United States Patent 7,745,391 (HUMAN THROMBOSPONDIN POLYPEPTIDE) - sequence listing, part 232

SEQ ID NO: 620383 - DNA, 900 bp, Homo sapiens
aggtctacaagacgctacttcccctatcatagaagagcttatcacctttcatgatcacgcccgtcataatcatttccttatctgcttccctagtcctgtatgcccttttccgtaacactcacaacaaaactacactacgtacgtaacagtctcaggacgctcaggaaagtagacaacccggtctggactattctctgtgccgcgactaactacttcgtagctccctcagtcgcccctcctcactctcctacgcactcccttttagcattaacaggacgagggtccaaccgagtccccttcgccttaccaatcacaacatccaatttggccaccaagtggtaactgaacctaaagagatacaacccgactacggcggataactcttccgactcctaacataacttaccccacatagatatcctaggaacccaggcgaactggcgaccctccttgacgtttgaccagatcgagtacgtaactcccgacattggaacgccccccattacgtataattaattcacatcacaaaagacgtcttgcactcattgaagattgtcaccacaatcaaggcttacagaaaaccagattgcccatgcccggaggtgtaacagcaaacccaagttgccacccgaggacaacgacgcgaggggtatactaacgggtcaacgtctgaaatctggggacgcgaaccaagtatcatgcccatcgtcccagaagtaaatccccggaaaaatcgatggaaataggggccgaagttgccccgattagaccacgtcatacccctcaacggcgacaacagcgccacacaacaccgtgggcgccgccccccaaggacagacaagggggcgaggccgcggaggaacaggcaaagggccagacaggagacaggccggcaaaaag

SEQ ID NO: 620384 - DNA, 470 bp, Homo sapiens
  misc_feature (428)..(428): n is a, c, g, or t
tcagaaaaacacacacacacacacacttatatatcaaactgtatatatatgtacatatatatatacaaactatatatatatgtacatacacacacacacagacacacatacacacacacacacacacacacaacacacacacacagtctcgctctgtcgcccaggctggggtgcagtggtgcatcgtcatcaccagacgatgatcttggctcactgcagcctctgcctcccaggttcaggcgattctcctgcctcagcctcccaaggaggtgggattagagaaggccgacactatgcctgggttaattttttgtacttttagtagagtcggagtttcaccatgttgggccagggtggtctcgaattcctgatgttcaggtgatccacccaccttgggcctcccaatttatggggttacgggtgtgatncactgtgcccagccttgatatgtttcttaattaaagttttat

SEQ ID NO: 620385 - DNA, 107 bp, Homo sapiens
tttggtgtgtcatgcagcagagtgtgagggcactgaggaggcaaactggcactaataaaccattcttctgtgacaaaggaaagggaggaaatcactactggggagaa

SEQ ID NO: 620386 - DNA, 1793 bp, Homo sapiens
  misc_feature (191)..(191): n is a, c, g, or t
gcagagcacataggacataggagacacactatacctattattcgcgcgcgtgagctgagacgatccataatgcatcgagactactaaagctctcactatgatcctgaagtccgagcgtagagcgacaccaagctcgagggcatatcctatcatagggataacctcacacaacaaattcatacaatactgtncatgcagttcatctagactcgcatgacgatattagttaattcacagtctctcatatacgattgaggatgataatgatgccacgattctagtgagattccgagacgcgtgtagaggagtcctatcatagtaccttatgttctctctcaccttagactaaactcctggatgacacgcactcggaatgattgtgccgtatttccctcgccgtcatgaaagaggacaagcagtacgaaggccgtgttcttggaactccaattagcccgtcaccatacgtgcatcctccttaacctacgctgggcttactggccaattttcgtgacgtggatcacggtagaggaggtgggccggaggaagccaaggaaaaaccaaggggtttaggacaactaaggttacctaacgcgcctaccccccttttcacgccgagtggaaagaacttacccttggcgcgaacacagcatggtgaggacgcgtatcgcggatgaggaccacctaataacccaattcgtgtgtcatcgcattataagcagcctggtaaggacagggtgtgggatcctctgcttccttacttcatataagggggggccaagtgtaaagaacaaatatccagatgcaagcagagcgaaactctaaattcgaattaggttaaagaaaccaccccctgcattgacccatgttaaagcccccccacaatttaactctaaaaaatctgggcgcaccccttcaatgtgcgtgaccttggaagttcaccggatgcgcataaaaattcgaacgcgaccaagtatcaccatagcttgtttattccctgaatcttcttgcctccaagtgtgcgcataaggcatggaactggggcaaattcctcctcattgtgcgtaaagctagaagcgacgagatgccggcgaaacactgtccaaagcatgcgcaaagcagtattcttgtcaggaacactgccggtcccgacgaaaggaaggggaatgaacgacgccatatgtacatactaacgcagaacacacataaattgtcttggaaatgtgtaatcgagagaacagacacccttggaaaaggttctgagtgatatacatttattcacttaccacaagggcttccgggaaacataggttcgtacccggtaacttgggaaacgaataacataacatccggtgcaaactagacaaggagaactcacaatctggggtagttaccaaataagggcaacaggggtccctgtaaagacataagtaaaatattacaaattgaggattataccaaaagcgacgaaatgatctcgagatgatagaagacaccgaagaagtgtgtatccacaggacggaacaataagcaggtacgacacacagcacgcagatattaacaaggacacggcaagacgaggacaagtcggtaaacacgcagcaggagacgcagcgaaataagtcagcgcacgaaacccaggagcacacataaacgctaagctagacggacacaagccagagacagactgacacagaagagggcaaccgaggagtagtacacacaaccagaacacaggagccacctacagcgagacgaacgtatacccgagtcacccagacagcgtggaaacacag

SEQ ID NO: 620387 - DNA, 141 bp, Homo sapiens
cgtcagacgctgaactatgtcctcaactacgaggttgcgttctctgctgcgatacccccaaattggttgccccgtgacctccgcattcgtcatagctgctttcctgctccttaaagggagagccaccagcccaactcagag

SEQ ID NO: 620388 - DNA, 219 bp, Homo sapiens
acgtgttcttcaagagagctacatttgaagccattgccccacaggttggcaatgatgctgtcattcctgaatattatactaaatgaattatactacgatggcacatagtatgccaatagttcagtggcgggacctatccttgcgagcagacggttagaagtccgggctaccgaggctcgcaattctgtagatcagtggtcattagcttgttctatccag

SEQ ID NO: 620389 - DNA, 1315 bp, Homo sapiens
tcctttattcgggtcctataccaccaaaaattagggacggggcttctcgtactcctttaacaaagtcttcctctctctatattttctttatctaagagaggtatatccgtatttcagaatctgggtgaaaggaagaccagcgagctctacttgtattcaactgggggatcaacgagtatctcataaaagcttacaggcaacctgggacttcctgggccacccaaaggaagcatctggggaaggttccaccaatgtgtgggctcccaggggaaaggccccataggtgtgcaggccaaggggcgcaggagtatcaagagatgtaggagaggccccccaaaaagcgcacgccacggggggaaacaggggcccaaagctccgggggataaaggtgggggttaccggggagtatcgcgcacggagggctcccaccccacccaggggcagcaaaaagacgcttggcaccatgtgggcgcttaaaagctctaggtgttggcccaaaaccagagaaaaaactaaagagctccttgtaaagcgctttccctataccgaggggagaaattaaaaactccctctatatcgcgggccattaaatggggtccaacccgcattctatataaccaaaaaagtctccccgtgtcaccaaaaacggcacattatcaccgagggcgcgttagtgtgcctcccacaaaagttgtccctggtgtgccccccccccaaacagcgtggccgtggcgaagccctctgtgggaaaccttacaagggggggaacccccctcttacccaccccaatgaggcaccagaataaaacccccgtaaggcaatggttgcgcaaccctgctggtgccaccacagagggggcgggcaaaaacttctatcatcccccgggggggcggcgggacaaaccacaaagtggcgtcgccacaacagttcccatgcggtccgcgaaaatctcatttgaccccacatatagggggaaaacaaacccggtgacagtaacaaaaaggtccccgcccaaatttgctgcggcctccaaggaaagccctataaaagcggaccctcgagggggggacgacacgaccccattcacagtatcccaccccccgcttgggaagaaattaaaccccccctctgtgtgatgtccgcagaacaagagcccacactcccgactgcagggccgacacccacacacccaagaccacacttctcctgggacaaaacaaccaggaggaggggaaccccgccccccgcaaaataggttagagtcgccccccccggaaaaacaattccctagagcgtgcgcttgctagcacaagac

SEQ ID NO: 620390 - DNA, 166 bp, Homo sapiens
ctgaactgggctgtgctgcgctaggctgggctgggctgagctgggctgggctgggctgcagcgagtattgtgcctggctgcaactgcgctgggctcaagctgagctgggctgcagctggagctgagcttgtagctgggctctagtcgcaacggcacgtgggggcat

SEQ ID NO: 620391 - DNA, 107 bp, Homo sapiens
  misc_feature (8)..(8): n is a, c, g, or t
  misc_feature (86)..(86): n is a, c, g, or t
  misc_feature (106)..(106): n is a, c, g, or t
tcaagaantggcacgaggcaagagatcatcatcatacgcggatccaggcacggaccactctgtgcattcggcctgacgtgggcaanttatgagaatattggaggcng

SEQ ID NO: 620392 - DNA, 887 bp, Homo sapiens
  misc_feature (503)..(503): n is a, c, g, or t
  misc_feature (509)..(509): n is a, c, g, or t
  misc_feature (679)..(679): n is a, c, g, or t
  misc_feature (701)..(701): n is a, c, g, or t
ggcctccttctgcctaggtcccaacgcttcggggcagggtgcggtctgcaataggaagccgagcgtcttgcaaggcattcccggtcgggcgaccagtctactcggccccggaccctactggtgcataccctagacacctccggggatccctaccgtgggagatccccggagccctcgccttcctgcgccagtcatgccttgaaaaccgcgactttgtccatgtcctcactgtccaggactggaggactgggaggatgaacttcgaccgggagaacgcagtgctcttcgaagtgggctgggaggtggctaacaaggtgggtggcatctacacggtgctgtagacgaaggcgaaggtgacatggggacgaatggggcgacagatctacttcctggtggggccgaacacggagcagggcgtgaggacccaggtggaacttggtggaggccctccaagcccggcacctgacgaggacactgagattccatgtaacagcaagggcatnccaggngtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgnacacctggttcctgggtgagtncctggcacagagtgaggagaagccacatgtggtcgctcccttccataaagtgagtggacacgcgctggacatcacgcctggtgtcgagcacgcaaactgcctggtacaaccatcatcacaaccatgacacgctgctgggagcgcaacctggtagcagtggccaggacttctacagaaacaggcaaa

SEQ ID NO: 620393 - DNA, 637 bp, Homo sapiens
  misc_feature (218)..(218): n is a, c, g, or t
  misc_feature (224)..(224): n is a, c, g, or t
  misc_feature (394)..(394): n is a, c, g, or t
  misc_feature (451)..(451): n is a, c, g, or t
  misc_feature (493)..(493): n is a, c, g, or t
  misc_feature (527)..(527): n is a, c, g, or t
taccagagagatggacaaaggtgttcaggaataaatcatgcaatagagaagtaaggctaaggcagcaggtgagaaattagcagcagatatggaaacagaagataagagagctgaggcttaagtctatagacatctgcctgcaaatgggagaaccacggatgagtgaagatatgaggctgaagcccagagcctccctatggtgcctccccaaccccatnccaggngtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgnacacctggttcctgggtgaggtaggccccgtctgacacattccacccatacctgaanctacaatgaccatcagcccctgggccagaggatgggcttctncctgggcattctgggagtcatagggtcctttaanccaaggattagctctggcctttgaggacatgaacatccaagggcccaggctctactctcgatgccaacttcatttactctagtcttacaagcatagggattcttggaatc

SEQ ID NO: 620394 - DNA, 126 bp, Homo sapiens
gagatagctagtgtagaaggagaaaaagacgacccacgaccaccgaacccacccaaaccgatgccaaatccaaaccccaaccaccctagtacctccggtagcttaacagatgcagacctagcggat

SEQ ID NO: 620395 - DNA, 104 bp, Homo sapiens
gagctaccctggcgctagctttctatgtggtcctagtttggctccaagtttacttggtcgatccaagtggcgtggcggcatggggtcacgcagctcgccatctg

SEQ ID NO: 620396 - DNA, 90 bp, Homo sapiens
tttttcccccccccccccccccccccttgggttttattttggtaatgttgggggggaaagaaaaaaaaaagtggatttttgcccccgtta

SEQ ID NO: 620397 - DNA, 551 bp, Homo sapiens
tagggagatggagtctcgctgtcgcccaggatggagtacaggggtgcaatctcggctcactgtaacctttgcctcccggacttaggagattctcctgggaggcggatcttgcagtgagccgaaatcacgccactgtactccagtctgggtgacagcaagactgtctcaaacgaaaaaaaaaaaccaaaaaaatagtaagtagcgttataaaaatgctttggcctcacagaccccgttgaggggatactaggattaccacctcccacagccagggtaccacactttgagaactgctttattagggtgacggtttcctaccccaccaaaaaggcaagccctccggtgttacaaacccctaacaaaagggtgccgtgtggcttgcacaagtgagaaagccacacagccagtaggttacggtggtacaggaagggaggcctaatataacctggctcgaaggagcgtaaggctttactctttaatgggccccattccaaagccccactccttcctcagagttttaggtttaaagggggaccatttttcgggccctg

SEQ ID NO: 620398 - DNA, 152 bp, Homo sapiens
ctgtcgacgatgattccgtcgaaatcccacaatgacagcggcacataaacggtcggcggtcactgtgtgcgtctcacgtggcattgaaatagtttgcctccgggtgatgcacgacgaaggcttagttgcgattggccaggatcaagctggaa

SEQ ID NO: 620399 - DNA, 585 bp, Homo sapiens
aaactttttatttattacagcccaaagagcagtatttattatcaaggagtgtccattttaccttgtccgcaccattttaaaccgataggacaataaagagatatgaataaacgcagaaaaaaaaacaaaaaacagaggagacagagacacagaactcataaaagatatcacacatggagagggggcccgaagcattgaggcgttacccgagctttctgtgtacaaaaggtggtctcccctatttgttgagcatcgtatattaagatagaggccataggcacctgtggcccggccgtttattacaaccgatcagggcaccgtgggaatacaactgtgccaagcctttggggcaatctgtgggtagaagggaaccccttaaatctcatggtgggttgtgaccaataattgtgagacaatattttagctctaacacgaacatatttgaaagggctcctaaaagtgttacaatcttacaaagttttcgcccactgtggtctcacatggtggttaacctctcacactgggcataacgcttggctgagccttcgaacaacgtttcggcgttaactggacgtatggattcaa

SEQ ID NO: 620400 - DNA, 229 bp, Homo sapiens
tggtagacgcattcatgactctgtccaccaaggtcaggagtacttctgcgctggagctgtgtcatgagggtgaatgaaatgagctgtggtatgtgtggttccccctacatcccttccctatagcacttcccagcaggaatagacctactgctgtgggtcccttagcatggaggaccaggatacaaggctgataaggtatcctccaaacagatgattacttccctaaaaa

SEQ ID NO: 620401 - DNA, 760 bp, Homo sapiens
ccttggcccatttccagaggggtccttactaatgagccctcgttgtgccccccccttatgggcgcgcgctaatgactccgaggttcccccccttcttctcgcctggtacgcccctcttgatccgctcaccggtccctcccgccagagcctcccatggcgtcgcgtgacgctaattttccccttcgccggcgaggttaagattgtcgctatgatctgtctgttccccaaccccagcaactgctttttcttgcgccgggtctctttcccgcgcgagttaaggcccacgcaccgcccggcacgccacccgaggtcacttccaccacgcactgtggcactgattcacacgcacctcccatggaagcacttctcactcctctcactccctcctgatacggctcacaatccactctctgtttttcctggcacacgcccacccgaatttatctttaacaggagggtttctacgctgccatttggaacaaacccccttccccgattttaactacagcctgccccttaatttcacccctaatgaagtgaaagaagatactccctcactgcacccggcggtgacgactaaacgattggtcgcaccccgctccgtcaccactcactttgctagcactccgctgtacaccagcgtactgttctgcgcactaaagagaggacaggagacgctagccccccccacccccggttcatcgccccacccacactcattaggctcctcacatggagattctgtacccacatagtacaa

SEQ ID NO: 620402 - DNA, 437 bp, Homo sapiens
  misc_feature (1)..(1): n is a, c, g, or t
ntcgtgagctacttggtgtcttactcctagggaaccaagaggggatgaaggcgtgaggagtcagaggccctgaggagtcagagcctctagagaagaaaggaaaatatgagaggccaaaggcaaagcctctaaacactttatctaaaaaatggcactcttttttatcgattcagttttgggactggaaaatacagaagacttcttggtttatacatggtcttgtaaaatactattacttacaactcaattgcaattccaagtattgaagcaatcgcagaattacctctggactacaaatttacaagattctcttcaagcaattcaaaaataactggctactatccaaaccttccattggtcttatcaaatgatcagacactgataaccaaataagttatctttactgaaaagtgaagtgaagacccatatatgcggct

SEQ ID NO: 620403 - DNA, 213 bp, Homo sapiens
cctgatgcggtcccgcacagcctctggtccagtgtcacatccctggagggcacccgtagccgctcccataccagcgagggcccccgaagccgctcgcacaccagtgaggggtcccgtagccgctcccataccagtgaggatgccgtctcaacatcaccccaactcgggtgcaccggaaacaatgcgggccaagttcattgaggtgtctgtaaa

SEQ ID NO: 620404 - DNA, 221 bp, Homo sapiens
gctctctcctgtcactgacaattttgttcctgtgcgtttccgtaagggcaccagacgtgacattatggatctccataccctacagccatcttgggacgagctcccggatcaggaaggctcggcagccaccgcacagtgcttcatagtaaagagtcacattgcacagcggtgcattggacttcttcagggtgcccccgtaaatatagaaaagtgcactttag

SEQ ID NO: 620405 - DNA, 225 bp, Homo sapiens
gtgactacaggacctccgctagcatatcaggacagtgaggcaggaggatcgttgaggcaggaacttgaggctgcagtgagctatgatcccaccaggcacttcagcctgggccacagaaccagaccctgtctctaaaaaaaatacaaaataaatttggtaacagaaatcgtttcttttctttttttttttttggaaagggattcccactgggtcccccgggctaaa

SEQ ID NO: 620406 - DNA, 157 bp, Homo sapiens
aacacttgaaatatgtaaattatttattcattcatcagaagttcatataaaataaaattcaaaatcaattggagctatataaaatgtcttatggtgcacaaaatatggtcttatatggctaagcatcttttttctgatgaagggattgtgccccgct

SEQ ID NO: 620407 - DNA, 485 bp, Homo sapiens
tgggggttaatctgggggcacagtcatgcaacccggtttatcttctgtctctgaatcctgatggcgctttagagtctagtcctcagcttggcaggtctaaaatattaacaggagatgaagctgaccagatgacacgaatatgtttccgcccatgggaggagaaggctacataggagaccaggtcatcagaagccgtttagtgagcacagagctggaacccaccagggagctgagagtccttcaagggtgtttctgtcaagcttgggtagctgggctcatagcccgtctccaactgcatcaacactgatgaagtctctcttcggctttttctaaacactatgcagggcagcatccttcagtcaacatatcttttatcagaaatcaggttataatcgattggatctctgctttcttcaattacagtccaggcctgtggatataaactagacactgtgattagatttggggcatttaccaagtcttta

SEQ ID NO: 620408 - DNA, 230 bp, Homo sapiens
  misc_feature (149)..(149): n is a, c, g, or t
agaggatcgttttctgcccacgactcgagttataggaagtgttcacgagagaggataacacatttgaatctattttttaaaaatcatactggaagctagcagtatgggtggtcgtttaaaaggttcctcatatactcttaaccttcagncaaaccatacaaggtttattcaattcaaaattctaagaactttctgtgaaccaaggagatttgggtagggaaaacatttct

SEQ ID NO: 620409 - DNA, 494 bp, Homo sapiens
atttataatgtggagaggtaaatctttgctggatatgggagcgtgattacccagagagtagagtgatttctcttgtgaagtattgctgagcgaggcggtggcatttgatcacacctataatcccagcactttggtgggctgaggagggcggatcacctgaggtcaggagtttgagaccagcctagccaacatggtgaaaccctgtctctactaataatacaacaattagccaggagtgcacatgcctgtaataccagctacttgggaagctgaggcaagagaatcacttgaacccgggaggtagaggttagagtgagcagagatcacaccactgcactccagcctgagcgacaaaagcaaactctgcctcaaaaaggttattataggcagcctcaggaaactacgtaggaaacatgtgctgtgccttaggcactataatttaagagtttaataaatgttaactcattcaatccccaataacaacactataaacc

SEQ ID NO: 620410 - DNA, 242 bp, Homo sapiens
tggagctggcggccaggttgatgcactgatggcatgagattaccttcatgaagctgtccttgatgcggagctgtcccagatgcagccgcttgtctctgccacctcagtggtcctctccatggacaccacccgctacctggacctggatagcatcatcgctgaggtcaaggcccagtatgaggagattgccaaccgcagcctgtgacagaagccgagtcctggtatcagaccaagtatggggt

SEQ ID NO: 620411 - DNA, 227 bp, Homo sapiens
aaagggaaaggggaccccccccttttttttgcccccttcccgggtttaatttgggggccaagaaaaaaaaaagggtttttccggggcttgggggaaacggtttttttttctccctccccgcgcccccccaaaattttgtttttttttttcccccctttccccccttttggggaaagtgtcccccttggtgggggaccccaattaaattttttatatttaacccccca

SEQ ID NO: 620412 - DNA, 767 bp, Homo sapiens
agcgttcctggcagtgacgacaacgaaaaatcaggttaagtgtgatcgcagttacttggatataaagatgaaagggcaagtaagcagctagttttctgaaaactgatttaccaggtttaggttgatgtcatctaatagtgccagaattttgaatgtttgaacttctgtttttgctagattaatccccatttcttcatatatcattttgaggcttgggggtcttcattatactaccacttgttctttagtgacaagaaggctgattacatatgactataagacagagaaatagctttaaggtgactttaaggagatatgaatgagaaagaaacaatgatgatctttgagtgtagagagtaatttgcgcaagattattagtggctcagctgaaggcttggcgaaattggtaccataagcgtgtattgaacatatattttattttggattgccgacttgaaatttgtataatttgtgtcgcttgtattctgttctacataaaatcagaaacttcaagctctctaaataaaatgaaggactatatctagtggtatttcacaatgaatatcatgaactctcaaatgggtaggtttcatcctaagccattgccactctgtttcctgagagatacctcacattccaatgccaaagatttctgcacagggaacctaagaggtggatacacgttgttgcaagtataaaagcatcatgggatttaaggagaattgggagaatgtacccaaaaatggggaataataaatggataaggt

SEQ ID NO: 620413 - DNA, 535 bp, Homo sapiens
  misc_feature (5)..(5): n is a, c, g, or t
  misc_feature (65)..(66): n is a, c, g, or t
  misc_feature (73)..(73): n is a, c, g, or t
  misc_feature (80)..(85): n is a, c, g, or t
  misc_feature (89)..(89): n is a, c, g, or t
  misc_feature (96)..(96): n is a, c, g, or t
  misc_feature (98)..(98): n is a, c, g, or t
  misc_feature (101)..(101): n is a, c, g, or t
  misc_feature (119)..(119): n is a, c, g, or t
  misc_feature (142)..(142): n is a, c, g, or t
  misc_feature (150)..(150): n is a, c, g, or t
  misc_feature (152)..(152): n is a, c, g, or t
  misc_feature (167)..(167): n is a, c, g, or t
  misc_feature (225)..(225): n is a, c, g, or t
  misc_feature (236)..(236): n is a, c, g, or t
  misc_feature (245)..(245): n is a, c, g, or t
  misc_feature (251)..(251): n is a, c, g, or t
  misc_feature (264)..(264): n is a, c, g, or t
  misc_feature (268)..(268): n is a, c, g, or t
  misc_feature (270)..(270): n is a, c, g, or t
  misc_feature (303)..(303): n is a, c, g, or t
  misc_feature (311)..(311): n is a, c, g, or t
  misc_feature (313)..(313): n is a, c, g, or t
  misc_feature (316)..(316): n is a, c, g, or t
  misc_feature (336)..(336): n is a, c, g, or t
  misc_feature (348)..(348): n is a, c, g, or t
  misc_feature (382)..(382): n is a, c, g, or t
  misc_feature (385)..(385): n is a, c, g, or t
  misc_feature (387)..(387): n is a, c, g, or t
  misc_feature (390)..(391): n is a, c, g, or t
  misc_feature (405)..(405): n is a, c, g, or t
  misc_feature (441)..(441): n is a, c, g, or t
  misc_feature (486)..(486): n is a, c, g, or t
tgggnggcccgaggagaggaagacacacatgcctttccagaagggagatgccctttgacctctgnntcctggngcagagnnnnnntttnaaggtgntnggngaacgggatcctcttcgngcagtacttccaccgcgtgcccntccaccgngnggacaccatctccgncaatggctctgtgcagctgtcctacatcagcttccagaacccccgcacagtccctgtncagcctgcctnctccacggngccgtnctcccagcctgtntgtntnccacccaggcccagggggcgcagacaaaaaccncccggcgngnggnctgccaacccggctcccatnacccagacagtnatccacacagtgcagagcgcccctggacagatgngcncnacnnccgccatcccaccnatgatgtacccccaccccgcctatgcgatgcctttnatcaccaccattctggggagggctgtacccatccaagtgcatccncctgtgaggcactgtcctgcccagtgctcagagggtccacatcaacctg

SEQ ID NO: 620414 - DNA, 1362 bp, Homo sapiens
gagagccctgagcagccccaccgccgccgaccggacctagattaccaatcacaccccgggaggagccgcagactgccgcagaccggaccccagtcgaccatcaccgcgaaccatgagcagcgaggccgagacccagcagtcgggagacgtacgtacagagagagctgggtatgaagtaaggtgggacccacagtcccacgggaatacatcgtaccagcgggacagaccgtatgcgaggcggaccgaggccggcacaaaaaactacacacaaccacccacacacacaaagggcaaccaggcacacgaccgaccgcgaccgaacacgaacaagagacaagacagttcaccacaccgccccaccacgacaagacgcaccgcgcccgccgcgcgcaacgccacgcagacacggcgcaacgacgcggcccacagcggccccccgagccagcaaggacacccgacaccccccaccacgaccggcagatacgcgcgcaccaacacacccggggccactaccaagccaccaaccacccgcccaatccccgcacgacaacacccaaccaccgccacggcgcaccccttcaacagacaacaaccgcccaccacaaacaacaccccagacgcgccgccgaccaaccagtcggcacgcactacgcgcccgaacgactacccggaacaccaagcaacacacaagacggagcgcacccgacaacagcaccaacacgaacgagaacgcgaccacggaccccagtctgcagatacagcagcggacacataaagcagtcaccgacacggcgagcacagccaaaaagaggcaaccgagagcagagcccgaagcgaggagccaaggcaaaacgcccaccccgcaccacacccaaacccacaagcacgcacaaacaagcccgacaacccaacagccagcccagcacaagccgacataagcaccacaagacaacagagcgagcaccaccgtaccaatagaccgatacgatcgacaaagcgcacgcaaccaacgcccgtccacagacgaaacggagcggcaaaagaccgagcgagcgagcgcgccaagcccagcaaaagacaagacgcgcgacgaggggaagagaggagggagggggccaaccacggacgacggagaacgcgcggagacgcacaggacaggagagaccgggaggcgacccgacgaaagcaccaacaccacacgagcagtggcccaaggagaacacagacagcagcaaacgagagagagaaaaaaagaacggcagaagagtcacgagcggcagcgaccacgcaagcagaggcaaggcagaggagcaaagcgagagagagagcagacacgcagtgcaagacgagccgaagaagagc

SEQ ID NO: 620415 - DNA, 695 bp, Homo sapiens
agctgtcaccaggacaccgctatcaccaggaaagatcatactcatcagagatgaatgctcacatcccaaagaatttcctcagatagcttctgtgtagatgttatgtgaagatatttccctttctactgtaggccacaacgtgctccaaatatccacttgcagattctacaaatagagtgtttctaaactgctcaatcaaaggaaaggttcaaatctgtgagatgaacaaacacatcacaaacaagtttctcagaatgcttctgtctagttaatatgtgaagatatttcattttccaccatagactcaagacgctcgaaatgtccacttgcagattctacaaaaagagtattttaaagctggtccaacaaaagaaaggttcaactctgggagatgaatgcgcacatcacaaagaagtttctcagattgcttctgtctagattttatgtgaagatatttcgttttctaccacaggccacaaagcactcgaaatgtccacttgcagattctacaaaaagagtgtctccaaactgctcaatcaaaagaaagtttcacatctgtgagatgaacacatacatcacaaagaagttctcagaattcttctgtctagttttatgtgaagatataccttttccacattagactctaagcgcccaatgtcatttgagttctaaaaaagagagtcaaactgctcatc

SEQ ID NO: 620416 - DNA, 1077 bp, Homo sapiens
tccgatggttctaaaatttacaataaaggggtggggcaaagggttgtagaattgggctcgaaaagctccctcaaggttccgtgaggggacctcccctgtgaagccaaggcagtatggaggtctccatacatatatctcgtggtcgtgggactctataggcaaagcccgcgggccccttgggagagccagcaaccagagggtctcccgaacgacaccccacgcgaaagagggggctcgaagcggtgcacgaggcgtgggaaccacgccgcggaagatctcattgtgagccccatcggtgggggaaggagcagtctcccgagggaacccgagaggaagggtgaattctcccgcgagtcacaagagtgcatccgagaggtataatcacacacaaacagcggggaaaaggacctacgacaaagagagacaggaggagaggagagaccccgagatgtcaacagacacagtgtgtgaggcacggcgggagaaagaaaatcagaagaacaacaaacaatgagaggacacatgaggaggaaggagacagggcacacctactaaaagagagccacacctgggtgcaccccaaagacaccccaagtcgaagaaaacgaagaaacagaggaaatccgaggaaggcgagaatgtactaacaagcgggcggagcagtgagaaacccaaactattacgcataattcatcacgaggagaacgcgcgcatcaagagggtaaaaacacagcgaggaggaggggaacacagcaaaaagcgacagacagataaggttgagacacaaaagagaagacggaggaacaaaaaaagaggccataggcagagtggagaagaacagagcaaacacacaccatagatggcacgacggcccaaggacacaataagagagcaaggagacgagacaacaaaacaaccaagccccccgttcggactggagacacagagaataaaccaacaaaacataaccacagcatgaggagagatatagtcgcacacaaacaccggagcgaataaagaaaactacacgtggaagaatagacgaacccaggaatagaacacaccaatgagagaggg

SEQ ID NO: 620417 - DNA, 240 bp, Homo sapiens
  misc_feature (6)..(6): n is a, c, g, or t
aggtantcatatgtatgatgtccttcaatttcttagcagctactgatcctctgtctgtagaattgcttgagtagatttgcaaaacactttgtacaacattcagggctttctattttttcttcagcaagctcttcttcctcagcagttttcttttcacttaccactccccgtgcctcggtctcttccctccagcactgttttctctgctggctcctctcctgctcactggcgtgtgtgggg

SEQ ID NO: 620418 - DNA, 118 bp, Homo sapiens
ggaacgatccaccgcgatgaattaccaagcacccgggggaccggcggcggcgatgactctggaacgcgagccggaccattccagtaaataacacaagttgtgtggggcgtcacggccg

SEQ ID NO: 620419 - DNA, 476 bp, Homo sapiens
agctcctgatacaggaggggaccccaagggggttgcctttgctggctcgaatgcctgggtttatatcccgatccttgtcccctcccactgtgctctcaggcaatagatgattggctatttctttacctcctgtttttgccaaattagcatttagtgagctctctgattggacagctgtgggctcagttgcaagccccgtgtataaaggtggatgtggtcaccttcccagctaggcttagggattcttagtcagcctaggaaatccagctagtcttgtctctcactagcacaaaccatgtagtttaattgccaggaggtctgtcattaaacatgacaatgtttaataggagattagacttctcactgaatgtgtttgtttcccaggagcactgccttgcgaaagggaattaattcatcatttcatcgcagacctgctgtgtaaacattttcatctcaccgcataacaatgtctctgc

SEQ ID NO: 620420 - DNA, 539 bp, Homo sapiens
  misc_feature (510)..(510): n is a, c, g, or t
acagctatcgccgtgactacggtttcgctggcctctatctttcaccagcagacttctctccactatcaatctgattctctctccgagccgtttctaatccttcttgaacacaccgttgctggctttgcatttctctttcctccaaaagtgccgaggcctcaatttactcactgctgaaaaaggaggactctatatttgtaaatgaagagtgttgcttttacctaaatcaatctgccctggtatatgacaacataaaaaaactcaaggatagagcccaaaatttcaccaaccaagcaaacaataacgttgaatccacttggacactaattggtcatcctgggtactaccaactcttaggcctttaatacctatttttctcctcttttattcggaccttgtgtctttcatttagtttctcaagtcatacaaaaccacatccaggccatcaccaatcattctatacaacaggtgctccttctaacagccccacaatatcaccccttaccacanaatgttccttcagcctaatctctcccact

SEQ ID NO: 620421 - DNA, 377 bp, Homo sapiens
catactttgataaacaaattgcatggtatgtgaaccacatttcaataaagttgttatttaaaaaaagaaaatagcagcctggacccagatggcccatggctgcctataatcccagcactttgggaggctgagacaggaggatcaattgaggacaggagtttgagatcatcctgggcagcataacacgatcccatttttacaacaaaaaaataaaaaatttagctttgcatggtggtgtacgtctgtggtccaagctacttgggaggctgaggcgggagtactgcttgagcccaggagtttgaatctacagcgagccatgatcacaccactgcattgcagcctgggcgacagagcgagactccgtctcaaaaaaaaaa

SEQ ID NO: 620422 - DNA, 101 bp, Homo sapiens
tgttgcatatggattatataaactgaagagcagggaaggaggctttgccatcttcagggaaggaggctttgccatctcagggaaggaggctttgccatctt

SEQ ID NO: 620423 - DNA, 111 bp, Homo sapiens
acgaaaaccaaagtgcatgtttggcatgtcacatgtgcaaatcattcagtatggcggcatgcaagccagcatcagtgcaggcaaccagttgcagcccaatcatgcacgtgc

SEQ ID NO: 620424 - DNA, 152 bp, Homo sapiens
actgatggctgaggggagtcaggggtggagacctaattgcgcgctgatttgcctgctgttcgcaggaggaggcctagctactggggtgaggcttggattagcgtttagaagggctatttagttgtgggtactcatgagttggagtagaatga

SEQ ID NO: 620425 - DNA, 1084 bp, Homo sapiens
gcagccacacagtccgagggcagagccaggctctgtgagagcagctagcatgctaaaaccctttggttatttgcttgaaggtatctttagcttacggcttcatctgcccatgactttgtttattgtttcttggagactgggagtccttgctcaggtgcgcccaggattcctgggtgcgaggtgcgcgtggatgttgggtctccaaggcgtcgcgtgtgcattgtacaggcatgttggcacccaagcgctggtgcacatatattcaggctttgtttcgggggtacccaggagcaggtatttgccccaatgtgtggggctcagggtggtgagtctccatacgtcccggccctctagggtgtactctctggcccgcttaggtcctcccagaagtctgctggcgatttcttcctgtgtttagcccacgctggcgcccgacccctgcagcctcagtgcatattattgcaagcgggcgtctacagtcgccctgttagcatgctcattttcgagtggggcctcttggaaacttgtggttgcgcttggagggttgccgcctggggggttgtcagctggctggccgtgggcgatgaccatgctttccacgcctgtttttatggttcaccgtcaatccgtgcttgttccctcggtaggcatttgactcttggaaaggattaatttacgcctatcggcctgagagtgcccccggtagtcactggggttaacagttgccttcggcaccgagtagcgaactatcctttcttccatattgatgtccctcgaccacgaaaacttatctctcggtatagcagaatacgtcgtggcttgtcctaccgcagaaaaggctctgcgcagagcaaattctcggaagattgcccgggctggtcgtcgcctcccatcatagttttacccccgtggcttattagaggaattaacacagactttggggcggcgcacgctctgggttgtctcctggagcgccaataatcaatacctgtgtcgccaaggcggggtaccagaaggccggcattacctttcacttccttgcggtggaccatgtccgagggggttcgcgcaaataccaaggatg

SEQ ID NO: 620426 - DNA, 832 bp, Homo sapiens
tgcggtggctcatgcctgtaatcccagcacttgggaggccgaggcaagcggatcacgaggtcaggagatcgagaccacggtgaaaccccatctctactaaaaatactaaaaattagcctgggtgtggtggtgggggacctgtggtcccagttagacgggagggtgagggaggagaatggtagtgaacattaggaggcggagcttggagtgagcggagatagcgccgactggatctcagcctggggatagagcaaggatgacatctcaaaaagaatgacatagcaaaaagcataatggcagtgtaaatccaatatattgataatatcattggtatgaatgggttaagtaattaggtccaatggcgaggttgtcagatcagaaacttttctacctgaatttaggtagatagaaaaagtagagagaatatcaggaagaaaatataagggatgaacaagatgttaagaaatataaatagcttctacagaaatctcctctggaagattagaagtagcacataggtgggcgggggggtggggttatgcctgtatcgtgggctttgtggagggcagggggggtggatcaccttaatgttcggaaggtccagaacaagctgtgccagaagaagcaacctaatctctacaaaaaaacacaaatacgcccagcatgtggcagcgcatgacaacacactaccaggcggacgaaacgacgacaaaggccgccaccaactcaaaaaatatccaaaagagatagtataaaggcgcgaacagacaacaccacacaaaccacaaagaaaccacgcacatcaacaatttcaaacaaaaacaccgccaaa

SEQ ID NO: 620427 - DNA, 178 bp, Homo sapiens
tgtgaagcggttgtgtatgttggtatctcgcaagtggggaggggggttgtccggagagaaatgggatgttctaagggttctgattgcagagggatagagggggcctcctccgctctctgatctcaccgctccccgaattcacacctccgacccccctccgcatacacaagccgcttca

SEQ ID NO: 620428 - DNA, 289 bp, Homo sapiens
gtgagtaaggggcacgtgggccaaccccaatctgagaaagggtgacacagaccagcagggacacttccccgtggccaagaaacatgttggcccacaaagtcaccttgagttacgggggcaaacagcatctgtacccaagctaaatggccatatctcaggaagggcaagcaaccgggtggatttcttctctcgaacaggcatggagagggggggatgtgcagggcgcagggtgcaatcaatcataattgggagtgaacacagccaagcaataattgttccatatgccatt

SEQ ID NO: 620429 - DNA, 979 bp, Homo sapiens
cacaggctaattatcaaaatgattgctctattatagaatgagagccactgctgcaatctacttaattgaggtgttccgccaatcctttcggatcgaagccccgtgaacaatccggcgctcgtgattgactaagacaaagcatgatctacctgacgcccgtgcacgaatatgtggacacagctgaatgaccggattctatcaagtgagctccaccttatcggcgtaataaggacagctgctgacctgcaccgtagttactgatgtctgccctatgaagagttctagccgttaatctccatggaacattcgatagtgcaacgggaactaaattgatatttactattgatcctgctatctgttagaaccacaataagggaatttctaaaaccctggaggaataatctatcaaaaacgctcgaggtgctgagcgaacgcgacgcacaagaaaacggcgcatggagctaggcgagaggtccctatttacgtgttcacttaatttggtagcaatgccataggttacgtggtattcccacttttctgccccagtgatgacgagtcccggcagtaaaaccttaaagggttcaatggacctagtcatagggggggtcacatatatatcattgggctactatacacttcgattccgtcaaatcgcaacgctagatgaatagttaagtaccaagagttgctcgtttatggcaggaaacaaaacagttttaacttatttgaatgcgtaggccttgatcagctaggagtcaacgcatttgttagtgacaattacatagggaatcaacccttatttaatcgggagtgtcacaccattagattgggtcttccccattaatctgtgccattgtcagaatttggccccgccaaaagtgtgggggcctcaattgaggtatctaagcccgcaggtcaattcctggggcaatataggagccagttaatggagtaacttgaacgacctcctattggattc

SEQ ID NO: 620430 - DNA, 181 bp, Homo sapiens
tggctaatttttgtatttatgtagagtagtgggattttgtcatgttgcccaggctggacttgaactactgggctcaagcaatcctcctgctttgccctcccaaagtgctgggattacaggcattcagcccgtcggcccgggccccccccaatttactccttaaagggtaacatcacttatt

SEQ ID NO: 620431 - DNA, 184 bp, Homo sapiens
cagaaccactgcctagaaaccaccctctcctgaccctgaagaactgtgtgattctgccccacattggcagtgcacccacagaacccgcaacaccatgtccttgttggcagctacaacttgctggctggctgagaggggagccgatgctagtgaactcaagctgtagcaaacagtagagatggag

SEQ ID NO: 620432 - DNA, 343 bp, Homo sapiens
  misc_feature (90)..(90): n is a, c, g, or t
  misc_feature (113)..(113): n is a, c, g, or t
  misc_feature (122)..(122): n is a, c, g, or t
  misc_feature (137)..(137): n is a, c, g, or t
  misc_feature (159)..(159): n is a, c, g, or t
aaattcgggcaccgagagcattttccatttggttcgtttaaaaccaaagaacaacaacaacaaaacaaagccccaggtttggtgactganacctgtaaaactagcactttganaggctgaancgggacgattgcttnaggcccaggagttggagatcancctgggcaaaaaagcgagaccccatctctaccaaaaaaaaaaaaaaagatggctggatgtggtggcacatacctgtggtcccagctacttgggaggctgaggtgggaggatcacgtgagcccaggaatccaagtcaatgtgagttactgtcacgctgctgcactccagcttgagtaacagggtg

SEQ ID NO: 620433 - DNA, 395 bp, Homo sapiens
atgagactctgtatctcatcttcaaaaacaatgtgtataagtgatacaggccagtgcagggctgacttattatcccagcactatgggaggccaagtgggacagatagctttagagcccaggggtttaagaccagcctgggcaacagggcgaaaccctgcctctacaaaaaataaataaataaaaataaaattagccaggcatggtggcttgttctggtagtcccagctactcaggggacttgagcctaggaggtcaaggctgcagtaggccgtgattgtgccactgcactccagcctgggtgacagagcgagaccctgtctcaaaaataataataataggccgggcgtggtgggtcacacctgtaatcccagcacttcgagaggccaaagcatgt

SEQ ID NO: 620434 - DNA, 1268 bp, Homo sapiens
ccgaggactctcccagtggaggtactgcaagttccaccccgaggcatctgacggcattctggtgagcgcagcaggcaccactgtgaactgtctgggacgcagccaagcagcagcccctgacagagctggcagcccatggggacctggtgcagcgcgccgtctggagccgagatggagaccctggtgggcacggcgtgcaatggacaagcagcatgcggatctttgacacccagaacaaagccgctgggcctctcagagcacgcaggcccatgagaccaccgcagggatagccggctggccatggatgggccacctgggacgcaccttgtgtctactggattcaaccagatgacgtgagcgacgaagtgaagctgtgtggacacgcaggtacattactccagacgccctgagcactccctcaccttggaccccctcgcttgaggatgtcctcgtgcctctgcatggacccctgactctgggctcctggtccatggacaggaaagggcgagaggcaagctgtaccatgctacgacgtgagtccacgcacgcagccgagcgactgagcccaggatgacccagatgtgatccctggacaagccgtgcatgcacatgggagcatgcacccaacgcacgcccaccggcacagcgcaacctacgccgcatccatgaacacacgcccagagacccccccgcgcgtcaccaacgaggcatgcagcgcgacacacaagacccatccgagcacacacacgacggctacccaatcgatgaccacccggcaagggcacgcgggcacgcaccaccacagaacgggaaaccctcgcactaccccgggaccaccctaggcccgccggcatgccgtcgcccatgacaaaccggaaccacccgcagatagacaaacgacacgaacactaggaggcacacaacacacacaccaccgtcacgcacaacaacggcacagagaacgacggacggcgccacgaacggagggcaggcgccagcccaaccaggacgacggccacacgacaacgagcaaccgcaccacggaagtcgagacacagtacacaggaagcgcccgaacgccagcgacaacccaccgacacacggccacgacaggcagaacacggcagcacaccacaacgaaaccgcagacgcgacccgaacgcgagaggccgcacgggccacacacacgcagaggcacacaaccagccacccacacacacagcacacgcacacccgcaccacgccgcacgccgccaacagcgggcacc

SEQ ID NO: 620435 - DNA, 90 bp, Homo sapiens
actattcaaagtttactgacctccccagccagcaggccaacccttccgagcaggggaaatgtccatccagcttcccttgcgtttaaggcc

SEQ ID NO: 620436 - DNA, 993 bp, Homo sapiens
ggcggtagcatcgcggagtcggtgctttagcacgccgtgacaccttatactctcgcggcggcagaacccgttagagctcggtatcctagtgcacacgcctgaagcgaggggccatgttttctgattccagtcctgcgtacggagttgaaggtggatcgcagcagttaccagtgtgctgcgtgggaacagttgcacatttggttatctagcttacaaaagatttatgttaaaagatcattcgaaattaagggttatgaataaaatcttcaatatccaagaaaagaaacccccaaagaatagtacatgctttggactagtggaagggatgtggggagattaaagctgtgtgtactgccggtttgtggggaggtttccaaaaagttcccattctggtgagtggggctcaaacaaaacataagggaagagactgagacaaatgtgggccctcctgatcaatcaaagaacacaaagacactttaaagtgggaccacttttggatgctgcaaatcagttgtcagtgaagttaccctgaatgtggttatagaatggataccaactctgttctggatacacttcgtggatttctaaatgtggtatatgggaactggagttttcacatatatggcatttgtccttgttgaacccactggtgctggcccatttggtttcacaccacaagacacacaccaccagggggcaaacgccaaaaacacacaccaacacacaaacttcgtgtgccggcgccgtggacacacgaaaaagttaaacacatctgtggagccagcccagtagtacgtaacgtggcatggtcttccacgcaaccgggcgactgctgggtgattcacccaaaaaagccgggacacgttggacaacacgagtgggcgcatgggtcaaaggcacggctaaccccgacgcgtggaaaagaacaaagacgacgcgaaacgacgacagagaacgaccacatcaccgacgagaccgagacaacacagaaca

SEQ ID NO: 620437 - DNA, 307 bp, Homo sapiens
gggtgacagagtaagattctgtttcaaaaaaaatttttttaataaaataaataaaaataaataacctttttttgaaaaaagaatgttggccgggtgcagtggcttactcctgtaatcccagcactctgggaggccaaggcaggtagatttcttgaggtcaggagttgagaccagcgtggccaacatggcgaaacctgtctctactaaaaatacaaaaattagctggatgtggtggcaggcacctgtagttccagctactcaggaggttgaggcaggagaatcgcttgaatgtgggaggtggaggttg

SEQ ID NO: 620438 - DNA, 307 bp, Homo sapiens
tgatctagaggatctgggagttaggggacaggacaccaagcaatacatgcagatctgtgtgtgtggacagaaggtacttgagagatggagtttggtatatagaaacagaatgaataaatgaacttgtatctttgaactttttttgcaagaggtaagtagaagattcaatttgattcttctagaggggggaaaaaggagtggggagtaggtcttcattaggcggtcatcatctggacgaattcttcatagtggatttgtccgactccatcagtatgtgttcctctgatcatgtcatctacttcttcat

SEQ ID NO: 620439 - DNA, 503 bp, Homo sapiens
gtcgaggtaccaacaggagaatattggtcttcggttgctctagtttagaccaatacttcacatgactgatgtaaactggtggctagtttcggaaaggtttctcatatcaatcctgtagaaatctccacatgagtcacaaacacaaattgttcagtatctggggaattcaaagccctttcctcaaaacagacatttctcctatatcatatctttcttcagggggaagtattgagaagtcattgagaagtcattccgcaaccactatgaggagagaaacgcaaggccaggaaagggaagaagtacacagggattcacggggacagtggtgatggggctgagcactggcttccagaactggtggtggggaatggagggggcagcaccctctcaatggcatgtggaccctcctcaatgtgattgaatgaccggggttctttggaggaagctccttgtaagaatcggtttaggtctctctgatgaagtaacgatggattctgcagaga

SEQ ID NO: 620440 - DNA, 154 bp, Homo sapiens
tctctcacactgggcgacagagctagactcctcaaaaaaaaaaaaaaagaataagatttgtaagttagattaacaattttaagggactattgggtccataaaagggattttggatattttaattagcatattaaatgattgccagtgtggagag

SEQ ID NO: 620441 - DNA, 192 bp, Homo sapiens
agaagtaacctataagaactcaccattacaaagaacacctcatgaactaatgagaagagaaagcaacagattaatctagcaccttcttatcttgccagaagtctagcagatgtccctagaagagtatggttcttctccagtcatttgtcaacggcaagttagtaatagcatgttgcaaacatggagactctg

SEQ ID NO: 620442 - DNA, 917 bp, Homo sapiens
tatctgcctctgggcacttgaggggcctcaggaagtgtgtgcttgtggctgcatctgcccgtctccctggcccaccatgtggctgcaggccaagctcttcatgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggttgtcttttgtcttttttttttttttttttttttacaccaactcattaatgaaattgggcttcagcccccagtgttggccttgaacaaagggcacagccctgtggggttggtgcaaaaaagtttgaatacccagggtggcacggtgggggttctgggggtaggtaggtcacctctcctttgggagaatttctttggtaacaagaacaattttttgtaacaccgaaatcgggggttggaaatagacgctggagccctcctctgggaatatcagcctaagaaactcatggatatgaattcacccgaaattctcatttgccataggcgagctttagagaagatgttctctaccaggttgtactaccgggtaatctgctcagcggtgagaagtggcgggccattgttttttatggaggtttttacgaggatgccggatataattcacccctttatattcaatattgttcaaaaaaggtccggcctatcagggcctaccgaatggtagcctaagggcttttaaaaaaagggggctagtatcgggggccgatcaccctgtaaggctggggatacacggcgcacggaaggtggactgggtcacaaagatgtgtattgtgcaaaataa

SEQ ID NO: 620443 - DNA, 493 bp, Homo sapiens
agaggcagatggagccggggttgggcctaaggccgaatcagtagttggggctgcaatggcttctgcaatagcaccacctcccggggtgacagaggcccttggggctgcaaaagcccctgcaatggcaggggctcccaaagtggcagaagctcccagagaagcggagacttccagggcagcggtgcctcctgggacagtggtgcctaccgaagcgggtgcacccactgaggggaccgaggggtcctggggtagcaacaccctaccaaggaagctgaagctcccggggtggcatcgcctaccgaggcagctgaggcttctgtgcccgcaacacctactggggctgcagaacctactgggggctgatgaaatctcctgggaacttttgagttccccaaaatcaggggagggtacctggaaacatatactgcccaataaatgcaatcccgtgggggcttaacactgggggcttttcccgtaagtccacattcagctg

SEQ ID NO: 620444 - DNA, 405 bp, Homo sapiens
ggcagaggagtgtaacttggaaaccgatgctagatattagcctgttagtttatctcaatttaaccttatatcagactctctaaaatagagtctgaacttaaaagatttggtgccttaagagtagttacttttaaaatattttgcaatgatgttagtttttaagaagtagttttgctgatatttgtagtcacattttctcttaatatgttagaagacgaagataacagctaaacttggatttattgttgtattagttaagaaacgggtcttatctatttactcaccctggattctctgctctctgatggagcccttctgaaatctatactctgagatcctagtgctatatactctgtagcagggaacctatcaacaacacagtactctgaaagccctggtcgacgc

SEQ ID NO: 620445 - DNA, 450 bp, Homo sapiens
  misc_feature (306)..(306): n is a, c, g, or t
  misc_feature (369)..(369): n is a, c, g, or t
  misc_feature (439)..(439): n is a, c, g, or t
caaatgtgactctttttgcaaaaataaaacattgcagaatatttgtaagccttaaatcaacaaaaattaactatgcaaacctctggatgattctaaataagattaaatgatttctaatgattttagcagtcttctgttagattgagttgcttcatccttctgcactcccaggtatttgtgaaaataacagggaatttttcctatcacaggaaacattcttttgaatacagtggcataaattcttggatttctcctggattcttgacttttcattaaagtttatgctgatgtaaagctgaggcaaancaatatatttctgtacttgggggctcagaaagagggaaaaatagttctttgtcacttccgatnaatatttgccacttcctcgcctacctggccccttcaacaaagggggactttctgcagtccacttgagggntttccatatac

SEQ ID NO: 620446 - DNA, 189 bp, Homo sapiens
  misc_feature (11)..(11): n is a, c, g, or t
tgagggggccntgaggcgagcggttagagcgtctcccggaaggatgggccggtctcggagccggagctcgtccgtccaagcaacaagcaagacaagaagacgtcctgatccgacagagtggagcgtcattcgaataggacggggggagtggcgtcgctacggcggtcgggaggacgggcgcctgccccc

SEQ ID NO: 620447 - DNA, 328 bp, Homo sapiens
  misc_feature (36)..(36): n is a, c, g, or t
  misc_feature (104)..(104): n is a, c, g, or t
  misc_feature (164)..(164): n is a, c, g, or t
  misc_feature (171)..(171): n is a, c, g, or t
  misc_feature (173)..(173): n is a, c, g, or t
  misc_feature (183)..(183): n is a, c, g, or t
  misc_feature (203)..(203): n is a, c, g, or t
  misc_feature (206)..(206): n is a, c, g, or t
  misc_feature (216)..(216): n is a, c, g, or t
  misc_feature (225)..(227): n is a, c, g, or t
  misc_feature (236)..(236): n is a, c, g, or t
  misc_feature (308)..(308): n is a, c, g, or t
aacactggcaggtgggtcaaaacgctactggtagcnggaggaacgactaaagcaaagtattaccataaggctaaaacatatggcctgacaaatgcctgccaggnacactacacataaggcatgtcttcagtgtcccttcgtggggccctgcagccacccctganttccctncnccccctaggntagacggggtcctgtaaatntcnttgcatccanaaaaacgcnnncaatttctntctgcctttcctccttttatcctccaccctagccatgttgtcaaattctcttatcatgtcctcattgctganattcatatcatgtatggctt

SEQ ID NO: 620448 - DNA, 481 bp, Homo sapiens
ttgacatttatagccaagtgagtatactcaatgtctctgctgtggtacaagagtacgggaaacagaaaacaagattactatcactactgaccagggccgtccgaccaaggaagacatcgaacgtatcgtccaggaagctgctaagtcccacagtctcgaagatgaccagcccagggacaatggtgctcctccaagaccttcatttgaatcctattccttcaacatgctctgcaactgtcgaagatgagaaactccaaggctagattaacgatcaggcccatccacaatattctggcccaagtgtcatgaaattactcaactggcttgataagaatcagactgctgagaaggaagaatttgaacatcaacatgaaagagctggataaggctttgcatccccatcatcaccaatgctgtaccagatgtgcaggacgcctgccaggagtgcatgcccggcgtctaggagtgtggcgtccgagga

SEQ ID NO: 620449 - DNA, 405 bp, Homo sapiens
aagctgtgtgttctttggcggtcgttcatgtcagcagatctcctctcactcgtcgtcgaccgtcgtctatcacttcgacgtcgctggctcggagcgtcgcgcatgcatttgtgcgtcccgagcctgggcgcgctcacgtgcgtcggccgtaaacgtcttgatggtctcagggttcttgagctccacccagattgtgcgcgggccgtggttcggcgttctcggcagcatcaccaggcgatcgggcgccgagttgcggccgacccactggaccttgcgcacctcgccgcccatggcctttacgcgcgtgacgaggtagttctcgatgtcacgttcacgcatggaggaccagcagagccagaatggggaagtacaccgtggcgataccgatcagcatccacttggcca

SEQ ID NO: 620450 - DNA, 994 bp, Homo sapiens
gagagtgggtggacgagtgatgctatctagtaaggcacacgggatcccaggccaggtctctttctcctttggcctcctaatagtcaaccgtatcgtgttgctactgccatatctagggaaatgatatggagatcaatacagtttcttcatggctgtgcttagcggctctaggtagactcggtataatcataaaaatgaaatagctagcgttaccacagttggccattagtgcaacgtagcaggcattatgctgggtgcttgacaaaagtatagctcatttaatccccgcacaaattctggaggtaggcaccagtgattattctcagttttactgagaaagtatcgtaaggcaccatgtgagttattcaccgtggtgtaagaggagtttggaccaagtacctggcacattcacacaaactgggttgtgttaaatgaacattagagaaatattttatttgttaacttatttcatgttttagaatcttctccagatagactatgatagcagatatagcagagttaatatggtaccagtatgttgaccttcactcttatttattgaaggaaacacacaagtccaactagaacaggctgatttatcatgtgtgagggaatggcatgcacccaagtggctaaacagcaatccctaaaatgaattttggtctgtgaggtgtcctctgagctcaagctaaggttaccacaatacacaagattttaaaatgacaatgttgtcaggtccaagaccaattcatgatgttttccattttattgaacttaacccttatgattaaggacctggcggggaagatcacaaaggcctgaaaaaggctcaaaagtacacgactagaaacacacgcagtagagcacggatggccaaaacacacaacgaggtggtacgaaaaaattctgggaaaagacaaaacagagacaagataatacagcacgaacagtaaaagtaaatacaagagcataatgactctgttcgcacatacga

SEQ ID NO: 620451 - DNA, 639 bp, Homo sapiens
tgcggtggctcacgcctgtaatcccaaggcaggtagatcacgaggtcaggagatcgagaccatcctggctaacacggtgaaaccccatctctactaaaaatacaaaaaaaattagccgggcgtggtggtgggcacctgtagtcccagctactggggaggctgaggcaggagaatggcatgaacccgggaggcggacctggcagtgagccgacatcgcgccactgcactgtagcctgggcgacagagcgagactccgtctcaaaaaaaaaaaaaaaaaaatattatcttctggctgggcctggtttttctcccactaacctctatatggatattccctaaaagggcaaaataccaccaatattctttatccctggggctttccgacagggtcacagtggcctttgggactaaacgggtcctaaagtggtaattaaatttagggataaccagggatacctggtattagcagggatagtaataagggaatactaggcagagacaaggaaattagggcgtgttaaaacaattaaaattcaatttttttaaaacctccaaggattgtgggcccaatttatttttgaaggtattaccagtggggtccaagtatttaaggcaaaacaaaatttcttaaaatttact

SEQ ID NO: 620452 - DNA, 428 bp, Homo sapiens
acgcagagtgagacagagagacagagacagtgagacagagagacagaaacagagacacagagacagtgttagagttagagagagacagacagagagacagagagacagccagatagagacagaaacagagacacagagactgcgagacagagagatacagagatggagggacagagaaagagagacagacagagagggagacagtgatggagagacagagaaccagagagagagagagacagagagagacagagccagactgacacggagagacagagacagagagatagagacagagatggagagacagagacacagtgatggagagacagagaggtttagggttagggtgaggttagggttaaggtagagagacacggagagacagagacagagagagagatagagacagagattcctgtcgacgc

SEQ ID NO: 620453 - DNA, 393 bp, Homo sapiens
cgctgaagagcctgcatcgaggcgctacaacagtcacacacgctaacaggtgtgcggctgtatcgaccgcccgctcagcggcccatgcccggcatgcccttcatgccgcccatgcgcttcatcatcttcatgaggccaccgccgcgcatcttcttcatcatggtctgcatctgctcgaattggttgagcatgcggttgacctcctggatatgcacgcccgcacccgcggcgatgcggcgcttgcggctggccttgctcttgccgtccatcagcagcgcgggctggcggcgctccttggccgtcatcgcgcagatgatgccttccatgcggcgcatgtcgcgctcggccttgcccatgtcggcctgaccggccttggaggccagttcggtgggc

SEQ ID NO: 620454 - DNA, 174 bp, Homo sapiens
gcgggcctgcagggccattggtcttcctcaccgcgcagtcttggctgggaaatcgcgtcaccgaccgctactttcggatccaggaggtgctgaagcaggccaggcacttccggggaaggcaaaatcgctgctaacaggttgggcggtcagacccgtgattcgagcctttgtgat

SEQ ID NO: 620455 - DNA, 161 bp, Homo sapiens
gccaggccggccaggacagcacccccccccggctgctggtaaagggcaactaggagaacctaaccaggccaggcgggggcccttggacagcttggaaggggtttgccctttccctgggcaggggtaaaaagacaaggaacaataaaagtgctacagctcca

SEQ ID NO: 620456 - DNA, 255 bp, Homo sapiens
tcgtttatcacgcgggataatatacaaccatgagctcgtctagcctgggaacatacatcatccgtatatcaatcatattcatcctacattgctgccgaccaccagaactcattcctcctatctagctataatttcatatacattaaccaacctctccccatgctccccacccctttccatatgatccagcagtccttctactgggtatttatccaaggaaccagaaatcagtatatcaaagagttgcctgcaaca

SEQ ID NO: 620457 - DNA, 84 bp, Homo sapiens
cccagccccaaccagacctctctgtacttctgtgccagcaggccgggacagggaggtctaactaactatggctacaccttcggt

SEQ ID NO: 620458 - DNA, 334 bp, Homo sapiens
  misc_feature (9)..(9): n is a, c, g, or t
  misc_feature (221)..(221): n is a, c, g, or t
  misc_feature (266)..(266): n is a, c, g, or t
  misc_feature (294)..(294): n is a, c, g, or t
  misc_feature (307)..(307): n is a, c, g, or t
gaattcggnactctgttgtccccagatcagtagtttcacagtggggttttatttcttgagatggagtctcactctgtcacccaggctgcagtgtgcagtggcacgatctcagctctctgcaacctctgcctcccgggttcaagtgattctcgtgcctcagcctcctgagtagctgggattacaggtgcgcaccaccatgcctggctactttttgtattttnagtagagacgaggtttcaccatgtttgccaggctggtcttcaacncctgacctcaggcgatctgcccacctcngcctcccaaagtnctgggattacaggcattagcaccgagc

SEQ ID NO: 620459 - DNA, 972 bp, Homo sapiens
cctatgtatgttgtaattgcagggtgctgctgttgctggacatgttttttgggtcgatttatatgtgactgtctttattgtctgttactatttgtgttatgtctgcttctcgtgtatatctttggttttatttctattttcctatgcaattttgatttagggtgctatttagttgttattctccctccctttgtttgcctgatctttttggcccactctatttgagtcatgtttcactgtttatctggtatttgtagtatttgaatatggttctggtagttctcaagttgagtaatcctgttgtctcttaatgactttacagattctgaccttagattctgtgacatactgatacagggttgggctggctatgtctttaccacatcaattaggtttgctttagaatttctaacaatgtctgggctttggtggctcactcctgtaatcccagcactttgggaggccgagatgggcggttcacgaggtcaggagatcgagaccatcctggctatacatgggtgtaaccacgtcttctacttatttatactataatcattatgccaggcgtagtggtgggcgcctgtagtcccagctacttgggaggctgtggcaggagaatggcgtgaacccggtatggcggagcttgcattgagccgagttctcgccactgcacttcagcctgggctgacagagcgagactccgtctcaaaatatataaagttactatacaaggctgggcgtggtggctcacacctgtaatcccagcactttgggaggccaaggaaggtggatcacctgaggtcaggagttcgagaccagcctggccaacatggtgaaaccccatccctactaaaaatacaaaaattagctgggcgtggggcctgtaatcccagctacttctgaggctgaggcaggagaaccgcttgaacctgggaggcggaggtgcatgagccaataaggcaccacggactc

SEQ ID NO: 620460 - DNA, 124 bp, Homo sapiens
aagttcttctcttcaggttcacagaacccgccgcctttttgggtagaagttttctactcagctagagagatctccctaagaggtatgttgctttttccaaaatacaaacagtatactcatgatt

SEQ ID NO: 620461 - DNA, 743 bp, Homo sapiens
gtcaaatgtaatgatagcaaagcgcatcgtgaagacccttggtgataccgtgacaggattagactgtgctagcgagactgaaatacaggtggtgcagagtctgggggtgcctccagagaggattatctatgtcaatatcgttgttaaacgagtatctcaatattaagtatgctgctaataatggagtccagatgatgacttagtgatagtgaagttgagttgatgaatggttgccagagcacatggccaaagcaaagatggtttggcggagttgccactgatgattccaaagcagtctgtcgtctcagatgtgaaatctcgggtgccactgctcagaaccagcaggctccttttggaacgggcgaaagagctaaagtatcgatgttgtgggtgtcagctgccatgtgcggaagcggctgtaccgagtcctgaggaccttcgtgcaggcaatctctgatgcccgctgtgttgtgagacatgggggctgaggttggtttcagcatgtatctgcttgatattggcggtggctttcctggatctgaggatgtgaaacgttaaattggaagagatcagcggcgtaatcaagccagcgttggacaaactactttccgtcgagactctggagtgagaatcatagcgtgagcccgggcagatactatgtcgcatcaggtttcacgcttgcagttaatatcatgtgccaagaaaacttcgtattcaacggaccagacgggctcgatgacgaa

SEQ ID NO: 620462 - DNA, 728 bp, Homo sapiens
  misc_feature (544)..(544): n is a, c, g, or t
  misc_feature (556)..(556): n is a, c, g, or t
tgggtaattttttaattgggatagtgctttttggtttggttttggtcctgcttaaaggccttttttggcttggacttgaaataatgttctttggacagagctatattggctgggttaaattaatgtacacctaaagtatcgctattaggattggtagaaatgtctccgtgagtatcgccaatcctggagggtggacaccaatatagcctttgatgaaaggggcaggggatcctgggaggctctacttccaggtggctggctataatggcctcatctaatcgggactaatttggtgtgtaggaaactggcagtgggggaagaattatgcttcctggctccaggctaaaaggtgtcactggatctgctccttagaaatttcagagttaacttgagcaaaacctcagttaaaacccattttaaggtggcagtggattgggtgcagtgactcttgtgaataagaatttcctcagtgtactgtggtgccctagtttttccagggtactgggccgtgtccatatagaatgcgaggtgattgtgtccccangttagctcgtgnttcaccagacctttggggggtgctcttatagtgttccattgggagaagtctcagggccgaaaagaacgggttgcattgtagccacttctcgtgttttaaaaataaatctatggcttaaaattacctattaatagtttgggggtcatttaaggggcacttgaaggaagctacc

SEQ ID NO: 620463 - DNA, 90 bp, Homo sapiens
tgactccagaggatcccgcgcgttgttgttacaaaaaagataagcaaaagtaataaaagtaaaatcaaatgcaaaatatctcgatgtagt

SEQ ID NO: 620464 - DNA, 123 bp, Homo sapiens
tacactcctctgggccctcgatgtctagctgagtgtccgcggcgagcgttactttgaaaatagagtgtcaagcaggccgagcgcctgatacgagctagaataatgatagggacgcggttctat

SEQ ID NO: 620465 - DNA, 437 bp, Homo sapiens
gatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacccaagcccccacatacataggccccttttaagttataattttttgaaattagaaggtgcctttggtaaaaaccagctggaatttttaaggggtggcctaaatagttaatgaatattgcctttgcttggtaggaagtaaatcaccagatatcttattgtttcatttaggaaagtagtgatatagatgaagagccaacttgatgaatgtgctattcataagctagaaactacagtttttccaaactaataaactgatgaattctaaataaaa

SEQ ID NO: 620466 - DNA, 563 bp, Homo sapiens
tgtccctgggccgggagcccagcaggccgggagcggatgaggccacaccccgtcggcccgggccgatttccctccggtgaatcatcgctcgcagcggcggcgccctgcattggccgcatgaggcgcatcctggtcccttggccggggctcaagcctgaggcgcaggggaggtagttcgcccccgaaccttttcttctgcggagtgtccggggccggccgtggaacccgcgacaacgaatttgggcggtgtcatttccggggggcccaagagcgtttggaagaaaagcgacaccggaaaagagacggggccccaaagggagcacttgagagattcccagatgaaatgaatcgccacattccatgttcacgcttcaaacccgtggggaaccttacaaaaagcagccgtcttgtggagacacgcgaatgttgccctttgggacggtctctggtcaaccagcgccattactcagagggacccccgtgacaaatttccccggggggcccaaatttccacctctttcgaaagcccgatgggagaccatttcaggaggagaacttacgcg

SEQ ID NO: 620467 - DNA, 439 bp, Homo sapiens
tattctgttcccaaacacagaaaagggggagagaggtctccctccccacaccactcgccactctgggttcctgagttcccacgcccaccctccaagattttccttctttttttgtttttgtttttagtatttattgatcattattgggtgtttctcggagagggggatttggcagggtcataggacaatagtggagggaaggtcagcagataaacatgtgaacaagggtctctggttttcctaggcagaggaccctgcaggcttccgcagtgtttgtgtccctgggtacttgagattagggagtggtgatgactcttaacgagcatgctggcttcaagcatctgcttaacaaagcacatcttgcaccggccttaatccatttaaacctgagtggacacagcacatgttttcagagagcacagtgtttggggaacaggtg

SEQ ID NO: 620468 - DNA, 784 bp, Homo sapiens
  misc_feature (70)..(70): n is a, c, g, or t
  misc_feature (121)..(121): n is a, c, g, or t
gaagagagccctggtctccggggcgtacataggaccagccagccctatcccggatacaaacccgggtcgnctccctccttccgaacggggaccccaccgggctatcgaggaacctcgccanctgcaggcctatgggaccttcaagccgaggctcgccacaaccagttgggacctgggccccgtgacagcctgcggggcccttcaggccgggctatcgttgccgacgctacaatcttgcggccccctgccttcaggggcccgccccattgagcggcaaggcaagaatccaacaagggacgccggccttgacgggaggctatttagaggaccccccccgtataaagcccactggtggtgtgcccaccaaagcccatgtaatgcccccttttgtgcacccacgatagcacaaaggggtgcgccaggaattgataccccgaggcgaaactccaccaagtctcaacgcctatgtgacaccatgtgtgtttccagcaaaaaactagagcctgttgcgcaattcccgcggtggtcaacccaaagcttccttccgaatagccggcgtgatgcaacaggcacaacctcctattggacacgttctcgggaggcacccaaactttgtggaggtcggtgtgcacacccaaaagtggtcgtttgggccccccacaaggaaatcggtcggttgcccccaggaaacctttgtgggttaggtaagcacacaggcggttatccacggtccgcgagacagggcccccgaacagtaacaatgcggcactctcccgtgggatgc

SEQ ID NO: 620469 - DNA, 113 bp, Homo sapiens
ccacgcttggtctgatcgaagccggagctccgttttctgtccgggcgctgaagcattgcccaacgccacgacgctgcattgccccggttcggtccggctgctctcgctggatg

SEQ ID NO: 620470 - DNA, 167 bp, Homo sapiens
gaccaaggattatcttctcgaaaggcacactgtattacctatatccccatatacaggcctgtggtgctccatgaggttcagtagctagggatgttccctctttccttcaagtgcctgttgcatatatgaaaggaaggagaaatcccaaagcagattccttgtgatcg

SEQ ID NO: 620471 - DNA, 202 bp, Homo sapiens
tgatggtgtgatctcggttcacagcaagccctgctcttggtaagaggtgaagccagctgagcttctgggtcgggtgggaacatggagaacgtttgtgtctaactaaaggattgtaaatgcaccaatcggcgctctgtgtctagctaaaggattgtaaatgcaccaatcagcactctaaaatggaccaacaagcactccaaca

SEQ ID NO: 620472 - DNA, 295 bp, Homo sapiens
aaaaaataacttgttttattaccatgatttgggaaaagcaacagggtagacagttcaaggaaggacacagacagtgccctgttttaggttccaaattttttttttttaatggggggggggagctgaccaatgatgtcattcgggggaggaaatggattgtagagtaaggttttgacatttgaaaggggcattgacttgtcaatgatgcctaactatgaacgcattatggagaaggatgtgcatcgttttttggggatgaaaactagaaagtgggatatgggttatcctttgggcc

SEQ ID NO: 620473 - DNA, 970 bp, Homo sapiens
  misc_feature (492)..(492): n is a, c, g, or t
  misc_feature (518)..(519): n is a, c, g, or t
  misc_feature (533)..(533): n is a, c, g, or t
  misc_feature (546)..(546): n is a, c, g, or t
  misc_feature (595)..(595): n is a, c, g, or t
  misc_feature (601)..(601): n is a, c, g, or t
  misc_feature (613)..(613): n is a, c, g, or t
  misc_feature (621)..(622): n is a, c, g, or t
  misc_feature (634)..(634): n is a, c, g, or t
  misc_feature (696)..(696): n is a, c, g, or t
  misc_feature (703)..(703): n is a, c, g, or t
  misc_feature (705)..(705): n is a, c, g, or t
  misc_feature (741)..(741): n is a, c, g, or t
  misc_feature (758)..(758): n is a, c, g, or t
  misc_feature (761)..(761): n is a, c, g, or t
  misc_feature (771)..(771): n is a, c, g, or t
  misc_feature (793)..(793): n is a, c, g, or t
  misc_feature (813)..(813): n is a, c, g, or t
  misc_feature (815)..(816): n is a, c, g, or t
  misc_feature (824)..(824): n is a, c, g, or t
  misc_feature (859)..(859): n is a, c, g, or t
  misc_feature (970)..(970): n is a, c, g, or t
ccacgcgtcgcaaatggcggacttcgacacctacgacgatcgggcctacagcagcttcggcggcggcagagggtcccgcggcagtgctggtggccatggttcccgtagccagaaggagttgcccacagagcccccctacacagcatactgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccnatgggcagccgcttcaaaaatagaanncccataaaataganaaaaaatagattnaaaaaaacccacagaagaggaaagagcacagagaccacgactccagctnaaaccncgaacagtcgcnacgccccnnaatcaagtagcnaatcccaactctgctatcttcggggggtgccaggcctagagaggaagtcgttcaaaaagagnaagaatnancctgcggttgggagggaatggggcgtggggggttanaacaagaccacagcctnggngagtcccagngcaaccgtcctgcagccgccantcctgcgcctgccattggcntnnaaaaaaangaaacacagcttgtgagtgcatgtcagctgttaanaagtggtttttagtacattctgggctttgctgtatctatctaatgcctgtttgtgcgtttttttctttcttccgctgcttccccattttcttctgtcctttttctcctgcn

SEQ ID NO: 620474 - DNA, 938 bp, Homo sapiens
aggcagagcttgcagtgagccgagatcgcaccactgcagtgcagcctgggagacagagcgagactccatctcaaaaaaaaaaaaaaaaaaaaaaaaatttacccctttcttttttgttttacccctttaagccccccgcaccggggttgttccgggacattattcatctcttggttttgcaccctttctcctcttccggcgttataacttcccaggaggggttcccccgagaaagggtggagaccgttgcacggggttacagggcagcagtaagacgcgttcgccactgtgtggaagtgtgggtcgcgtgactgaacacatttttccaccacacagggtgtttccactcaattccctgtgcacccaaccttctcacattgtgaggacccccaatgtgattttacccccgcggaaaaatcatatttctatacgtgcgcaccacctataaggtcgtgcggcacacaaaaagaggaattctctttcaaccccagggggaatattctcccaagaaacaccacgcccttataaaattgtgccacgcgcggggaaaaccacgtggcaaaacagctggctagctcctcactaactattattatctttagtggacacaaggccacgatacttcccacaaaggtcttataccccacaataatacacacgcggcatcactaccccaccaactattatattatacaccaacaccacaacacccccacaaagacacacgatcgattacacccccacacctgggtggtgcaacccaccgcgacccaccaacaaaatcacacgctggtggcacagaaccacaagcctctcatacaccaacccccgcccgtggccagcgacgaccaaccaaacgcaccaccacccacccccaccacagaccgcggacgcggaacacccacacaagcaccgcgactccccggacaaaacgccgc

SEQ ID NO: 620475 - DNA, 1088 bp, Homo sapiens
  misc_feature (209)..(209): n is a, c, g, or t
ccacgcgtccgggaggctgcagtgagctatgactgctgccactatcactccagctggggcaacagaaagagactctatctccaaaaaaaaaatagtagctccctttacgaaactcctttctcctggttcttttggatttctgctgtgtttgccttgtggtgtctgcattaagtgctagtgatctgcgtattaggcgaaagttcaccagngacagtcgtgcgtgggaaattgctaggaataaaggtgccagctttcctttcttcagagtaagatagtgagcgcagcgataaggcttccacagtggcttaaagcaggcgctggtcttctggaactgggctgggctggtgcagctcctggtcctggcctggaaaccacaagggtgtgggagttgggaacgacagcgagctggtctctggtttaaaaacatttccagagttgaagtccagatgtggcctcacattaacccacaggtggggctgcaaattcattgacagtgtggttacaaaaataaacaatcaaagtgctgggattacaggcgtgagccgccgtgcccggcccccttttcttttcaggagcagaactacaaagatgagaaattaccagaagcctcgccttttcctaagcaccagcggaaggagctgtgccccgggatgcgagtgagggtggagggcgcgtcagccacgggtgggccttgttgtcgcctgtatcggcccaggttaggttgttgggctcttactttgggctgacctgacccccgaagagaaccagacaactctggtcctccaagactgggattggccggtttcggcccaagcgtttaaggctctattaactccagggccccaagacagagaatccgccagacccgggacccatggatttgggcaacaccccgggcccccaaccccccaaagacacggctagcaccggtgttccctgccgacaggagagctgaagcaagccggacacacgccgacacgcatgggcagcgcgaacgtgcggacggaccaccgagagagaaccccctagaaatacagggcgggaggacaataacaacaagaacgagcgcgggcaagatacgcgggcag

SEQ ID NO: 620476 - DNA, 660 bp, Homo sapiens
  misc_feature (492)..(492): n is a, c, g, or t
  misc_feature (516)..(516): n is a, c, g, or t
  misc_feature (527)..(527): n is a, c, g, or t
ccacgcgtcgcaaatggcggacttcgacacctacgacgatcgggcctacagcagcttcggcggcggcagagggtcccgcggcagtgctggtggccatggttcccgtagccagaaggagttgcccacagagcccccctacacagcatactgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccnatgggcagccgcttcagagatggncctcccctccngtggatccaacatggatttcagagaaccacagaagaggaaagagccatgggaccgacgatcccgctgaagctcaacagtcgaagcccctcatcagtaggcatcccaacctgcaaaacgaggggcaggctaaaa

SEQ ID NO: 620477 - DNA, 210 bp, Homo sapiens
ggacgtgactcagaatacctctgtgcagtattatatagtgacagacttaatccttatccaccataagccccacaggctctccgaaatatccacttgcagattctacaaaaagtagtgtttcacaactgctcaatccaaaagacaaggttcaactactgtgcagaggcatgctacagatcaccaaaccaggtttcgtccagcaatgcatta

SEQ ID NO: 620478 - DNA, 720 bp, Homo sapiens
  misc_feature (552)..(552): n is a, c, g, or t
  misc_feature (576)..(576): n is a, c, g, or t
  misc_feature (587)..(587): n is a, c, g, or t
ccacgcgtcgcaaatggcggacttcgacacctacgacgatcgggcctacagcagcttcggcggcggcagagggtcccgcggcagtgctggtggccatggttcccgtagccagaaggagttgcccacagagcccccctacacagcatactgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcagttctggcttcagggatgacttcttagggggcaggggaggtagtcgcccaggcgaccggcgaacaggcccccccnatgggcagccgcttcagagatggncctcccctccngtggatccaacatggatttcagagaaccacagaagaggaaagagccatgggaccgacgatcccgctgaagctcaacagtcgaagcccctcatcagtaggcatcccaacctgcaaaacgaggggcaggctaaaa

SEQ ID NO: 620479 - DNA, 626 bp, Homo sapiens
  misc_feature (22)..(22): n is a, c, g, or t
  misc_feature (92)..(93): n is a, c, g, or t
  misc_feature (137)..(137): n is a, c, g, or t
  misc_feature (162)..(162): n is a, c, g, or t
  misc_feature (217)..(218): n is a, c, g, or t
  misc_feature (224)..(224): n is a, c, g, or t
  misc_feature (239)..(239): n is a, c, g, or t
  misc_feature (295)..(295): n is a, c, g, or t
  misc_feature (352)..(352): n is a, c, g, or t
gagcacgtaaaagtctaccccnccattctagatcgctgtggggaatggaacggcggacttcaaagctgacagtgatcaagagcttgcgagcnntacagccggattggacgactgaggccctccgcttgcgaagctgncgagggctcgtcccctctcagctanaagcgccagcttacgatacagccaaactgcggcttctcatcggctgtggagcagnnaggccnccaggggtaaatccngaagcctcgtctctgaaagcctggcgcttgtgtctcagaagatggagttcctctcntgtggcccaggctgaagtgcaatagcaccatctcggctcactgcaacctctgcctcncaggttcaagtgattctcctgccttagcctcctgagtagctaggattacaggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacagcctccataactttgtcatccaattcccataataa

SEQ ID NO: 620480 - DNA, 351 bp, Homo sapiens
gagacagagtctcgctccgtcacccaggctggagtgcagtggcaccatctcggctcactgcaagctccacctcctgggttcacgccattctcctgcctcagcctccccagtggctgggactacaggtgcccgccaccacgcccggctaattttttgtatttttagtagagacggggtttcgccgtgttagccaggatggtctcgatctcctgaccctgtgatccgcccgcctcagcctcccaaagtgctgggattacaagcattaaccactgcactaaaccttaacatttaatattttacactcataatgctgcaggtggagttcaaaccaattcgtctatcactttttaa

SEQ ID NO: 620481 - DNA, 172 bp, Homo sapiens
atccccacgctgcaccggtgttaaaaaattggcctgggcacatggtgatgcccgtactctacaaaaattcaaaaaattagtgtggtgtgactgtacattgccttttgtcccagctactcaggaggctgagccaggaggatcatttgaaccggcgttgggcatttcattacct

SEQ ID NO: 620482 - DNA, 764 bp, Homo sapiens
tataatcagaatcttatgacaatttagttttacaaggtcagaagagatgagttgctaaacccagctgtgatacctcagttgaaagggaattcaaaggtatgcttgtagaacagaaaatgtatagtgttccatgaacttaatcattttctgttttaccatctatgtgagtcagtacaaaagtggtctaatttttacaagagtagaacttcctccttttctactgtaatcttcccagtgatttagtgacaggtatgaaatactagtgtatgggatcttcagtaacctttttatttcctagatgattgaaatataggtattaactccattttaaacaggtgataacgatgatgtacatactcagggagggtattaaacttgtaacttctgctcgtaaggggttggtacaagtgcatgactgaataatcttcaattcatgattctagagtaagttaattgggaaaagggggttccaacatggtggtggttgaacatggattctttataatacttaagaagatgaaaatgtttgtggactgtacattgaatcttactggatatggatggggatggtatctgtactgtaaagttagcttttggaaagtaggaacgacaaggttcaattacagatttgtaataggaaacagtattagatgaaccagggtgcgggattgggatcggattgatttgtgggaccttttgaaggaggatgaagggttgggagacagtatagggatgaggggaaaagactgggaggagtggaaagg

SEQ ID NO: 620483 - DNA, 153 bp, Homo sapiens
ttgctgccgagacggcattgttaccaaatcgctagtcgcagagctagatgtagtagacaggctggaatcgctagtttctgccttcatggactatgagaccgttgatagctacatcctactctctaatgaaatctcatcctgtaaaatgtcctt

SEQ ID NO: 620484 - DNA, 339 bp, Homo sapiens
  misc_feature (323)..(323): n is a, c, g, or t
  misc_feature (327)..(327): n is a, c, g, or t
  misc_feature (329)..(330): n is a, c, g, or t
ccatccattaaataagccgccttatattccatggtaatattcctttgttcccgaaatcctacctttgatattaatacagtaaaatcttgatttccttcctaattggtgtttgccatggtatatcgtctttcatccttctacttttagtctgtgtattgaaatatatttaaaagtttgttgcagacagcatgcggctgggtcgtgcttttagatgcaatctgataattttcacctattggtagtggtgattagattgtttgtatttaatgggattattgatatggttggatttaaatcgaccacacttgtccaatatgttcatnactngnnttaactctc

SEQ ID NO: 620485 - DNA, 180 bp, Homo sapiens
agaaatgtatcaacatttatctagtgcatatggtgttccaagcactggggggttacctaaattgttggcagtacccttctccagtttctcaaaatgaggaaaacgtagaaggcttcatgatggaataggtagctcggttgaccacctccaaccttaaaaccatctactgcgaaggaccat

SEQ ID NO: 620486 - DNA, 283 bp, Homo sapiens
  misc_feature (64)..(64): n is a, c, g, or t
  misc_feature (86)..(86): n is a, c, g, or t
  misc_feature (110)..(110): n is a, c, g, or t
  misc_feature (135)..(135): n is a, c, g, or t
tggacaacaggacccggacccgtcttctgccacgtgcagctatttaattcatgtgaatccccanattatccctaagtaaatatttngtttcacagaaagcttgtcctttngtttttctgtgtacacgtgcgcacnggcgcttgtgcgtgtatgtgtgtgtgcgtgcaatgtgtcattggctaccaggggaatgtgtcagttctggatttctgtggtagtcttcgcatttttttctattaatctattacttaaaatttatttattcctttaagaaacgttcacc

SEQ ID NO: 620487 - DNA, 585 bp, Homo sapiens
  misc_feature (301)..(301): n is a, c, g, or t
  misc_feature (312)..(312): n is a, c, g, or t
  misc_feature (334)..(334): n is a, c, g, or t
  misc_feature (373)..(373): n is a, c, g, or t
aaaaaacaaactcttatttaatcctttgagttaaaattcaaaccactagtcacttccagaatatcagatacaagtaccaccatccttcgcaagaatttccgagtttttccagggccaattccaaatgacctcattttttgttcttttgtattcccagcaccagtgtttcctgctcattggatcctcctggattggtagtgttaataaatattctttcagtgtgagccagattcataaaattaattttcttcattttagtagtaaaaagtagtctaatagctttttgtcagcttgatttttntgtgtgtgtanattcaagggcagaatgacaggncagataagcaataagaaatgtatagaattagaaaatatngtagttcccttttacccatgggacatacgttctaagacccccagtgaacgtctgaaaccatggatagtatagacacctctatacactgttgtttcctatacatatatacctatgataaagttctatttataaatcagggtcagcaagagataaccaataactgcaaatagaacaattataacagtgcactgtaataaaagtgatgtcaatgt

SEQ ID NO: 620488 - DNA, 253 bp, Homo sapiens
gagtaaaaattcatccatcattgggtgaggcacaataactgcctgctggattgcctattagaggatgaacgtattagccaggaagacatgaaccaagtgagagctgacaatgacactgtcatggataaggcccgagtcttgattgaccttgtaactcggaaaaggacccaagtcttgctgcacatttatcaagcatctctgtgaagaagaccctcaacttgcctcaaatatgggtttgcactaagagagaaga

SEQ ID NO: 620489 - DNA, 251 bp, Homo sapiens
cccccccccccgccccccccaaataagggttttttttttgtttggggttaggccccccgggggccccccccccccccccaaggggggggcggttcccgggtttttggaaaaaaccccccggccctttttgggtgggtttgggcccccccgggggttaatccaaacaggggggggtccggggccgggggggtccctccccccccccccgggggtttcttcccttaaaaatggaaaaaatttttattttggga

SEQ ID NO: 620490 - DNA, 558 bp, Homo sapiens
  misc_feature (558)..(558): n is a, c, g, or t
gccagcttgggattggccggctcacctgcgggtcgtgtgctcgctctgcagagcctcagtgctcgcggcctggcctggtgcgccggctggccctgacagcccccacctcgcaagagcagccgccggcgccactatgccgacaaaaggatcaaggtggcgaagcccgtggtggacgatggactggtgacttgacgattgacccgtattatcttggcagtctcatcacacggagaacgctcattccgtgccccactgtggaccactcccagctacaagtactttctgaccccttcgggcgcttccagaaatcccggtgaacccatgatctgaattgcaccaaggttcaacccacttgaccgtccttgccaaccttggagccactccccaaggaatagtttaccacggtcggttgtgcctttggtccacactggttggttgcaccacccatttcctaccccccctttggaattgaacgggacccccggcttcgcttgcggaacacgaaaggtttccacaaggtctttgatcatcgacaccggcactttggtcggcaccacn

SEQ ID NO: 620491 - DNA, 337 bp, Homo sapiens
agcctctctctcttcgtgattcttggtggttttttgaaacatgcccttcacaggccgggagtggtggctcacacctgtaatcccaacactttggaaggccaaggcaggcggatcatagggtcaggagttcgagaccagcctggccaacgtagtgaaaccctgtctctaataaaaaatagcaaaaattaaccaggcatggtggcgggcacctgtaatcccagctacttgggaggctgaggcaggagaatcacatgaacctgggaggcggaggttggagtgagccgagatcgcaccattgctctccagaccggacaacaccgcgaggctccgtctgaaa

SEQ ID NO: 620492 - DNA, 202 bp, Homo sapiens
aggtagttatgatagtaaattacagatagaaaccacggaaaagctgggccatatcttttgtatgacccaggcaacatgtcacaaagttcagacacacagtctcccatctgaagccagtatttacacaagcacctgcagtgtcatgaatttgacagaaatgcaaacccactttatcttcctgattgcacatcataagccacaa

SEQ ID NO: 620493 - DNA, 147 bp, Homo sapiens
ggattcggcagagtttaccacagtcagagcaacagacacaaaagcaggcaaatggagtcgttgggatgagctgcagtaagggagtggagagagttcaagtaaggcagttatcttgagagaagaacccatagagttcccaagtgagaa

SEQ ID NO: 620494 - DNA, 256 bp, Homo sapiens
cgcaaccgttcaatgtacgcttcttccgacaggtaatagcccggttttttcatcaggtagctatgggtggcaggcgtttcccccatccaccacgcgggacgcgtgtatttaagaatacagcccacctgcgcccaggtcagattcatgcgcatcagggagtgcaccagacggatcccctgcgcgttaccttcgaaatgacacagatcctgacgcaccttgcggcgcagatcgttcaggctatcttcgccctcacgca

SEQ ID NO: 620495 - DNA, 136 bp, Homo sapiens
agatgtatcacaaccttctacatattaatggaacatctgttatgatgactttcatacacctatcacctcaaaggctttcttgcacctcgcagagcccagctacgggcccgcagtctccgccgacgccacacacctg

SEQ ID NO: 620496 - DNA, 1037 bp, Homo sapiens
gcaaaggcatccaagagaccgaggagatggtgaagtgtgggggccacccatcacaggggttggcgaagctgtgtcctggacaacaagctctgtccgctgcagccgcgccaaatcaagggcatgcagatactatctaagcaggcaggacttcgacagcctgctgcagtaggcaggagtcgagcgtcaggctctggtaaggtgctggcgctggtgtttggcatttgccacatgtgccaccctcttcttcattctccggaagcagtatctgcagcaggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtcgtgggcacgtttgttcctgaacctgagtgctacacgctgccttgccatgagcccaagacatgtgccctatctgcagagcatggcgatcacccgggtgatacccctgtagcaacagctaatagtcgggaagccagcacaggattgaccgtggaatgcacacccatgtgcccctttatcagggcatttgtatctcgaggcctttggacggagcagtggtggggggtagctgtcaccatcaggtatgaccgagggagtgcattgggtacaaaggctgcggaacccaggccatccccagtaggctgagacgggagaacgttcacccggccttagaaccggccagccgtggccccaaggggccagcggtgcgattcaagaggccggaacacacgagagagtagaccaatgcacggaggaagatcttgcccaccacagggcgaaacgcagaactccaggagacgggacgtggggaactgcaggacggccggcgcgggacacccaaagacacgcgaaagaccgggggcaccgagcgagcccacccgggtgcgccgtgccaccaacagcgtcacacagcgggggaccaccgtcctcccccgtttggaacccggagagg

SEQ ID NO: 620497 - DNA, 156 bp, Homo sapiens
  misc_feature (14)..(14): n is a, c, g, or t
  misc_feature (18)..(18): n is a, c, g, or t
  misc_feature (125)..(125): n is a, c, g, or t
aggagggcccaccntgcntgcacctccgcgggctgactgggccacagcccccgatgacttaacacagccttccttctgctcccaccccagaaatccactgtgaacatgattggcttaaaagtggnaggaaataaggtaaaatcattccagactccc

SEQ ID NO: 620498 - DNA, 1311 bp, Homo sapiens
gcgcgctgggttgccgctggcgatgccgccatcggtgcacaggctccctcgggtctcgcgtgaggccgggtgacgcatccagaatgggaggagaatgctcaatatgggagcagattggatccagcttcattcaacctattatctaccaggttatttgatcatgatagagacccaaactacggtcgcaagttgcacattgacgcgtcactgcgcttacgctgggaaggacgaacagtttccagggggaaacgctgggcattgtaggcatgaagttgtctaggccttccgtctcgcagcaataatatcaggcatcgagtcatacatccgtcgcaggaaccatcgaggcccacatcctagaatagctgtcgatcagtcagacatgcgttgttgtggccacgcttcaaggcgaggatgacagaccccaatcatgggcgttccatccagaatgtgtcctattagcaggaacgatcgacacgatgcttgtggatttgcaacgcaacatgacgagtgtattcaggctacgtgccatggacaagctttggctgaaccattcctctgtcagctaggtcactcacgcgtgatattcctcctccctcctcttagccaattactatgtgcccactccgtccagtatgctccgaaatatcatgcagcaaatgaggcagggtcgacggctggggcagttgggcgcagttgcccatgttgcaactgagcgtgttgtgcatgatgttgggatgcttagacatagttgcactctgacgggcaaaagctagtgttccaccagaagccatgcttggcacgacttcacgtcatgggccacaggttggctccatttgtagaagctgtgtgatgtttagatataaatactaccgtgcaaaagagtgcgctatagataaactcaagaagaatgtgtaggacaatacagactgcacacacgccagaaagtgcattgtcccaattctcataaagcaccaaggaacgataaacgcacatgttgtgtgcacgaaacacaaagaacagaaaaacagggataatatgggcgagcagaaccaaaaaagaccaggaacaaaggatgtacccacatctatcacgggggaagcaaggaccacacgcggacgcaagcaacgccgccacgctcacgaggcacaagcgacaaccgccgacagaaaaccgaggcacagagaaaaaagagaaaaaacacaacccagcacaacaaggaccagcagacacacgcacacaaagagacgcacacgacgggacgaaacaacaaccaccaaacgacgcagaacagagacaagaagcaagaagaaa

SEQ ID NO: 620499 - DNA, 524 bp, Homo sapiens
  misc_feature (18)..(18): n is a, c, g, or t
  misc_feature (48)..(48): n is a, c, g, or t
  misc_feature (84)..(84): n is a, c, g, or t
ttttccaccatctttaantaagtgcctggccattttaaatgcaaactncccccaaacctaaatatcagtatggtgtgatataangaaattgcccatatgcattcctgctttatgcccagtccatcagcaaaattgaagatgtttgtcatttataacacgcttagaatcccacagactatgtggttatagaaggaaataaaagtgggttgtgctgttaatttggatgactgattattgttgtcttaaaattttaagccagttgttttgaactgttgagtattccatgttgcattagcctcatctagagccttgtggaaactcatgttctcagcataatctctgagggatagaatctcaaatccctggctgagcctaatatcctgggtttaaacacacacagttgcctgtaattaaatggacagtgttgggagcaaatgccccaggcaaagtttagttctagaaggattatacatagcacatagtaactgaatactgaactttaaatatttttcaaaagttctcca

SEQ ID NO: 620500 - DNA, 88 bp, Homo sapiens
  misc_feature (24)..(24): n is a, c, g, or t
gctgcaggaattcggtacgagganacacaaaagaaaaaaatattctataattgtacatatatgaagcacctagagtcgtcaaattcat

SEQ ID NO: 620501 - DNA, 748 bp, Homo sapiens
tggaaacggagtctcactctgttgcccaggctggagtgcaggggtgtgatcatagctcactgagcctcaaactctggggcactagacaatcctcctgcctgtggcctatcaaaggctggtattacaggtgtgagccagcacaccgggcattggactatggccttaagttgggccgattagactatgaaataaaattcctagcactgaatattagccctcatttcagacctaaatatcagtggtggtttttcctgaaccatcttccagggatcatttggtaactgaggtcccagagttcccctttgatgtagaggctgtagattccttttctgggggcaggttctgatagcaacaagattgccagcctgtctgaactgggggctaaggtatagatgtcaagatgaaactgtccagtgagattccgggagccccgtgggaggtctagggtgggggtacgggtgatagccctttcacctgagggtaggtggcacgagctggtaaccttccgggagctcaccaaagaccatctacagccctgaggttgaagacctgtgtcatcttctcctcctttacatcattcctaccagaagccctgtggggtgtagggaccatcctgcgtgatggagctaaaatttaaaaggtcgagccccattggtcctgtatcttatgcaagcagtcttaaaagtgcccatagggttggccagccaatgaaataaccttcccttctaaaagaatgtgggaaactggc

SEQ ID NO: 620502 - DNA, 124 bp, Homo sapiens
aatcgaaatgctcttacccccctccatctccctcatccccgcccctccaccagctgactcctgctcactcttccagtctccactgcaaacatctcctcctggaaccctctgaaacctcttctgg

SEQ ID NO: 620503 - DNA, 1540 bp, Homo sapiens
tggatggaatgctgtctggagctggttggctgtgtgccctggactcctgacccccgtgggcgcttcgagccccccagctggtacacctgatggcacctgcctgcttcacccatggccatgtatgcctgccccctctgctgcacccctgtgcccctgcctcacactgctgctgccctgatgctgatgcccctgtgtgctccgcctctgtggccctagctgtggctgcatgggtgtcatgttggttctcatctgaggtactcggcgacaagtgtgacgcaccccatttatttgaatgtgccactgtgctcccattgatttgctgtgacaagacccttagaggcctggcggtagccagtgatgattcggttgcgtgcctgcgcacctacctgacacattggtgcccgtgctgggaaggaacccggggtataaacaaggggttggccatatacacgtagggcattaaatagggaccatatagaacctctttgagacgacaaggcgttatcagacaagtaattaaagatgtggcacaaaggcggaattggccccctaatactattactttacaacgaagtaatatagctttgtcgcaccataccacctttaatggcgcaaaaccgcgaagtatccactaattcaaactgatgtagaaaccggggaacagctattggtccgagggcacatactgagcaacgccattccacccgagtgggcatgccattcaccgttaatcagcaccaacgttattctagcgccgcaaaaactaattgaaacggactcaggatcaccccaatcgaacaccgggtgaaccccgggtacccaccgcggacagccacaacggccattaacccatcccacttaacttgctcgcttgccgcaccacttggcgcatgtggcaccccgtagaggagggcgagcgaaccgaaacgatccatcgccataagtgtcttccacgcgccacagcaaacgtgattttcccacggcacacccgcataccaccagcctgaattagggcccccccaatgcgggtgctggaatataccgcagcgaagactccccagaaattggcgaaagtggcgttcaaggggcgcaggagccgagttagttaaacggaacgccatatccttttccaacaccgagcaaccaatccgtaacgcccctatacaccagtcgcagtttcccccgcattattttcgacatcactattctcagtggccgagtgacctatatggcgatgacttaataccagttgcgacaaggcaacacttaaaatccgaggccacacgaacgttgaacaaacgggtatggtactaccaactcgccccaaaacagattatccaaacaaaaataggagacagtatcttaagccataacagagttgtggaaattatttacaagttgaacagcgcttcgcggctacaccctataccaaacggggcagttaataacgggggagccgtgcgctcgtcacataatagcccaccaattttacactcagaacggaagagatacgccacatatagcgatttgtgacacaaag

SEQ ID NO: 620504 - DNA, 1005 bp, Homo sapiens
  misc_feature (862)..(862): n is a, c, g, or t
agcggagggggtgacggggccccggctcagcacctcggagagctccctccccggccttgttttgctctggcatcgccgccgggggagggagcgagggggccgtggcaccgtggcgcaaaggcgaggtggatggccctggaagggttgaggggcccccgtcggacagaggggccaagccgtgatccacgcgacggggttttggggctcccgcggaggggttgggggggccaccgggccggggggcgcagtgggcgcgcatctggatgtgagcgcagctttgtgcagagccacccctgggtctggggccggtgctcccaagaaagcgtgctctcgcggacgtgggtgtggggcgtatgaaactgtatctaccgtgtgcgcggttctctgtgaaaacgctgctggggaagtacacagcggagcccatcgatgactcactcggaggggtttgtcgatttttgcgcgcccttttagagcagatacctcagcaccgcgtttaaggtgccccgtgagctgggttcacgctcacgacgggcacgcggggcgtttgggactatatccggcgtgggctgtgagcgaaaagtgtccaacaactgtgtgtagcacgcatctcagaacactggagaacatcagcacaggccggggcaagggccggggcatgggatacccgggttgggtgaatggagaaagcgcatgtcagaatacattcacccccggggtctgcgtgacacccgggagcaccagacgggttctatgactctgggaggccatcatgctgcgggatgaagccaccattcctcaccggaatgctgattcgggacttgaggcgcgcatcggaacttcaggatttctggtcgtaagaagngggaagatgcctgggacgggaaagaacccccgcggggcaatcggattaaaccgccctactaaaagttacgccgaggttcaatacctgacgaccgaagaagaagcggaaagccaagagacgagcgaaggaaatcgccgagaccg

SEQ ID NO: 620505 - DNA, 839 bp, Homo sapiens
gccgccgccgccgcggtttgtctgccagaaggaagatggcggatctggaggagcagttgtctgatgaacgagaaggtgcgtatagcagcaaaattcatcattcatgcccctcctggagaatttactgaggtttttaatgatgttcggttactgcttactaatgacaatcttctcagggaaggagcatgcccatgcatttgcagcagctataacttggaccagtttactccagtaaaacttggacaggttatgaaggaatcaggtcattgataacagaacatggcgacttgggaacatggaaacgttttcggatccaaagaacagaatctgtctcaaattcgatcactctaaggaaggacggcaactgatccaagaccctgtgaagtcgaccctgcagttgaactcatggagaacttcagtagaaactgctctgagagcttacgtaaaagaacattacccgaatggagtctgcactgtgtatggcaaaacaaatagatggacagcaaaccattattgcatgcatagaaagccatcagtcccaagcaaaaacatttctggaatggtcgttggaggtccgactgggacgttacgagtcactccttcaaccactcaagtggtcggcatcttgaacattcaggtccagtatccatgaacatggtccactgtcagctagtgagtcataccgatatacgaagattcccctaacagtggtctaactggccgtgcaaacagccaaagaacttctacagatcggagaagctgagcaactgcataccgactgcatcctgcgcttcccgacatggtgaccactcacgctacgcacagtgccgacgcccaaa

SEQ ID NO: 620506 - DNA, 363 bp, Homo sapiens
  misc_feature (115)..(115): n is a, c, g, or t
caaatcttatcttgaattgtagttcccgtaatccccatgtgttcggggagggatctggtgggaggtaattgaatcatggggatggttacccccatgcagtactctcatgatagtnagtgagttctcatgagatggttttataaggggatttcccccttttgcttggcatttctctctcctgccgccacgtgagaaggatgtgtttgcttcctctttcaccatgattgtaagtttcctgaggccttctcagccatgcagaactgagtcaattaaacctcttttcttcctaaattacccactctccaggtatttcttcgtagcagcatgacaaatttcacatgctaatagtgaactatctgaaaa

SEQ ID NO: 620507 - DNA, 974 bp, Homo sapiens
acattaactgtctgatggcttgacccgtttagggtctgtgctatcctggcgtctgtgaccgcacacaggtgtgatgacccttgtcgacgtgctctgtgccctggggcattatgctctgtgctactgttgtacgcggtcccctccggtatttgtgtgccttgtgggcggtgctttcggctgtttaggctggtgtccaaataccgccggttttaccgccgttgttccccccggtaaatcggtgttgtcccccggctgaggtgcaggtctaccccctgtttgtttttggttccaaaattaggacagagcctgtttccggggcactactcaaggggggatgtcagcagatgtcttccctgcttggcctgttttcacagaagcacgtggtttcattccgctgtcagtgagggtccccggaaagcgggtgctgttttcccatgggtttcgcggggcgaatccggcattgttgtcattaagtcctgcggtaaatcaatggaacggtgcagtggaaaacctgttcccttataattggcggcttgtttcatgagggcacccccgcggttcctgttataagggtatcagggggaatagtcgtcgccagtcgccatctcgtaaatatggagaagaagggcgctaccaatgcccctggcgtgtttggaaaatagggcaggtcgtttctccgacctggcatcagctgtctgtgaccccacgagaagaactctgttgccgcccccatcagaaggcgacagaacgcctctatagcgcccccataaatattcgtctgcaggttgacaacaagacggaaggcaagatttcgttgggcaatattcctatttcttcaggggaacgagacaattgcttagtcttccgcaacctgttaatgagaatttggggcgggtgccactgcctcatcgtgttggtccccccggtccccccccctcacaaaccaacaaacccccttttcccccaaaataaca

SEQ ID NO: 620508 - DNA, 1005 bp, Homo sapiens
gggggggtttgggtgaaaatttttggttatgatgtctgtgtggaaagcggctgtgcagacattcaattattataaaaaaaaaaaaaagaaaaaaaaaaaaaaaattttggggcggctcggggccccctgagaaaaaggttttctaatagcccaatcgcgttgtgggcggcgcggcggccccaagtaggttagcgtaggaaatggcgctatacggtggtccccaataggagcacacccgggcgccagacaactagggcgctgtgggtttctcaccaatatgaaaaagcgcggcggggcggggaccacggcgtcgtctgtggaagacaaactccccagaattgggaggtcgggagagggccaatttggggggactttataccaggagggccgaagcgggaggcccatctattacaagttgtcgcccccgcgccggggggggaatggattaatattaagtgctagcagaacattccgcaatgtgaatgacacaaccattgcgaagaaggaaggtaaacagatgaacgcaaggtagatgaaaactgatcaggggaaagccagatatagatggagtgactggtacaaaagtcaaacttatgacgaaggtctgtacaacaatgaatgacagcaaagtgcacgaactagtacaggaaatggggtaacaagtactatgtacaacaaatgtgtaatcgccgtaactgcgtgggaaataatcactgagaaaacgtagctctataatgttaaaaaaatatgcggtatggaatgaaggaaacaatagccaaagatatataccattacttactggcatggtctaaactattgagaaaatgatcaggaaatgtggaggtggaagtaggataatataagtgtatgtagttaaacagcaggaggctaagagaataggaaacataagtagttagaaaggaagtggtaagtgatacatgaagtagcaaaattaaggataatatagaaaatagtgataaaatagtaaaaaaatagaaaatgaaa

SEQ ID NO: 620509 - DNA, 1014 bp, Homo sapiens
  misc_feature (111)..(111): n is a, c, g, or t
  misc_feature (147)..(147): n is a, c, g, or t
  misc_feature (529)..(529): n is a, c, g, or t
tggtgaaaccccatctctactaaaaatacaaaaattagccaggcgtggtggcaggtgcctgtagtcccagctacctgtgaggtggagattgcattgagccaagatctcaancactgcacatccagcctgggcaaacagcgtgagacntccaacctcaaaaaaaaaacaaaaaaagaatctctgacctttttattacccatgtggaaaaggccaccacttcgtgccacctttaaatataaaccattcagggaactcaggagattctccaaggagggaacaatctcgtgcattcaaggttcttctcacccaaggtgtgttttttaaaggcagaaattaattgaaattaggggaagcaagaaaattatgcctgtgtggcccatgagaaaaaaggaggtcttaattctggtccctccaaataaaggcgttttgtttccttctcaataagttttcaccaccaaaaaacttcaacagctcacaagaggggggttttctcgggtccttacattaagttctccccaatgaaaatggngcatatatcaatcctcaaacaaatttcaacctccaaagttcgccacgggcaaaccttttatgaaccccttaggttcctcacaccccttagaggtatcatcatgtgccaccccatttttacagggctacctaagtggtcctaaaagactatatccctctaaactctttccatgttaggcaaaagccccattaaaatttccgggtctggggaaaagtggcttaacatactcctcttaaatttacctcagcaaaaattccaaacatctaacactttgtgaaccctggggtttcctcgtgcccccaaaggttttctgtccccaggggagcccaataattcaccttaacggctttggcccatcccactttgtaacggaaaaaactctcttattaatttaacttcccggctgttaaaatgagaggtccgttccctattttatatcccaaaatttcttaacagtccaaaatatcaaacgtgggactacaacg

SEQ ID NO: 620510 - DNA, 174 bp, Homo sapiens
cagtgatgcaatcacaagtccactataactcaaactcctgagtctgagcgatccttccacctcagcctcccgagtcgctaggactacaggcgcatcgtcaccacaccagctaattccttttttttttttttggtgcaaaaaggaggcccattaagttcacccaaaagggtttta

SEQ ID NO: 620511 - DNA, 563 bp, Homo sapiens
agtgcccagaagctaaagccggttttggaaaagtggttgatggaggcagagctccgcaaccaggaaggccagcagaacctgatggagttcgtgggcggcgagccctccaagaaacgcaagcggcgcacttccttcacaccgcaggccatagaggctctcaatgcctactttgagaaaaaccccctgcccaccggccaggagatcacggagatcgccaaggagctcaactacgaccgggaggtggtgagggtctggttctgtaatcgacgccagacactgaagaacaccagcaagctgaacgtctttcagatcccgtagggctcagtgtcagcgtgtgccggcgcactgtactcttccctcagcaaccagccgaagtcactgcggtgactgtactgtgtgcagctgcgtttgccctaggtcgtgagcctccacctgtgcatgcgtgtcaatgcctgcctcttctgcccacatatgtcacaccctggggaggcctgaggggctgcatgagagccttaggctctggctgggcatgtggaaggagggggtttgtggagtcatagaaa

SEQ ID NO: 620512 - DNA, 213 bp, Homo sapiens
gacatagaggccagttccctccatgagcaatgacagtctttattcggagctttaaggtagttaatgtaggccgggcatggtggcacatgcctgtaatcccagctactcatggggctgaggcggaagaatcgcttgggcctgggaggagaggtttcagtgggccaagattgcactactgcactccagcctggtgacagagtgagactccatctc

SEQ ID NO: 620513 - DNA, 953 bp, Homo sapiens
gacaaaatccgaggccatcgaactggaggacctgcttcgctactccaagctgtacaggctggggaacacagccagacatcctgatggggaggcagagccaggtaagctaagccaggggcccagctgcgtccaacccagccccccacctcgggtcccggaccccagctcgatgccccatcacgcgcctctccctggctcccaaggtgtgcaggtggtgcgcgaaggcccgggccccatcacgatgttcccttggcctcagagctgccctgcatctctccaccacagctaccgagaggcaccccatgtaaggctttttgctcgttcactcccaaagccaagtttccaaggctccagtcctaggagaacaagtccctgggtcagcagtcaggaggcgggtccgataagaatgtgggacagtgggctctgtcgagggctgcggacgctgtgcagacacagcatgtgtctgttcctcctcctcatgcggtttccagcctttcagccctccccggatctgcggtcccctcgggcccctgcaagtgtcatggcctgtccctcccggatccctgctccatgggcccttcgaccagtcctcccttgtgttctctctgtccccgtcttcctctctctctgctctcgctctctctctctctttgctgtgtgtgtgtagtgagatgtgtcaaatgagtaggtgtgcggcagggggcctgcagacatcctgtacagcctgagagtatgcgcggaactcctacagaatcggcaacggtgggagggtttggcctgcaaacagctctgggcgtcggcgataaggcctttgtctgtgtcacgctgcgccaaccagggcacaagccagagaagggtgcccaactggtagggcggcttcccacttttcttcggatttggggggcccatccaaacaaccaacaagagggtacacaccggagggggcccattgg

SEQ ID NO: 620514 - DNA, 599 bp, Homo sapiens
tggagacagagcctcgtctgtcgcccaggctggagtgcaggggtgtggctcggtcatgaagctccgctccgggtccgccattctgctcggctcccagtggtgggatacaggctcctgccaccgcgcgggctgatttttggtatttggggggggacggggtctcaccgtgtgggccaggatggtcttgatctcctgacctcgtgatccacttgcctcggtctcccgaggtgctgggtttgcggcttgagccaccgtgcccggccaagccattagtttaaatttactcttccagaggtaaatttattacaccaatacaaaaccagtttggatatagatcctagttccttctcctttctatcaaaaacacctgtagtatattatgtactctgtggattccttccttttttttcttataaaaaatccagagatgggggtcttactacccctgaccaggtggtgtcgaacttgcctcaagtgatcttcccattttgacctcccaacagtgttgggattatcggcttgagccccccacccagatgattttattttcaactcacgtggctgattgatgacaacatggccttgtatacggctatttt

SEQ ID NO: 620515 - DNA, 1249 bp, Homo sapiens
  misc_feature (877)..(877): n is a, c, g, or t
  misc_feature (1249)..(1249): n is a, c, g, or t
tttttttttttatgggtgacccccgcctttattggtttcaatctccgtgaatctccatgggccgaccccgaaagccaaaaaattagcaaaaatttcaatctcagcaactctccgtgtatgtggtggacaaaaaatctgtgggcaggtgggaattaggcagctgggggggctgtgtgtggctctcggggggtgccgggggctctccatttactttctcccgactcgggtttcgatctttctactccccagagccaagaagagccagagggtgtgtgccctgttggtgtggaccccccagaggagaggaaaaaccccccgagacccggacacacctctcacaccaaagaagatctccgtattgtgtgtactatctcgagagaagacgcccaagttgttgtaaaacaccaacaccaagcgcccttgtgtatacacgtgagagtgtgtggcattgaaaaagagagatgtgtcctttgagatggtgtggagagaggtctatagagagaacactgtgtgtctcaaggagtctctatctctgtgaggtgtgtgcgccccttgtgtagaatatctccaccgacacactatcttctgtgagagagacaacatcatctctctcacagaaacaggcacaaagaggagatctcacactctcccacgaggggacacagagagggatgtctccacagaaggggagtgtgtgtctctcacaacgggaggtcatcagcgaggtgagagactccttctaaggggaagtgcttgcgtctccctgttatatcacccgctgttgagagggcggtgtgtgtctaccactataacattctgctgtggtggataagcacccatttttattgttgtgggcccacaacaaatgtggagactntttcccgcaatattagacatcttataaaaggcttcatatattgttggagaaaacccccgttggtggggacaaatatctgtgttggtgttgtaccccacatatttccggcgaagaaatactacacctgatgtggatgagaaggtggaggccaaacctatttttccccggcacgtggatttatcaacgagggagcgacgatctttcataagtggggcggaataaaactacttcccctatccggacggagaactagggtccgaaagagcagcttaaccaaagtctcatttaaagagagggggcaaccaacaaaaacaaccggcgtcttagtaatagctatcccacacactgcctgtgatcatcccgggggggtan

SEQ ID NO: 620516 - DNA, 1460 bp, Homo sapiens
gaggctgtctagaggatccctgcatttactccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 620517 - DNA, 1082 bp, Homo sapiens
gagctcccgacgtgagctgcgcctgtgcaacctcatgggcgccaagatggcgatggagatgaggcttccagtggctcgcaagcctcttagcgagagactgggccgcgacactaagaaacatctagtggtgccgggggatacaatcactacggacacaggattcatgcggggccatgggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacgagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagcgttctctgacggcagctgtctctttgccacacgaggagcctgaaatatggaaaactaggtcacggcggtaaggtaccaggtttcccgcctccctggtgaaacggcagaagacccactgtcatgatgtagccatgtggtgcctcagtgattctcggtaacaacggcttcatctggattacccaaacctgagcacaaacgaacgaggaagcaggagggcctcattgcaagactggagcccggctctctgctgatcgagaggtgactacccggattcggaacgggatcacctccggaggtacacccagaggacgacgcagcacgatacccaggacatccgagacggcacgaaggatcccagccacatcaggaggagcacacgcaaaccagaaatacgcgaggaaaggggaagggaacacgacccaggcacgggaaaacacagggacaaggcggggaccaaaaacacagcacacgacctacaaaagcagacacggatagaaccccacactgcgaacacgagacgaaaatcctgacccagcggcagagacacacaacacgagcaacccaaccgaccacgaaagacccacaaaacga

SEQ ID NO: 620518 - DNA, 4832 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattat

SEQ ID NO: 620519 - DNA, 236 bp, Homo sapiens
cgcccgagtgtgctgggtcgttctagaggtcccgcttgcggtagtgagggtggcacctcgtgcttcagcatctcctcgtggatgccacagtgtgcgtaggagtcagagtagtagtctctgggatgtcatgtcctgcagcgttgggcttctcgacggcttgccgcctggtgcacaggagcacctccatgatgcagttcgcggcctcggctgccggcatcttcacgcggttaaactcg

SEQ ID NO: 620520 - DNA, 6102 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatacatactccagaattaacccaaatttaaacagaacatttagaactactgcattttaaactacaccttaaccatttaaacctcttctaactttgctttcttatccgtgtgcataacttccagaaagaactagctcaatggaatcttcaagtgacctctgcagctcagtgggttaatagaaacaatctcaggtaatctcccttattagcccagtgcctactaggcagaaccgtggggccaaaaaccctggttaccacacgtgaaccaacccccgtgcgacagctaggccttcttcttttaacagaacagactaagtaacacgttgcccttaaacattcaaagggaaacaaaaaaccaagaacaacaaagccagcaaacgacaccgcacaacaaaacaacgcaagacgacacccgcaacaccaacacaacaacacacaacagcacacacacaccacaccaccaccggaactaacacaacaacacacaaacatagaacagacaaacgacaaacaaaaagcggtgatccctgcgccgccggccccgctgcccgaaggcgatcaccaagaggaaagttcgagaagaacaacaaatgaggaggtcggagggacggagtgagccagacgaaaacagacacaagaggcaacaaacaaaagggaagaaaagcgtggggactgacagaaaaacacacggagagcggagtaaaaacacacaggagaggaggaagggagcgaaacaacaacaacacaaaagaaagggggggaggggggacagagaggggcgtgtggcagaagcgaga

SEQ ID NO: 620521 - DNA, 740 bp, Homo sapiens
gcggccgcctactactactaaattcgcggccgcgtcgacgaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 620522 - DNA, 179 bp, Homo sapiens
agcaacagggtttctccttttctaaatgtccctcaacgcgaactgttagacatactgcttgcgataccctttttgaatattttttccccacaactcatcaacctcagatggatggcccacactgacttcaataggatggctgttatctaaggcgtcaaactcctggacacgaatgttca

SEQ ID NO: 620523 - DNA, 2363 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgtagcctccacaaaattgcatcaggccccacaacagctgcttgcatggaatagcagagaataccgcctgctccctccggacagcacactcctgaaaacggggagagaggagccaaacatgctcggtttacactttccttatttactgaatgagtggagggcagagacaggcctggagttacgcacactgagtgccccaacatggaaagaaacatcaggagggacaggaaacgttccctccttaaccaacagttttcaagaccttactggaggcactttattggctacataatcactccatgcggtgggcatcaggcagaatcctggtgcagacccaactttgaggtggaggatttcacagtttctttattttgaacttcccccaggctcccactaattcctctccattctatcctcctccctttcccacaaaagaaaacagaaaggagcagcagtgtttgataccgtatcatccagaggcctggttctctcccattatagggcaaacaagccctggcaagatatttcactcccgccccatgccatgcattaaaaatccaaaattgcctatattccacctgccaagcaagagatgctttcattattgaagttccaaatgtatacctttgagaacagtgccttctcgtcttaaaagagaggtcctcattttgtgagttgggagcagagggaattaaagaaagccatgatgcagggatttggccattcaagccgggcagccttcagagaatgtcatccctaatgacacatgcccgaatgaaggagcggggctgagcttgtcctgccttcgtattgaatgttgcctgtctgcctccttaatagcgggcctctgtgtgagcatttgacaagacttaaaactattcattgaagaaaatggatgatcccccaacaggaagatgcaaccccatgggctgcctgcttgaccacagaagtgcttccagctccagttgctcatctgagaactccccccaccacttgctgttaaaattgttaaaattaaaggccatgttgattgattttttaaactttatttccattttttttaataaaataagaattggacacacccccacctcacctccgccacaaagccccgggt

SEQ ID NO: 620524 - DNA, 1427 bp, Homo sapiens
  misc_feature (29)..(29): n is a, c, g, or t
  misc_feature (60)..(60): n is a, c, g, or t
  misc_feature (127)..(127): n is a, c, g, or t
  misc_feature (1335)..(1335): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgtgatggcttgtggttttacatacaatcattagagacggtaaaagaccacaggaatatagagtgcggaactcagatctcaaatattgnttatgaactgaaataaaagtagtttgccaacatctctattttgacaacccttgaacccttatatgtataaaaatatcttttaaaagaaaaaa

SEQ ID NO: 620525 - DNA, 1176 bp, Homo sapiens
gctgcggtgtggtttaccgtggtttgtgctctgcctgctctcgatgatgtgccgcgttgtgtcgtgctcccatcttctctgatggcgccgcctttgtttgcttgggggtcttggccgggcctgttgctggtcccttcgttgtttggtgttttctaatttcctctggtacattgttctgtcctctttgtctgtctctctcagtttgcctttatgtttggtgcctttgttctacccctccttctcctatccggttcggtgctctgcggcctcttttgtctggccttaacggcttctctcggtccagctgtcctgctctgttctgtgtattcgtggcctctgttgtctcgttcaagcgtcctcatggtggtcgtcctttcccttgggtgaatttcttgtctgaccctttctcgtttgtccgtgtccatctttgctagagttccatcccggccaatcctgcgtgggattcggctttgtgccatatcttgtcctctagctatgaatggagccgaatacgtctggtagacacgtatgaagcagttagggagcatgtgagcaagtgagagcctacgagccaagctgggcatcttgatgtcggatctcttctacaagctggtcatgaggcgcaagtggtatggagggcagggtcctgctgcccgcctctgggtccggcacatctgtcattctggtcctgcctgttttcttcctgtatttaagtctccgtgggtctgggtggaaccagcggtttcccaccatccaccctcatctcacgccttgttccctccaggcatctctgggaaaggacctgggtctggttgaggggtcccggaggagcctttgcccgtgtgtcagactccatccctcctctgccgccaccgcagcagccacaggcagacggaggacgaggatgatctgggaatcctagggggctccatgacaccttcccccccagacccagatcttggtgccgttgctcatcgacatggacacagccaggatcaagctgctcagacctgcttccctgggaggggcgtgacggaaccagcactgtgtggagaccagcttcaaggagcggaaggctggcttgaggcctacacagctggggcggggacttactgtctgcctgtacttcatggggggacggctccacccagcatacgccgctgtgttcttctctta

SEQ ID NO: 620526 - DNA, 127 bp, Homo sapiens
aaaagcccctattacatgctaaacaaagataagatcctccacgaggtaacaaaatcatgccaagcttgtgttcaagtaaatgccagtaaagctaaggtcggtcccggggtgcgagtaagaggacagt

SEQ ID NO: 620527 - DNA, 224 bp, Homo sapiens
cggcgcgagttgggatagtgagagcgagtcagacagctggcacatgatgaaacccgtcctataaaaataaaaaaaaatagccgggtgttgggacgtgcacctgtatcccagcttcttgggaggctgaggcaggagaactgcttgaacctgggaactggaggatgcagtgagctgagaacgcaccactgcactctagcctgggtgacagagctagactccatctc

SEQ ID NO: 620528 - DNA, 388 bp, Homo sapiens
  misc_feature (16)..(16): n is a, c, g, or t
  misc_feature (31)..(31): n is a, c, g, or t
  misc_feature (46)..(46): n is a, c, g, or t
  misc_feature (76)..(76): n is a, c, g, or t
cccatgggtctttaanccttatagatgtttntggatcccacagaancaagtttggggaaaccctgaactgatatcnagtcatgcaaaacgattcaacaaacccaaacaccctgcagcttatgaatgacccatgaccctcattgtgagtcaaaaatgaagccagaaagctgggtgcagtggctcatgcctataaccccagccctggacgatatagtgagacctcgtctctacaaaaaataaaaaaaaattagctgggcacagtgatgcaacactgcggtctcagctactcaggaggctgaggtgggaggctcacttgaatctaggaggtggaggctacagtgagatgtgatcaggccactgcactccagcctgggcaacacagccagac

SEQ ID NO: 620529 - DNA, 81 bp, Homo sapiens
gctcttggggaacttccgcgctggatttccctgaacttaattatcctggggactgggggccaaagggtcaccgataaactc

SEQ ID NO: 620530 - DNA, 474 bp, Homo sapiens
tatggacgagagactgactacttaccttagagactgcttaacaaggttggccttgattggcatctgggaacttggagttcaggggctccaccattcccagaactgatcaaagtagcttactatatctaaactgtaaaacaatatagtttctcctgaacacctgctttccttctgggagtctggaattttggtatgtgccaggcagagactacctttgtgaccaggctcccagtaaaaaccccaggcactcagtctctaacaaagcttttctggttgacagtgtttcacaagtgctgttacaactggttgctgggagaattaagctcatcctctgtgattccactggcggaggattcttgggacagcttgcaacttagtttcccctgacttcaccccatgtgtcttttttcctttgctgattttgttttgtatcctttcactgtaataaatcatggccgtgagcagaactgtaac

SEQ ID NO: 620531 - DNA, 345 bp, Homo sapiens
cccctgcccccaaactgggtaaaacagctttcagttcctgactccccaacttggtttttgcccttaagcagggccctgaactttgggctgcttctctgtgtgtaaaatgggcccatcttcctaatctgttaatggtcagtggtgtcccccaggatagtgctggcttccatggaaaccctccctcctggagattcccttcccttttcaagtggacagccccagccaggagcccgaccctgatttggtcgattttgtgaccccaaccccccccattggtaatgccagtttttatttggctggatataccattttagctatttaaatttggtccatattttccaatta

SEQ ID NO: 620532 - DNA, 465 bp, Homo sapiens
ggagctcgccaccccagcgcactagcctcatcatatagtgaccttctttttctcttcatacagtttttgccttgaaatctattttgtctggtataaggatagctactcctgctcctttctggtttccaatggcatgaaatatcattctccatttctttattttcagtcctctggtgtctttacaggtgaagcgcatttcttgtagacaacagatcaataggtcttgttttttcatctattcaaccagtctatgtctttcaattggagagtttagtctatttacattcaatggtattattaacgagtaagaacttactcctgccattttgttgttttctgattatttgtggccttttctttctttcctttagtgaaggtaattgtctctggtgataggatttagtctcttgcttttcattttttttttttttggtattgctgtgtgttttcttgtttgaagttacc

SEQ ID NO: 620533 - DNA, 342 bp, Homo sapiens
gatgagtaggtgagtttattgggacttacacacaggtcaatcctgggcggcgacaagacagctctagagatctgagcttcctcccaatgctaaactgctttcatgctaattttctgactgtttacttaccgggtaagagcgatgggactgttttcattggttggttctcacatactctctgggaagtttgggttctcagggacacctgctcctcagctggggaccatggccatggcccaccacctgcccttcagtgttcaagcaggggacatgcaccctttagtaacctggaggggacccatcacatgacaaccaccccaacgaccataatcaggaagccgc

SEQ ID NO: 620534 - DNA, 783 bp, Homo sapiens
tgggaaacaaggtttaggggttgcccaggcgggttctccagccccgggactcaagcaacccatccacttgggcctcccaaagtgctaggataacaggcgtgagctacgtgcgccgtggctacagaggctattctcaatggggctcaaactcatagttatacagaatgcaaggggcctctccatgtggacaggtccccttctccattagtgtttagatactagtgaaaaaaaaattattatcccaggcttaataatctagctagttctcaaaaggaaaagtttaaagaaacgtggtgggtgtcttaattagggagggcaacgtgggtaagacacctttgtgatcacactcgtgaaaaagaaatcaaggaagtgctagtgtggggaaagaacgccagaatcgtggctagagaaagttatagagagaattctcgtgtccataaactgtgtgtgtgatatttggggtggtaccaagtgggattgacaaagttacatatattgtgctccaatataagttacggtggaaaatgtgtagaactgaagcgttgggctcaatacactcagaatatatacggaggcatctactcctatgccgcgggcacttcacttgcacaaatgagcggactagaagaccatcaagggagggcgaaggtccataaatgcccgaaagaatatgtggcagtgagggcccttcatgaagaacggacacgttcggttgtccagaacgttcgggttgttcgcaacagtccgggcttcgaaacgaagggtgctcaaatgttgcagccg

SEQ ID NO: 620535 - DNA, 1523 bp, Homo sapiens
  misc_feature (1130)..(1130): n is a, c, g, or t
  misc_feature (1359)..(1359): n is a, c, g, or t
tttgcccacaaccaaggctgtgtgttcgttcacccgcgccaagagatgggtctccttggtggttgtccccccccgcggacccccccccgggcgtcgtgttgagagaccaccttatatcccctgggggggagaaagtggtgtgctggtagacaacgacgaaacattcgcccggggttttgccttggggatggaagacgcgcaccccccccacgaatagtgtgggacccgagaatgtgccctcttttttttgggcttgtggcgttggggcctccaccctttatgaacgatgccgctttttcgcccacaggttctattagaggggacacccaccacgggccttgtgggtgagaaatagtgggtctcttcgcctgtaaaccacgtgttgccccgcaccacccaaaaagggtgccacatgtggtccccacttgcaaccttgtgaccggcggaagcgacgaaggtgcgtttgcttgtggggaagagacccaacggaagatggtgggttgtccgtcagacccaacagagggtatttttcccgcccccccctcggccaccactttataaacggctttggggttcctcgtggtccccggtatattcctttcgctgttttcggggaagattccccgcccgtggccccacccaaaacaacacagcgggcctcatattgaataagcccacaggggttattagcccaccagggttatcgcccacatgtagaaacgcttggggagatatttgtggcgctccacagcctatatttcgctcgatggcgtttgtcctcgcgctcttttgtggcccccacgacttttcgcggttttctgagcacctcctcgcagagttcctggcccacaactccacacacacaactctttgtggaggagttcgctcgggcgcgctgtgcgcttctcaacactcgaaggtttgcctctggaaagaccacgagaggcaccccgatgtatattcctctcccaactagagcgctctaatagtgtgaagagaaaccaagatgtggcgctcgcttaaatatctctatagccgcgcgtgttataagagaggaaatatatatctctggtgatataaaaactcgggaagagccctcagcccaaggagagtatcacacacacagaatnttgtgagaaataagcgcttttctcttgtgtctctctcagagttctgctctcagaccccagccaccccaagaccccttgtttggtggcgcacactcatcacagagagcctgtgatgtggaaaagagatctctctcagaaacaccacatctcagatagccaaagcttgaaaagaagattgctcacaccaaatatttctttggcgttggatattgaagacgtttaaacatcnctctgtgtggagtatccacacatccaaatatacccacgtgtccagtgtttgtgccatttgtttcttagtgaaatttagtgtcccatttgtataaagggttactttcatactccttatgtaccagaaatcaccatgtaacaaataaaggttcccataaagccaca

SEQ ID NO: 620536 - DNA, 192 bp, Homo sapiens
tcccacacctgctcggagtccacacctgcaccggggtagtccgagtaacgtcgggcattccggatcaggcgagaaggtgttgtgggaagaaagttagatttacgccgataaatactactacgtgaaactggattttgaccgtaggtttaggtctacgggtgtacgcctgacgacataggggacaatcacgtg

SEQ ID NO: 620537 - DNA, 318 bp, Homo sapiens
cgacagaagggagaggaaactttaaaaaaacaccaaaaaaccaaaaatgacctgtcattactattcttagaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaatagaagagaaaaggtaaaattagaagactggctcagaagttctaatgtccaaataataggagtt

SEQ ID NO: 620538 - DNA, 164 bp, Homo sapiens
agtgctgtgtgccagcagtgtcctcacgccttcctgggcagcctttgcgctgggggtgctgatggtccggtattgtgattgggtgctcgtaaatgctcggggtcaacccagcacgacattgaccacgcccattgcagcctgtcctggagagaccctcatcgaca

SEQ ID NO: 620539 - DNA, 360 bp, Homo sapiens
gggatccttacctcacatagctcccaccggttcagatgcacagccctcaactgaacatcactccccgtcgtgttcagatgcacggctgaaactgaaatcagtccgcagtctcagtgatgctcaaatggaataagctcccagcaggtattcagctgtatacgcctcatagtggaacatcagctctccgcccaggtctccagctccaagagcctcaacctgcaacatcagatctccaccgggtctccagatgcacagccctcaaactggaacactggctccccccccgggtctccagctgcatggccttaaactggaacatcagctcctaggccctcaaacaggaacatcagctccccacag

SEQ ID NO: 620540 - DNA, 322 bp, Homo sapiens
catatttctttggatttagcttcttgttgcctggagagaagtatatggtaggaaaaccgctgacttcatatggggaaggcacatcattggctgtggcatccatcttggctatgacgatatttgggtctttgctgagctgctcgccaagttctttatacttgggctccaggttcttacaattgaccacaccaaggggcataaaattcaatcagcacatctttattttcattattcactatttcatcaaaattctctgctaccactaccttcacaggcccatcattgctctctgggataggttcagactccaggtatctcttca

SEQ ID NO: 620541 - DNA, 732 bp, Homo sapiens
ttatggccgggtccgaggccgcagacgtgattaaggcgaggcctgggataatcagaggatcagggccaccatgatgaaccgattgctcaaggacatgaggatcaagttactgatgagtagctatctctggtccgtgcctatgaataaatcaacgtgcattgctttcatgctactgacctcagtaaatgatgcgcgagtgacgatagtgcgagtgcaggagcagacacgatgctgacagtggaccaggttcatgtcatcaggtgctatcagatacaagaatgttactcgtgtctctagctacacaagggctacaagatactaggacatcgacatgtctatggacagtgaccttgcgcaagcgctacatcgatctggtcgcaaggtatactgggggctcaagagcgatggtctgacgctatgcctatgaagaggacgagactctacggttgttacctgctacgcatccagcattcatacattgcacaggaacagttacacaatgtgcctaggatgctgatagactgtctgtactgactcgtgttcaacctagcaatgagacttactttcaatcatggccctaggatggtcacctttggtaccatagccaaggacctactttaacaaccccctaggacctagcacggatttggtttgaccaagtgtcactattactacttcatcgacgacccccttaggatcaccactttgcctttctcctaaggacaacaaccc

SEQ ID NO: 620542 - DNA, 894 bp, Homo sapiens
tttttgaatttttagtagagacagggtttcgctgtgttggccaggatgctcttgatctcctgaccttgtgatccacccgccttggcctcccagggtgctgggattgcaggtgtgagccaccacgcccagcctatacctatatattttaatttgggatgggggtcttgctctgtcgcccaggctggagtgcagtggcatgattatacctcactgcagcctggaactcccgggctcgggagatcctctcacctcagcctcccaagtaactggcactacatacaggtcaggtgtgcaccacagcgcctggctcaaatcataattttttttttgagacggacttttgctcttgttgcccaggctggagtgcagtgatcccatctcggctcgctgcggcctctgcctcctgggttcaagcgattctccagcgttggcctccctagtggctgggattgcaggcatgtgccatcagtcctggctaattttttgtattttggtggagacggggtttcaccgtgttggtcaggctggtctcgaactcctgacctcggatgatctgtctgccttggctcccaaagtgctgggattgcgggcgtgggcactgacgcagcccgaattacaatttttgagtatgtatagtatatttggtattgtcaatcattcctcaaagctataaaaaagaaaaacaaaaaaaaaagggggggggggcaaaaagtttcctggaggggccaggttagggtaccagttttggtaaagggggcctaagggggggattaaagaaggcgggggggtaaacgtggatgggaagggcgggtttggaggaccctctgggggattgggaccccagataaggcggagtaataggttggtgaggttggctgagtgtgtgtaacgaga

SEQ ID NO: 620543 - DNA, 615 bp, Homo sapiens
  misc_feature (181)..(181): n is a, c, g, or t
cgactctaccggatctatccccaaactcattagatgttacaatcaccttaggcaggatacagctgtgagcattctgggtaaactgcaagagcttgtacacctgcatagtacaatatatgaccataattctttaacaattgtgaccattgctggagagcagttttcaagtcttgccatagantttcaagcccatttaaatcaaaactgtaactaggccattcggggaaacattcattgtcatcttggtaaaacaattaccaattattatactcctttgtttacgttgacgttgcagtgtgaggttatgattcctgtacaccacaactaccgatggcctctcacctacctccctgttaggcccgactcgtacgttgttggtaatcaatgcctaccactagtgttgtctacaaacttgatgattgagtaggaggcgtgcatggccacacagtcatgggtgaacagggagtacaggagagggctgagaatgcacccttgtgggtccccaatgtagaggatcagcggggtggagatgtagtttcctaccctcaacacctggggcggtccgacaggaagtcccaggaccagttgcacagggtgggatcgagacccaggggc

SEQ ID NO: 620544 - DNA, 1643 bp, Homo sapiens
  misc_feature (1437)..(1437): n is a, c, g, or t
ctgaggaggaaaaaaaaaaaaaaagaaaaaaaccaaaaacctcaagggcctactccaaaaggtgggtcattttatgttaaggggaagaaattccagggtagtggccatgtggagtgtgttccaagttattgtgtgggcagatttttcagcacacatcttttctcccactgtggttataaggagttaaggtggatttacgtgccatttcactttcaataatccagataggactccagtgtgatctccttatacaagtttagaaaaacatataattcttatcgtgcctattctctcagtgaactccaaaccataatgtggccttatactctctttctgtggaaacatttgtaacaccctatagtgaatattgtattctgtggtggccacgtgggagatatatctgtgtggtcatatgtgtataagaaaataacacagacgaaccctctcgggtgtgcgccttatctcgcgtggttatatttagcacaacaatttatttagaccctattttttctagacagatataagggggtctccataaagcatttcaaggcaacaactttcgggcaataatatagggggctcaacggcaaaggcgctctcccgcctgtggagagtaggtaaccccgagaaaaagtgtataagggatatgttacccacaatgtgggaacgctttaagtgttaatgagctacccgaaggtggcgcggtgtggtttttctctgtggacacacttcagttggaaagcgcaattacacgacgacaagagcatacaagggggagaagaaaaaacggcccatccaaagcagtgccccaggtgggggcagcactgtcaccaaactccagtgggggccaccaagaaacaaaacatacagatggaaataacagtaccgcccagaaaacacagacggtggaggaggaaataacagatgggggagtatggaggaacacacaacgacagaagacggaggccgccgcacaaaaatggtggaacaaaacagcagtgggatcaagactgcttacctcaccaacgcgggagcgtgggagagaaaacaccacaaaaaataaaaggaggggaggacacaataggaaaaggaccactccgcatcgacagaggtagatgaacgggcgaccacgtgaggggaacaagaagtggatccaccccgtgggtgtaaacagaggcgacccagaaagagagagtataccagccccccgagtggggcccgatacactgtcacaattttaccaaagcagcgttggggaacgatctcgtagcaaagcgggcgactccaaacgaagcaccagctatggttaatcactaacgttgccaccaaggcagcagttgacatcgcagaagaaagagttattactggcagcaagcgcggacaaacgatcagacaagattgcacgaaccgaggccgcattcatgcacggccagatgngacagaatagtcccacaaaagaaacaaacgaaaaatcaccactcagacagtagatcaacgcggaagcggagagcgaggcggtaataaccagaggtggcgggcaccatcacgacaaccaacaattcagagtgcggatgacttgtcagcgccccagcagtgaacaaagccaagcagagtcggaacaaaccagagcgaggctgagacac

SEQ ID NO: 620545 - DNA, 380 bp, Homo sapiens
acatcagtaatgctctggaaagtctcagcgatagatatagaagaatcagagctcgaagacaaggtcttcgaattaacccaatccaacaaagacaaagaaaaaagaatacgaaaatatgaacaaagcctccaagaagtctgggattatgttaaatgaccacacctaagaataatcagtgttcctgaggaagaagagaatactaaaagcttggaaaacatatctgcgggggataatttgaggaaaactttcccgtggccttgcttagagaacgtagacatccaaaatacagaaagcataaaagatcacctggggaaattcatcttcaaaaagatcttcgcgtaggcacatggtcatgaggttatccaagtgattgttccccg

SEQ ID NO: 620546 - DNA, 473 bp, Homo sapiens
  misc_feature (1)..(1): n is a, c, g, or t
  misc_feature (80)..(80): n is a, c, g, or t
  misc_feature (149)..(149): n is a, c, g, or t
  misc_feature (154)..(154): n is a, c, g, or t
  misc_feature (164)..(164): n is a, c, g, or t
  misc_feature (169)..(170): n is a, c, g, or t
  misc_feature (172)..(172): n is a, c, g, or t
  misc_feature (175)..(176): n is a, c, g, or t
  misc_feature (178)..(178): n is a, c, g, or t
  misc_feature (268)..(268): n is a, c, g, or t
  misc_feature (270)..(270): n is a, c, g, or t
  misc_feature (323)..(323): n is a, c, g, or t
  misc_feature (412)..(412): n is a, c, g, or t
  misc_feature (470)..(470): n is a, c, g, or t
ntgttttttaaaaaaaattccccttatggactggtttggtcaatcaactacaacactttctagcagacataaggtaaaantggcatggctcagaatcgcccagatctttcacgatttctcgaccgcctcctgtcacgctcccgtcggcngccanctccaacacnggcanngncanngncaggaccagggtctctagaccgggaacgacgctcccgggatcgggatcttgatctatgcttcttgcgaggggggccatacagctcccgcngnagctctctggaaatgggcttcaaatgcatgaagttgcagaagccgcctcgtgngcattctcccatctcatactgacgggagcaggcttctctgaagtccgtcacgggtgaaagctcggcgtggataggctgtccattaaacnaagggttattcaagtcaatcacagccttttcgggatcttcctcacggggaaaattgangta

SEQ ID NO: 620547 - DNA, 800 bp, Homo sapiens
acagaaatcaggctatgtacgaggctcggtggtgaatctggactgaggcaagcccaaaccatatatctcagactttgccctcatctctgtgtaatacccaagtactctccctctagtcccccctatctctcatactctgcccctctcccagcctagactcaagtctgggtatatacagctgcctgccagccctattgctagctgtatgctagtaactctgtcctatgtgcccataggtgactaggagtgcctataacactgacttgattactccacactgcatcacccctgcaatgcatgagtccttaacctgctcctattgccagacacctgatgctcttccactatccatagtaccttgatgacacattaccttgtgctagtactggaacactcaatcatacttacaatggatgcaatgtggtgtgaacttttttgtggtgaccaccttgaccacatgaccaatatgtgtgacttgttgtaattatcctgtgtcctgtgtgtgcaccccctgtacatcaataccacctgtcatacacactatcccagtggtgaacatcatgcttgtagccctgtggggtatatactcaacttgatccctacagactttgaccacctagcccaaacactgcaacccaccaaggccattctattaacagctccagcaagcccccatatacctgtgggaactaggctaaatgtgcatgcaccaacttcccccagggccacacgccacatactctgtccaagggatctccaagatgagtgtcagtacctccttacgccgccagctgattgcc

SEQ ID NO: 620548 - DNA, 214 bp, Homo sapiens
tgaggctgtggctgcatccagtctaggaagtgaggagcgcctcttcccagccgccatcacatctaggaagtgaggagcgtctctgcccggccgcccatcgtctgaaatgtggggatgcgcctctgccccgccgccccatctggggatgtgacggagcactctttgtccgggccgcagacccctgtctggggagtgtgatggagctgtctcgtgc

SEQ ID NO: 620549 - DNA, 655 bp, Homo sapiens
  misc_feature (1)..(1): n is a, c, g, or t
  misc_feature (78)..(78): n is a, c, g, or t
  misc_feature (111)..(111): n is a, c, g, or t
  misc_feature (116)..(116): n is a, c, g, or t
  misc_feature (271)..(271): n is a, c, g, or t
  misc_feature (286)..(286): n is a, c, g, or t
  misc_feature (289)..(289): n is a, c, g, or t
  misc_feature (457)..(457): n is a, c, g, or t
  misc_feature (596)..(596): n is a, c, g, or t
  misc_feature (615)..(615): n is a, c, g, or t
nctcacgagatgagcagatgaagtgtatttatggattctggtttttctgaattttcaaagcataaggagtcaaaacanaaatagggtagggggaggataaaatacttaatnaaaangttttttttttgtttctttggcctttcatggagtgtggatttgtccattcttaatgtgtattaataggtatatgtgcataaaatagctattttgtaacattaaactttttgagtcattttggtcaggggggggcttaccttcctggttatttaancttatatttacctantancctttaaccaaacaataaccttttaaccaaataaaatgtggtaataaatacctttgcactggttatcttgtatactaggctggcttggtttgctgtctggttttaacccattcaatatatggggacatccaaaaggggttaaaagccacctcctgccctggcccggtntctctcccttcattcttctggtttagaaatacatgttgaatggcagcttctggattatttctattatatggaatctgatgacttaaaggaggagattaacctttcaggctctttgaatttgggttttataatttgggtntaaagatcacttactctgncaagaataaggagtaataaatcctggtcatatctgagatc

SEQ ID NO: 620550 - DNA, 497 bp, Homo sapiens
ggaccaaccaccctccctcccacagcaatcctggaggcaggagtgggagcccaatgaacagcaatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtccagtggcttattaatccgataacagttttcttgctaacaaattgcttgtaccagaggttgtggagcgaaggccaggttgggggcagtgttggtgcgcctgcccagcccaaactgggggctctgtatatagctatgaagaaaacacaaagtgtataaatctgagtatatatttacatgtttttttaaaaggttcgttaccagagatctaccatcggtaagatcctcctggtggctgggaggcatcagttgctatatattaaaaac

SEQ ID NO: 620551 - DNA, 181 bp, Homo sapiens
aaaatgggggggggggggggtaaaaacttagggggcggtgacccccccccaaccctttgggggggttccaatttttgggggggggaaaatccaaccccgggctcccccccctaaaggttttttggccaaagggttaggggggagggggggttttggggaaaaaaaggttttcccccccgga

SEQ ID NO: 620552 - DNA, 521 bp, Homo sapiens
  misc_feature (19)..(19): n is a, c, g, or t
  misc_feature (24)..(24): n is a, c, g, or t
  misc_feature (53)..(53): n is a, c, g, or t
  misc_feature (58)..(58): n is a, c, g, or t
  misc_feature (283)..(283): n is a, c, g, or t
agggtaggccaaaggtttncctanggtcacaccaaagcattaaagccatttanaaaanccctgataaattagatgttccatcaaaagttaaacccttttcctaagaaagacagttaagaaaaatgaaaaggtaagccatagacttggagaaaatacttgtaatacatatatgacagaggatttgtagctaaattatagagaacccctacaacttagtaagacaatttaaagatctgtgaggctaggcacagtggctcaggcctgtaatcccggtgctttgggnagccgaggcctgaggatcacttgaagctaggagttcaaaaccagcctgggcaatatagtgagaacctgtctctgcaaaaataaaaattagccaggtatggtgacgaatgcctatagttttagctattcgggaggctaaagcaggaggatcacttgagcctaggagttcaaggttacagttagctatgattgcaccactgcattccagcctgagttacagagtgaaactttgtctatta

SEQ ID NO: 620553 - DNA, 136 bp, Homo sapiens
agagacgtttgcaagtggtgacaccttcatcgatgagcacaggcgctcgtacgtgagggtgagttacacacttctccacaacattgcttgacatttgtgctgactcaatacaagtacattgcaacacggtctctca

SEQ ID NO: 620554 - DNA, 291 bp, Homo sapiens
cccaggaaattgcatatcagaactacagaacagagggattctttgactcagaaactacaggaagtagaaattcggaacagatacctggagggacaactgtctgacttagagcaacgtctggtgaaatagtcacgaatgaacaacgaagcttcttcgcaagtaacctggatgacacatcttagaacattctggatggacaagatattttgaactacacagaattcctgagatatacttggccaatgctaactatgaatgcagctaaaggaaaagtgaatatctcttgttgcc

SEQ ID NO: 620555 - DNA, 189 bp, Homo sapiens
gactggggataaacttgcggtagttggctaaggatgacttctagcaatgcctcgctaggcacgaccttaccccccactattaacctactgagagaactctctgtgctaggtaaccacgtactcctgcatcaaatatcaccctcctacttacaggactcaacatactagtcacagccctatactccctct

SEQ ID NO: 620556 - DNA, 917 bp, Homo sapiens
atttcatatatatgaatgtcatatatattttcatatatatgaatgtcatatatatttcatgtatatgaatgtcatatatatttcatatgtgtgaatgtcatatatattttcatatatatgaatgtcatatattttcatatatatgaatgtcatatatatttcatatatatgaatgtcatatatatttcataactatctcatatatatatgaaattcatctctatttcatatatatatgaaattcatatctatttcataactatatgaaattcattatctatttcataaatatatgaagttcatatctatttcatatatatatgaaattcatatctattcatatatatttcatatatatttccatatatatatatctaaattcatcagaacaaggtgtctcttgtcactatctgaccgaacaccaagtgtaatgaaacagtaagtgtgaaaaagaataaaaccaatacaggaatcaagagccccaaagtgcgtgggatcacaggcatgagccaccggcctggcccattaatcttcctctttcgaggtaacggattgttggaagatggcatgtaatagacgatgatatgcaaaggatatccagttatccataaggataaacaaaggagacgccaaaacacgcttgaagacaacaactgggacacacacgttcacgccgacaccggagccacccataaccctcactcgctgaacgcgacaacttccagctgcccagccaattgtgcaagcacgcactcagttgccccgaacgccccccgccgaacaacatcacacccacacagacaagccacagaccgcaccgcacgcccggttgtaccgtcatcaccagcgatgagcccacactaccacccacaacaacacacacgaaaaccaacacacccacacgcaagacgaaccaa

SEQ ID NO: 620557 - DNA, 452 bp, Homo sapiens
cacctttttgtggccaccaaggaaaacggaaattaattacgcattggggcctaatcccacttggttttggactggaaggggaagtgtcgaaatatcttgattgtcgattctggtgtcacctgtgttaccaccaatcaaagacaaagtctttttattcgtcatcattatctcatttgagacagagtctcgctctgtcgcccagtgtggagtgcagtggtgtgatcttggctcactaggaaagctcctgcctcccaggttcaagcgattctcccacctcagctcctgagttgtggtcctacaggcgcacacgaccacgccagctaatttttgtattctagtagagttggggttcaccatgttagccaggatggtctcgatctcctgacctcgtgatccatcacctcagcctcccaaaatcctggggttacagatgtgagctaccactcacggcc

SEQ ID NO: 620558 - DNA, 247 bp, Homo sapiens
cagctagtgctgactcctgcatcgacatcagtgtaactgacctcagcagacctgacggacagcattaaggccccatatggccgagacgagccctgtctcctgcagaggctgcccaacaatccacattaggcatctccttcatcccccggagaagatgggctaacatctggtcagcactcaagaaacatggtgaccatgtagacaacagccccgtgtctatcatggtggcccagtcagacgactcgat

SEQ ID NO: 620559 - DNA, 601 bp, Homo sapiens
gggcgactctacaggatctctacagcagctatccaagactgatttgatactcaagggaaaaactacagaagcttggtgaaggagaagggtcagtgacgaaggaagaattcacaaagatgaaacaggaactggaagctgaatatttgggcatattccagaagacagttgcgaagccttaagtggtccctgtgtcgtgtggcagcacatcctatttggagaagagatttaaatttccatgtcttcttggagtataatcaagatttgagtgtgcgaggagaaaataaaaaagagaaacttgaagacttctttaaaaacatggttaaatcagcagatggagtaatcgtttcaggagtaaaggatgttagatgatttctttgagcacgaacgaacatttctttgggaatatcataaccgagttaaggatgcatctgctaaatctgatagaatgacaagatcccacaaaagtgctgcagatgattacaatagaatgggttcttcattatatgctttaggaactcaggattctacagatatatgccagtttctcctcaaagtttcagacctgttcgataaaacaagaaaaatagaagcacgagtgtct

SEQ ID NO: 620560 - DNA, 141 bp, Homo sapiens
tgcgatactaagagaggtgctctctactgagggggctgagacaatggcattgcgacagaagagagaaggccaagcgagactagcagtcatccagacccctgcaccacctagactgttttctgagccctccggacctgagac

SEQ ID NO: 620561 - DNA, 1114 bp, Homo sapiens
ggtgttccttggaatttcacatttaatgtgaagttttatccagccgacccagcacaattaacagaagacataacaagatactatttatgtcttcagcttcggcaggacattgttgctggacgtctgccctgttcctttgcaactttagccctactcgggtcttacacgaaccagtctgagctgggagactatgacccagaactgcacggcatggattatgttagtgattttaaactggctccaaatcagaccaaggaacttgaagaaaaggtcatggaattgcataaatcatacaggtccatgactccagctcaggctgacttggaatttcttgagaatgccaaaaagttgtccatgtatggagttgatcttcacaaagcaaaggacttggagggagtggacattattctcggcgtctgctccagcggccttctggtttacaaagacaagttgagaattaaccgctttccttggcccaaagtgctaaagatttcttacaaacgcagcagcttcttcatcaagatccggcctggagagcaagaacattatgaaagtaccatcggcttcaagctccccagttatcgagcggcaagaaactatggaaggtctgtgtggagcatcacacgttcttcagactcacctctacagacaccatccccaaaagcaagtttcttgccctgggatccaaaattccgatacaggggcggactcaaggtccgaccagggcaagccagggcgctgattgagacaggctggtgcccacttggagcgggaagaagacaacgggggacaagagactcaaggggcacactggtggagccacaaccgagagcggacactctggccaaccaggtgcaagcagggttcaaggacgccgcgaggcgcccacttacacaaacccagcaaagcgtgaggggcgacaaaaaccgcgaaaaagacgccgacgcacgcgaagagccgacccaagcaagggggtccacacacgaagagaacaagacgacgacaccgacgacagatacgatccaaagcacaagaggacaaagacgccagtatcgctgataacaccatcaggtcaagatcaaagacacaccgacgacaaacagataagatcaga

SEQ ID NO: 620562 - DNA, 1256 bp, Homo sapiens
  misc_feature (109)..(109): n is a, c, g, or t
  misc_feature (119)..(119): n is a, c, g, or t
  misc_feature (146)..(146): n is a, c, g, or t
  misc_feature (161)..(161): n is a, c, g, or t
  misc_feature (167)..(167): n is a, c, g, or t
  misc_feature (180)..(180): n is a, c, g, or t
  misc_feature (183)..(184): n is a, c, g, or t
  misc_feature (186)..(186): n is a, c, g, or t
  misc_feature (197)..(197): n is a, c, g, or t
  misc_feature (199)..(199): n is a, c, g, or t
  misc_feature (201)..(201): n is a, c, g, or t
ctcccaacatcctggagactacagaaggcctggagctgctgaagactgctcattgggcaacagctggctacactgataaggtggtcatcggcatggacgtagcggcctncgagttcttnaggtctgggaagtatgacctggacttnaagtctcccgatgancccagnaggtacatctcgnctnnancagctggctgnancngtacaagtccttccatcaaggactcaccccagtggtgtctatcgaagcatccctttgcaccaggcatgcactggggagcattggccagaagttccacagcccagtgccaggcacatcccaggtcagtgcgcgggcattgcatctccaccagtgcacccaacccaacagcaggcatcgcccacaggccgtgcaacgcagcaagtccgtgccacactgcctacctgcatcaaacgtcaaccacgataggctccgatgaccgacgtctacttacagcgcgtgcacagctggacccaggccaactggtatggggcgtcatggtgtctccatacgttacggcgggacgactgacagataccttccatcgctgacctggttgtgcggacctgtgcaactgggccaggatccacgactggatgcccatttgccgatactgaagcgcttggccacgtcaccaccaagatacctccgcacttgaccgcagacgctgggacaaaccacagggctcaaggtatgggccggccaggacaccaccgcaacaccaccttggggccaagcaacggcctgtggagccagggacacacccaacgatcacacatgctgcgaccaacacagaagccactcaccattggaggaccagccatcaggccagtccagggacaacggacccaaaacgatgacacggggtaccccgtgcaagcgtataagcgccccaaatcgcacgaggacacatcgcacacacgcgataccgcaaacgaacgcacccgaacgcccacgccacctgaccaccacccttggcacgcaatgacacacgcagcacgagcataagcgccccagggccgtagagatcgcgacacaaaacaccaagcgcatacacccgcgaacgacgacacatccagaggatacaacagcaaaacccaaggggggacccacaatgcgcgacccagccggcaacaccaagcgggagcacacagcgcggaacagcacaagacatagaagcaacagaaaacaccgccagactcagagaagcacaacagacgccgcaacaacgtcactcc

SEQ ID NO: 620563 - DNA, 417 bp, Homo sapiens
atcaccctgctccctgcttcctgtgtgttcttctggcaaccagactgtgagccatgcctgcccgtgcacactgtgcggctcttcaccgctatactgaggcccttctcccaactgcccctcccaaaccaccaccaacagcagaaagcctggctaagacatcgttatcctccaggattttccagttcttcagaaagctgctcctgcaatcacccagtggttcttcctgcctgctgcacagacaaaaccaatgccctgagaccgtggcattaccacagagagagtttaattggaggcctggcactatgcctcacacctgtaatcccagcaactggggaggccggggtgggaggattgcttgaacccagatatttcagaccagcctgggcaacatagagagccccagtctcttaaaaaaaa

SEQ ID NO: 620564 - DNA, 107 bp, Homo sapiens
ttacacattaggctccattgtgaagcagaattcaccaagctacacatgagggtgccgtgactggtggcggtacacctgtcaatacggtatacgcacgattcctagag

SEQ ID NO: 620565 - DNA, 359 bp, Homo sapiens
ccttgtttggcaggcatcgtctgaagggcccacctgagatgtggtggagccagtggttgttttgtcacttggagaaggtttcgttggcacaactggagaggaagtggtggtccgtggttgaggagcagtgggttcagggccagttctaggtccatagagatactgaatgccagcactatcatctcgatgcaaggggaaaccctccacgtatttgtacatgggatacatcggggcatctttagtgttggagtgatcctaaccaagagcatgtccgaactcacgcccagccgccagaacccctatccccccttttcctcctatcccccccccccggcatcattaccgggttttcctcttta

SEQ ID NO: 620566 - DNA, 620 bp, Homo sapiens
cttctaagcacctccggtccatgtactgtggccatccaggccgtgctgtccctctacgcctctgggcgcagccagtggtcattgtcatggactctggagacggggtcacccacacggtgcccatctacgagggctacgccctccacccacggccatccgtgcgtcgtggacctggcataggccagggaccgtgaccggacataccttctatgaagatcctcgacgtgagcgaggctacatgcttctaccaccacggccgagcgggagaatcggtgcgcgcacatccaagggaggaagcgggctgctaccgtcgcccttgggactaacagaagcgaggcacgcatggccgacgcagcgcgccaatcgcgtccctcatagcgtgcgtggggaggaaaggaggcatacggaggcgtgccgcgactggtccacggtcagtcgaccagtgtgggcaactgacgcggatatccgcgtgtccgtgaggtcgcttgcttccaggccattcacttccatgggatatgggaatctgtggcggcatcacacgaagaaaccacgccttcgaacctccaatcatgcacgttgtggacgctggcacactcacgcaccggcacctggtaccgcca

SEQ ID NO: 620567 - DNA, 646 bp, Homo sapiens
  misc_feature (183)..(183): n is a, c, g, or t
  misc_feature (196)..(196): n is a, c, g, or t
agcggagtgtgcctcgtctgaggggacaggaggatcaccctcttcgtcgcttcgcgccagtgtgtcgggctgggcctgacaagccacctgaggagaggctcggagccgggcccggacccgggatgccgccgcttctctctagtctcacgaggggtttcccgctcgacccccacctctggactngcctttccttctnttctccgcgtgtggagggagccagcgcttaggccggagcgagcctgggggccgcccgccgctgaagacatcgcggggaccgattcaccatggacggcgccggcggcgcgaacgacaagaaccaagatccagtcctgaaccgctcgaacaagaaacagtctcgacgatgcagccaggtctcggcgaagtacaacgacatctgcacagttctcccactgagcttgctcactcagcttgccacttccacataatgtgagttcgcactcttgcactaaggcctctgtgatgcacgcttaccatcagcctattcgcgctgtgagcgcaccctcctggcatgctgggtgattacggcatatctgcaacatcaccatgacaagcccccgctgcaatcgctctccatcctgaccacgccttgccctgcgcctccgctccatggcttctcaccgcatgc

SEQ ID NO: 620568 - DNA, 252 bp, Homo sapiens
gcaatcccaccggaccccaggcccctgggctaagggggcagagcaggccccggccccagggcaattgtttgggaccccccttttactctgtaaagtttgtatttattccccctttagggtttgcagagggggtaggggcagagtcaggggctggccagagggtcttcttccctggacaagaaggaaggagggtgacgaccttgggcttgggcacacctggcattctgtggggagccgtcctcggtggtggcc

SEQ ID NO: 620569 - DNA, 144 bp, Homo sapiens
gactctccgtcagggcgtgtgcttgttgattccaggacgggctactgcgtacatccacaggttcactaacgggggcaaggaaaaaagggttgctcattttcgggtatcactgagagtctgactggaaacgagatacggcgcatc

SEQ ID NO: 620570 - DNA, 264 bp, Homo sapiens
ggtcgcctcggccgtgtggttgtagacaccgtcgacggataccctcgatgccggcctcgtgcagcgccctgaccatctgtttgaactcgcgcacggggtcctcgaccgcgtagcggggctcgggagcgaagtagccaatggggttgtagccccagtagttgcgcgggccgagctgcaccagccgatggtcgtccacgaacgcatgcaccggcatcagctcgacggccgtcacgccgagccgcttcaaatgatcgaccacgtgcg

SEQ ID NO: 620571 - DNA, 164 bp, Homo sapiens
ggctcggccctattggatcttattaaaaatgcaaacattacctgtcggtggtggtgcgcacctgtaatcccagaccactaggaaggctgaggaaggagaatggcgcgaacctggtgaggcggaggtttgcagtgaacctgaggttgcagtaagccgagatctca

SEQ ID NO: 620572 - DNA, 121 bp, Homo sapiens
aaaaaaaacccccccggggggccccccacccgggggggaaaaaccgggggtgggggatttccccccttttttttttaaaggggggggggaatttttttttcgggtttttttttcccccaga

SEQ ID NO: 620573 - DNA, 181 bp, Homo sapiens
gttttttttttggggggggggggtttaaagtatagggttttaaaaacaggggcttttaaggggaacacccgggccaaaaatgtgccacgaattttggggcccctaaaaaggttaatgggggggaaaaaaaggaagggaaaggaaaaagaagggaaaaagaggagagaggggggaaaaaaaa

SEQ ID NO: 620574 - DNA, 141 bp, Homo sapiens
gtgcgtgcgcacacacacccacgagctcataatgtggtgctggccctaagttaagcaaaatgcttctgcacacaaaactctctggtttacttcaaattaactctctcctaaataaagtctccctgacttcttgtgtcctca

SEQ ID NO: 620575 - DNA, 135 bp, Homo sapiens
attaaaccagttttgactccaaagacccagcagatcaaatacaaataccaatattaagcttaagagcaaattaaagaaatattttcctgtaacaggatgaatcaaccctatgtagtagacaagtttggcagaacc

SEQ ID NO: 620576 - DNA, 771 bp, Homo sapiens
agcggggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcgcgaagggtcttcgttccctgcagccatcccacgggaatgacaatggataaaagtgagctggtacagaaagccaaactcgctgagccaggctgagcgactatgatgatatggctgcagccatgaaggcagtcacagaacaggggcatgaactctccaacgcaagagagcaaatctgctctctgcttgcctacaagaatgtggctaggcgcccgccgctcttcctggcgtgtcatctccagcattgcgcagaaaacacgagaggaactgcgccgaagcacgcacgatgggcacaagagtaccgtgagaagactagaggcagaactgcaggacatctgcaactgcactgtcccgccgcctgtcggacacacatatcttattcccaatgctacacaaccagaaacgtacggctgttctacttgacaactgaccggagattatcctacgcgtatcttctctgacagtggccatcctggagaccacaagacaaaccactgtgtcgaacctcccagcacggcttaccaggaacgcactctgacactcacgtaagaacagaaatgcagcctacacacccaattcgtctgggtctggcactaacatctctccagtctttcactatgagcaa

SEQ ID NO: 620577 - DNA, 886 bp, Homo sapiens
  misc_feature (288)..(288): n is a, c, g, or t
  misc_feature (688)..(688): n is a, c, g, or t
aacaacagaccgccgcactaaaaaaaaaaaaagaatttttagctgcacaggctctcttatttaccaccgctacagagtgaagatacacaacagcaaatcatcagggagactttccatttggtatctaaaagagatgaaaatgtttgtactcccctagaaggacgattattaatcgcgaggatctgaccacaaactgatttatagacattatgcaacgttttattttgtcttctgtgtgcattctacacaaagcgaacttgacatttttttttttacccaggtattccncgaaacattacacaaatgctccgagaactgcccgtagctgtaattcatttcccacgcagacagcgcgcccaatcatcttggagacatcaccgtccgtccaatgttatcccacacaatattgactcctagcttacaccataagctacactacatatacagaatcatccaatgcttccacaacaccaccttcactcctgtgttcaatcaaatggcaagaacacaactccgcccgcgatccgcgttatataaaaaactttgtggatcttctaccaatcactctcctcctggcccatactaaataataaattcgcaccaataaccttcccaactcgtcaaaacaaaacataacacattaatttaaaaatataacaaacaccgcaacaaaacgatgccaaaaccnacccccaacaccccaactcttaaactcaatggcattgaagcagctggcagacaaagagtaaatagagacacaaaaatggtacgcgcaaccgcgaaatcaacagcagacgaaacatcccaaactcagtggtggaggcacaaccgccccccccaccaccccaccgagcagcggggtctataactagaaactcagctcacg

SEQ ID NO: 620578 - DNA, 357 bp, Homo sapiens
aactgtttacttcagttgtttgatatgtacacaatgtaccttagactacctagttgttctaccagcgattaagattacaaagtcttcatatgcgtcacaaatattttgagcacagataggacctacttccttaactcttttaactattacctacaaccattacatactttatagtttatcaggctacctcgtgacgtaacttgtacagtttgcttccattgttatgtctaacatatcgggacctccgcttaagataccttgcattaatcgttggcttggatgtttagctgtatagcctctggctagtctattcctttctactaccttgcagactgggtttttgaggctgcatttcaa

SEQ ID NO: 620579 - DNA, 616 bp, Homo sapiens
gcaagcctggaccccttaacagtggcgctgctaaacagccacctccccaagagtttttttggcaacagatgtccacaagcaatcgtgaattgcccagtgagggaaaatggtgaaagcagtccttctagagagaacgtttcttgtggggcgcgactaatagagtcttctctcctcctgctccccgtcaagggggtaccccctggcgcggatatatccgggatataatccaggttccccattgactggacgagtttcaggagactgtgttttgtgccttccacagtgtatgaacacctgtcgtcaatgtgttgaaaaacatttgctccttgaagagaggccggggctgagcccccgcatgtcggttcattcgggggaagaaacaatcggcccatcaatgggttttgcaatagtcaacagaacagcttttaacccacctttgggagcaatcgatcggtcctataagtattcagcggagtcccgcccctgcgggagagaatatatatgcaccccatctctgcatcggtaaaaaaggagttcaaaaccgttcgaaacaagttcaaaataaggagggttggaacccccgagggacgcccctggagccggaaaaacgttccca

SEQ ID NO: 620580 - DNA, 311 bp, Homo sapiens
cgtgaagaaaaagaaaaaagaaaaaaaaaagaaagaaacgaaaagagagaaaacacaaagagagacaaccaccagacaaagacgacaaaagaacgaaagcaggccagaacagcagcagaaagaacggagcgaaagctgggcgcgaagaacggaacgcagaagacagacaaaagcaaaggagagaagaaaagcaagacaggaacaaggacgagacaacgagaaggggaagagagcagcgagaacagagagcaagacagcagaaacaaacgaagaaaagaaacagagagaaaagcacaggagagaaggaaaga

SEQ ID NO: 620581 - DNA, 151 bp, Homo sapiens
ggtggcggcctgggcggcgcgacggctggtgcgaaggtacacttgatgctgaagtactatgagccttcggaacttgtggagagactacaaagttttggttgtaatggcccttagttggctcatcattggggtgaccgctcaaaagcagccc

SEQ ID NO: 620582 - DNA, 451 bp, Homo sapiens
tgagagctcagtcatgaaagtcaactggtttctccccctcatttgggttcagaatttaaagtccacacacacaggcagtctttaccaattaccatcagtgaactgtttcattacctagttttaaatctggtttctcagagggaaaaaaaaaaaaaacaattcacaagagtgagggtaaggccaggcaggggggtccggcatcggtaatcccagcagttggggaggcggagagggggggatcacctaagggtctgaagtccaagaccagccgggccaacagggtgaattggccatctcggtaaaaaataaaaaattaagccaggcgtgggtgggcagggcccggaggcaggagaatcactggaacacgggaggcagaggtcgcggggagtggagatgggcgccatggcactccagccggggcaaaaagagcaaactggggtctcaaaaaaaa

SEQ ID NO: 620583 - DNA, 917 bp, Homo sapiens
tcacagacaaagaaactagcgggagactaaaatcgaaacgtcccggaaaaaattgggacacaaaaccctaaggccccaccaaaatcccaggcggattacctggagccgataccaaaattgccttgacgcggggaccaatccaagacgctagcgtcaccaaagacccaggccacccacacttgggaggttcgaaccgtgggaaaggcccgcaaaggtgaacaccaggaccaaagagccccgccaaagaacaatctaccggggcccggaccacagtaaggtggtgccaagagaagacccccctagggcagagcccccaaacgcacagaaaccctttgttgaccaacccaccaaaccttttccaactcctggaaagctggattaaacaaaagcgctcccccacaagttttatctgggaacacatcccccctccccggccgatataaccccccccttcttttaaaaggagagccccatcccagacacccacacgccacctttcttgaacttctcgttgaaccaccaccccccggcaccaccacaagagcccacctgtgaaaacctgtttattgtgatgaattctccccaccttttgtaaaaaaatgctcagccacggctgtccgattaaggagacccgccttcccgaggaaggttaataaacctgtggctcgccaatccaacgccccctaaggcgattattaacatcaccccttacaagcctctctcccccctcccctcctgaggataagagaaagaaaatgtgagatcctcaagccgtatatcatcctgttttttctctttttctccgtggtgtataaacacacccccccgtctttaaaaacaattaaatttctctttaaccctttgcccctttttttttgggttccaattaaaaaaaaagggaaaaaattaaaaaaaaa

SEQ ID NO: 620584 - DNA, 364 bp, Homo sapiens
cagcatcacccagcgagttcacttgtcctccaggttgagactgggacgctgatgcaaggtcttatgacataactcgagcggtgaatgagaaaggctgggcatatggaatcaccattcctcctgatcataagcccaaatcctgggttgccgcagagaaaatgtaccacactcatagacggcgaaggctggtccgcaaacgcaagaaagatttaacacagactgcttcaagcaccgcaaggcccatggaggactcgcaagaccaagcgggctgggcatatgctcctctaattggctggaaatttcactggaaacaacgtagttcagatacctttcgccgcaaccgctggaggcgaaaaatggctcc

SEQ ID NO: 620585 - DNA, 241 bp, Homo sapiens
gctagaggatcccagaaggctgagctcttccctagatactcagtgctcctacagtctgaatcagattattttgccaattccaggaaactcttctcgtctttaataatttcctcccttcatcaggttttttggcttttcagtatggcagtggctttctggtctggatctgtccttctctctatcttttatattttggtggggttttgttttccccgtttagatatgggtgtctgggataccg

SEQ ID NO: 620586 - DNA, 219 bp, Homo sapiens
gaaagtaattttagtgaagatggactttagtcatctcatgaattggaccagaactttaacattgttcatttagttttccaagagatattttactttgggccgatactatttgcctaaaaaacttgcattggtacagtaaccagggtacagtaaaccaaggatgggcatacattaaatttgtgagtcggttttcgagtgacagttagaattagggccatt

SEQ ID NO: 620587 - DNA, 210 bp, Homo sapiens
tataatagaaataaaaataaaacacatatataataactaggtatcatagcccttcaaaagacacatactgaaatgctatcagtcagggggcaaaagttgtttaagttcagatttatatattaatatgtcctgagttctttctgtacataaaattatgatcttatgcacagctgtaactattaattaataatattaacaaatcattattga

SEQ ID NO: 620588 - DNA, 792 bp, Homo sapiens
gtgaaatgtcaatacagtgatggcaacactgaacggaacagtaacccgtgcttggcctcgaaaagtgtcatcaaagtttaggtaatttcagtattaactgctgttaaaagtgtctgtaatggatacgttgccatagtgatatacaggacagacctaaaaatcaaaccctatcgaaagcttcgaagagacacttagggaatgggtgggattgaagtacaagcacattcggcttacaagtaaatgaccggattgttattaactgcttttgcccatataaaatgctgatatttactggaaacctagccagcttcatgactaaagtaccagattataatgccagaatataatgtgcaggcaatcgtggatgtctctgacaaaagtgtgtctcaaaaataatatacttttacattaaagaaatttaatgtttctctggagttggggctcttggtttcagagttggttaatcagtgttgattctagatgatcaacataatggaccactcctgaatgagacttaatttgtctttcaaatttactgtcttaaatcagtttattaaatctgaattttaaaacatgctgtttatgacacaatgacacatttgttgcaccaaattaggtgtttgaaaaatatctttgcatcatagaacagaattttaacatatatgtttgaagtgtaaaggtatttcccaggttggtctgatagtactcagactaggaaggtatacagtgaccaaaaagcataatgaactaatatggcatcgattaatattgttttaacgtataaataattac

SEQ ID NO: 620589 - DNA, 450 bp, Homo sapiens
gggagggcggcgtagaacggtcaatttgagccgcgtgagctcccctggacctgtggccgccgcccacataccatgctcctgtgggcgcctgacattcccagctgttgagtggccgttccttgggcaggctggccggccgtcctttgggccgtctctggagtgctggtgcagccggggtctgcgtggcccctttacagcacatcgccggccggcccaggtagggcggctctctccctcggcaagggggcccagctggagctggaggagatgctggtccccaaggaagatgttccgtcaggcccctagagaagctggtctcacgggaccgcgtatgattctggcacaagacctggatagcgggaagcgcagggactgtggctccacgcgaaatcctacccaggtgtaccgcccaggcagatatgggggaaggggggcgagacatgggggata

SEQ ID NO: 620590 - DNA, 361 bp, Homo sapiens
gctgcatatccagtctctctgctcacaccgcctgagcttctgtcaggggttcagtcaggtccaggagtaatacgtgaaggagacagagagatgcaggagccgcggggctcccggttccttgggaagagggtgcccattgtacctttggcactgtttgcgactctgcggattaccaaacagtgccctgaccaatgtaatgtagtaacatgtatgcgaccactttaattgtcatgtccacggacaggcattataattggagtcattgttgtggctcactgggagttacaaaaacgtaagtcctgccagaagatagattgatagaatgcgatccaaaaacagcaaaaaggaagaatctaggtcc

SEQ ID NO: 620591 - DNA, 191 bp, Homo sapiens
ttcccacacagcaggctcaatggccttaattccatttgccttacgctgctggtgcttgtgtggatacaagcagaagcccgttatgatagcggtgttatatccaataataattgccacatttgtataacatttttccatttctaaaccatccttaaagaatcatcatatatcttggtcacacctatcctcac

SEQ ID NO: 620592 - DNA, 423 bp, Homo sapiens
  misc_feature (104)..(104): n is a, c, g, or t
  misc_feature (172)..(173): n is a, c, g, or t
cgactctagaggacccgatgtatcccaacacacacagacatttaggatagtgctgcagatgaagttttgtatgtaggctgtttcttttactatatgtgaacatnttagtgaggaacatctagcatgcatgattgataaatatactaagagctgtgataatatcctgacttannaccttgaagtaaatttgcactttttgaagttctgatagatatctagagtggcagatacaaatattttttggctcagctggagcaattgtttttagcacctgagaggaacttgtagcttattacttcgcttccaaaatacagtaaaaagtggtagttattttgcctgttatcaaaaccactgctgatttgtctagtgtaactttatcaaggctgactggttgtatcataaaaggtgtcgggcgataacata

SEQ ID NO: 620593 - DNA, 648 bp, Homo sapiens
  misc_feature (137)..(137): n is a, c, g, or t
  misc_feature (200)..(200): n is a, c, g, or t
  misc_feature (211)..(211): n is a, c, g, or t
  misc_feature (559)..(559): n is a, c, g, or t
ccgaactgggtgagcagctcagtttattttgttttttgctgagacaagagtcccgctctatcacccaggctggggtacagtggtgcgatcacagctcattgcagcaagcctcgagctccggggctcaagcgatcctncctgcccagcctcctgagtagctggaaccacaggcgcatcccaccaagcctggccagttcttnttatttttatntttattttttgtagagaggaggtcttaaactgcagagctcaagcaatccacctgcctcggcctcctggagtgctgggattacaggcttgagccaccgcaccccataagcagcccaggttaaacagggccttccgaagcagccggtgacctctctccaggctctaagggagagcgggtgggagttgggtgaggaggctggagtgggaaaatcatggtgtgggtttctgctcctctaccaattaattaccagctgtgtgactacagggaggatatggatccccggggcccctttcttccctggtgcatggctaaatggggataatccctgcctagcaagtcagtccctcnctggggaggaggagcacgttggggtgaaaacgtccccccaccacgcctgacgcacagcccacgcgtgaccctcagacctgggtcgtcat

SEQ ID NO: 620594 - DNA, 262 bp, Homo sapiens
acagaacctctaatccttgtaattactgttagtcaagggacagctctttgacactaggaaaaccttgtagagagagtaaaaatttaacacccatagtaggcctaaaagcagccaccaattaagaaagcgttcaagctcaacacccactacctaaaaaatcccaaacatataactgactcctacacctattggaccaattctatcacctatggagactaatgttagtataagtaacatgaaacattctcctccgataagcctg

SEQ ID NO: 620595 - DNA, 189 bp, Homo sapiens
tggaatacagttggatgcttaaacatacaccaaaacatccatatgggctgggcgcagtggcttatgagtataatctcagcactgtgagagggcaaggcaggtggatcacctgaagtcaggagttcgagaccagccgagccaatatggcaaaaccctgtgtctactaaaaaatacaaaaattagccaggc

SEQ ID NO: 620596 - DNA, 485 bp, Homo sapiens
agaggatccccaacctacagtgccttataaaacaaacaaactcataaaggggccaggattcagtccatttcacagttcatacccagttgaaaggggaacacagcacataaaatacagaatgggcaaaagatagagcctacctgctaaactagggcatggaagggacggatatttaaggtgattttcaccatattctggcccttgaaagtcattagaatgtgactgcaaggtcaccaggatataaacctgcacggagtcagctcaggttgtgccaaaaaaaaaaaaaaaaaaacaaaacacaaacaaaaaaaaaacaaaaaacccaaaaacttcttttaaattgtcttggggggtgggcattcctcgggaattaagcttttggtgggagttgccttaggggttgcgccggggaagcgcggggggggggcggttcctcccacttgttccactggctcgagggctcttcagggcggctgtgtttttac

SEQ ID NO: 620597 - DNA, 1357 bp, Homo sapiens
ggtccttgcagttggtgcgcctcaggccagtgctgaactgctgggacctgggccaggtgtactcgcctcgatccccaaccgacctctctggggcctaggcatagaagtgattacatggagacagtgatgtcgaggagggttcgggttgtgtcgttatgaacatgctgaatgactactcacgagctgctcatcgatgcccccttttgactaggtggccccgatacggagactgggcatcgtgggcaattctttcgtcagcttggcggacttcatcattcacaggtgcttctgccgtaggtacccgggagccataccatcatacgcagagatgaagagtctgacctagatcgctccaatctgcgggatgtagtccaggtgcacccgtgtgatctccgccattgggggaagccaattgtcgatctattcagtgttgcgcaggaggcccagagttagaggggtttccaatacattctcgggcctcgagaaagacgcgggaaaacgtacgactccgagattccaagagtagattaacgtggagaacgattgtgtcgtccaacgcgtaaggtggccaattcctgatgtcaggaagagcgctaagaattccccgcctattgtggagcatcaaggtggactgcttgcacacagggacggattggccagtcgggcgttgaatcggcatgggactccatagtttaataacaggcccccgtttagaatgggttccatgaggacgaagagagagtgaactttacccattgggaaagcctggagcgtgctggtttcaatagacggaaaaaacccatcctgtggcgagaggaggacagcccggggggaaccattcacgctcgcggggggaaataggacgaaaggaaaggacctacggggggaagtacacgtttcatagccatatgtggaaaaccgcgccaagcgggccatgatatggcgacaccggtttcaggcggacccagcaaaccaaagtgttcaaatcatacatttgggcatggccgtttgtcgcacccctttggcattatcgctaccaaacaggcgactcgttttgaaactacggctctgtggacaggcaggttcttggggaaatagtgatccctcaaacatcacgagggagagggatacctccaaaagagggaggggtcatatccctggcatatatcaagggtataagtccccgtcaccttaccagttgaaggtaccctccatttagcatagggaccgttcacacaaatttcgtcgcaagacgaaatactccagccgcactgagacggcaactagggaagacacccgcccagaagcaaatgtgcacagtggaccggaggtagatcggaagaacaaacacacacag

SEQ ID NO: 620598 - DNA, 432 bp, Homo sapiens
  misc_feature (10)..(10): n is a, c, g, or t
gcccaggagntaaacccttttaggggggccggccaggaaagggttccccaaattaaggtttatgtaccctctgtgggggggattgccccggaaaatcaatttgggtttttggcagggggccccctggagaaaaaggcccttttgggccagtggggggggggggcccttactcccctggaagaagcaggccgcatgtttgggggtaaagtccatggttccctggcccgggttggaaaagtaaaaggtcaaattccttagggggcccccccggaaaaaaaaaaaaaaaaaccaggttgggttaaccggcggatcaagtccacccggggtttttttaacgttgggcccccctttggcaaaaaaaagggcccccaaccccacttttaagttttttggaatttgggctttttttaaaaaaaaaccccctttgtttca

SEQ ID NO: 620599 - DNA, 432 bp, Homo sapiens
  misc_feature (432)..(432): n is a, c, g, or t
tagagagaaccccggcggcatggtgtctgtatcccaggcccgcgccttggggaggtcagcaaaggaccgtctctcctgtctgagaccatgcccaaagcagatttttgcttgccccaattttctactttagtcatggggcatttgaggcctaaaatgccaccatctcatttaacccactccaggattcgtggaagacattcgtggagcaggagggtggtgtagcgcggaaaaggttttctcccgtgagtttagcttattagttatgtcctgatgctttgtgaaaggtgtggttgtgaaacagctctaacaaagtaacgaaaaccaagtgtgtgtgagggactgagttggattaacctgagagctggctgcctgcttccagtcactcttcctctcacactgacaccccacatggccaccctcttgtacacacan

SEQ ID NO: 620600 - DNA, 427 bp, Homo sapiens
tgacgacaagacggcgtggttatttatgtcacacgggtgtcttacaggcggcctgctgacctcgctgggctgccgatgggagaccagatcatgccggtgaccggcgtgggacatgcccatggtcacacacgaacaggcccgcaagcggctcaccaagcgctcggagcgaggtggtgcgtctgctggtgacgcggcagtcgctgcagaatggcgtgcagcagtccatgctgtcctagcagccaccaccatctgcgactcctgactgccgcctctctgatacagaaacgccacttccacactctgtccccatctggcttctgctgaccgctgggccccagctcagaagggctatagctggtcccagaggcctggactggacttccttcccttctcccatccctggcctggggcctctgggaccagctta

SEQ ID NO: 620601 - DNA, 157 bp, Homo sapiens
aagggtaaatgaacacgcgatggtttgtcagaagcggcaggttctctgcacttcggccacctgtgcctgcatctgtgcaataagcgcattggcgcaggtcctgtactgtcgaagatcttgcccatggttgcgcaggtccttctccgtgtggcgtggt

SEQ ID NO: 620602 - DNA, 104 bp, Homo sapiens
ttagaggatcccccgtggctaggttcgctggcacagtccttccgctggcacagtccttccgctggcacagtccttccgctggcacagttctctccgtgcctagg

SEQ ID NO: 620603 - DNA, 1329 bp, Homo sapiens
  misc_feature (1329)..(1329): n is a, c, g, or t
aacactacattagcaaaggtgaagatctggatatgctcgtataatgatcggaaaatgtacatgttaacgactgactcatgaccgactgtgtgtgtgctcctggagtgtggaagggaggaaggcctaacttctggtgctgaaatcgcgatagcaaccgctagcgggagagttgagacactgacagctatggaaggtctgtccctcgctgcgtagtcgtaggcatatgtacatcgtccagttagacacatggatgtctactgggaatgatcacctggatggatttagctacaagtttcgcagctgccacaaacttacccccctaggcaactggtgctgcactgagtaacttatctgaatatgccacgaggttcatcatgcactcgtctgcatttgtatgacatgagttatcccaatctaattaggatacacatgagcatgtgtctacatatctttacttttattagattatactcgtgtgcaccatggggatcgtgccattctggttacccatgcatgcgcgttacgatgataggggctagtggtatggcataactttgcattgactcctagagtgggccacgctaaagtggatattgctcgcttgtggtgtgtgtgaggcttgttttgggggctcggtcgaaaggaatgttcgctcttcgcttatggacgataaaggcgatatctcactagaatgtatgtccacaaggaattctgtagattatgcattctgaatatccgaatggggttgatggcaaagttaaataatggatttataaattgtgaagtagatctttgtattttggataagtacgttgccgggaatatttctcacacgcaatttgctcgtttggcttgttcggaagggtgtggtggtgggcatttgcaccgaaaacatttaaagcctacttatgggatgctcttggtcaacaattgcgtggatatccataagattccaacacagagtaggtttgggcgattgactggaaggcccattagaacacacggtacaaccctccgcccgtacagtggggagggcaaaaatcgcgcatattagggagaagatcgtgggcaagaaagcgcgtataaaccttggaaagatgagagttgggttacagcaaataaataggtgggggacactggcaagatgtggaaatgagaacttaaaatgcgaaaataattcggaccggtaattgtaggtatatggaaattcgccgcgattgagatgatgagcgttaacacaatccgtggtgaaaaaacatttgtgggatataaagggggggttgaacattgacaaccacttaagatatgagccgaagagttgtggaatan

SEQ ID NO: 620604 - DNA, 99 bp, Homo sapiens
agcgggggtgacggctgcggccccgctccctctacccggccggacccggctctgcccccgcgcccaagcctcacaagatggagcgaacacccgaagcca

SEQ ID NO: 620605 - DNA, 371 bp, Homo sapiens
agcctttgctatcacggccatacagggtgtgggccggagatatgctcatatggtgttgaggaaagcagacatttacctcatcacatgagggtcggatgaactcactgaggatagaggtgcagcgtgtgatcaccattatgcagaatgcatgcaagtacaagatcccagactgcttcttgaccggacggaaggactgtccagtatggaagatacagtcctggtcctagcctcaatgctcaggtacaacatgtctccgtgaagacctccagcgagtgaagaatattcggggccgttgagtgctgcgttactgctggggccttcgagtccaagggcagcactccaagaccactggccgccgtggtagaaacagt

SEQ ID NO: 620606 - DNA, 859 bp, Homo sapiens
aagacacacaacccacatcgggggtggggggtggggggtgtgtgggtgtgtgtgtgtgtgtgtgtgtgtgtgtgtgtgtgtgtgtgtatacagtgtttgacatgtgcccaggttgctcatgaagtgatctcaggcaatctgctagctcggtatcccaaagtgctgggattacaggtataagacacatgctcggtgggcggtgggtgttgggttattaaagcagagagggtaatgagtatgctctcactctccgtgaagggcagtttcgttgctagcgcgtgtcatcagctctacccaggtgttcctctcacttctcctgtgtaatcattattagcaatatgttgcaattctagtgttataatatgtgtcgtcatcccagaccaaatgcagtgagtgccctggagggcaaccccctatggtgggctagcgggtgagtaggtctcaccaaataatatattaatgtgatgtgggtgtagtgtagtgtatgagatcaggtgtcaaaaaacaacaaaagatggatatagtgatgtgtgcaacaatcaattagaatatatatgtgtagaggggggaggggagaagtaagaaattacaggcaaaagaaagtgtataattaattagttgtcgtcatacagtgtgtggaaaagcatagtcacaatgttgggaagtgaataagtagataactcttaggtgtgagcgagatgatctatataagagttgtatactagagaggggaaagtgggcagtgtggaggtggacacacggggtgaaaatccgagcgctggggaggacaaggggaaccagatcgctggggccgggatttaaagacacgtctggacaatatggtgaaatcccgttatat

SEQ ID NO: 620607 - DNA, 141 bp, Homo sapiens
tcgctattcatcggcaccagggttgttgtcaaagaaaagcttggattacattaacatttgtactcagccttttaggcaatacaccagagggtgccgatgaagcgaggtgccgatgaatagcgaggtgccgatgaatagcga

SEQ ID NO: 620608 - DNA, 1312 bp, Homo sapiens
gctgttcgtcagattcacagatctgatgttttggttacactatatttacaaggaggaaaacccggtaccactgatgtcggggcttgagggatagtgagcgagcaagtgggcgcgataggatggtatgaacatgagcggtgttctctgctcggtgctgcaatgagaggttctatcgttccgtcaatgtggtgggtgaactgagccccattgtgttgtggtaaatacttgtatagggcacgtatagggctgtgacctagtatgtctgatgtcctgctaagtacgcgagaggtcgattattaagaatgcgaggacgagacggtcggtctaagctgaggctcacagaagaagagttctcccccacgtgccagtaaaactaactttgggtggagtcagacagtgcagacgagtgggttgacgacgggtgttcgcctcactaactgttcgatacgagaccacgccttattccactttggcggaatggcttcaacgttttcgccaaaggttcacttgtggaaaagaaaatagggggcacttttaacgtggcaatgggccagcaacaatgcgcgtgagcgtgccctgtttcccgcgtaagaaattggaaaggctttttgcccatacgggaacacccgtgtgatatacgcattgcccttggacgggtccctgtccaaggagagtacctggcgagtaggtgaacacctatcactgccacgcggagagatgcatggggggacgtgcacagggcctggcatacgaccttttcaattttgccacgcggctatttgggacaatcgacagggacacgtccgcgacattggttgtgtgtcccggaaccgtgtaagttggaccgaaacccggttcgcgagtttcgcccatatgaagattattgtatacccatagtaacacggaacttagaaagcgcgagcacctttttcacattggaatcccttcgactgctaagggcgttcggagttccccgggagattgaatctcgcgagacggtcccagcgggggacaagtcaacgcgtcgccattcgaaaggcggtccacactaaagggacagaacatacagtggcttagcagaaaccgtagcacataggtgggacgtcctccgtcgcaaacaagcccagtttggtgaaccaatcgcttccgaggcatttggagggcctttggccaaggaacatagaatagggcgaaccgagggggagaggagtctatgacatggaggcggcaccaacacggcgaacagaatccccccgaaagatatagccccccaaggagcgacccagaacacccaattgggatcccacatccg

SEQ ID NO: 620609 - DNA, 127 bp, Homo sapiens
gacagcacagagtaggtggacacacaggtaggtaagatcttagggaagccccttactcagcctaggctgctgcccacaggtcaaggaggaaagcccaggaggggagacaagacctcctctgtgctgt

SEQ ID NO: 620610 - DNA, 179 bp, Homo sapiens
actctagatggtccccccgaatagtagggcatgccatttaagggaagcacaggaacaactcctattgaggtttatatgtgagtagaggcgcgtagatgcctagaacaagtgtctgggagggaatgaaaccagatgggccacaaataatcacctcttggaaaaaggaaaagaatggggac

SEQ ID NO: 620611 - DNA, 782 bp, Homo sapiens
  misc_feature (28)..(28): n is a, c, g, or t
  misc_feature (169)..(169): n is a, c, g, or t
  misc_feature (209)..(209): n is a, c, g, or t
  misc_feature (263)..(263): n is a, c, g, or t
  misc_feature (266)..(266): n is a, c, g, or t
  misc_feature (286)..(286): n is a, c, g, or t
  misc_feature (294)..(294): n is a, c, g, or t
  misc_feature (299)..(299): n is a, c, g, or t
  misc_feature (355)..(355): n is a, c, g, or t
  misc_feature (397)..(398): n is a, c, g, or t
  misc_feature (406)..(406): n is a, c, g, or t
  misc_feature (408)..(408): n is a, c, g, or t
  misc_feature (481)..(481): n is a, c, g, or t
  misc_feature (494)..(494): n is a, c, g, or t
  misc_feature (678)..(678): n is a, c, g, or t
  misc_feature (692)..(692): n is a, c, g, or t
  misc_feature (704)..(704): n is a, c, g, or t
  misc_feature (771)..(771): n is a, c, g, or t
ggggggacaaggtaggggagagggaaanacagttttgggtataactatttggggggggggtggacatgaagagggcaaaccctagcttttcattatctacaatcaatagtttgtttttcttttttaaaaaagaaagaaaaaccctttcaatcttcaatactctttaaangcccacttagctactggccaatccacaccaattattttanttcccttggtacacacctttgtccactgggtaaattatattcattatgcccacngcngcggcgcgcgtaagccaacncccctgcntggcngggcagggcctaatctggggctggggggggaggggcttgcgaacccaggtcggggngtttctccgctaatactgtctaccaagctgatccctacaaanntgcatatnanagcgggcaagtttagctactgtgttgcaagagaaaccaggaccttgttaaatagttctctccattaccatttnttctctcaagggnagcttaaaaaaaaacaacaacaaaacaacacattggtctggccacctcatgaatccaacaagcattagtgtggcatttcagtggagaaggaaacttggggggaaaaatccatcaaggttgtaagaaaggctcccaatttaactgtccctgtccctatttatccatcatccaagaccatccattnttctagagcactcntgatcaataaanagggggccaagcatcaggagcaggcaaggagaaccaaaagacatcaagaaaccgattttcttgaganaagcagcgatt

SEQ ID NO: 620612 - DNA, 368 bp, Homo sapiens
aacagaccttaagactgacaaagcagactctttgtagcagtaagataccaacatgacagcaggctctgaacgaagtcaggccaggtgtggtggctcatgtctgtaaccctagcactttgggaagctgaggtgattggattgcctctgctcaggagtttgagaccagcctcggcaacatggtgaaaccctgtctctattaaaaaatacaaaaataagccaggcgtggtggtgcacgcctgtaatcccagctactcaggaggctgaggcaagaaaatagcttgaacccaggaggcggaggttgcagtgagccgagatggcaccactacactccagcctgggtggcagcataagactccaaaaacaaatat

SEQ ID NO: 620613 - DNA, 118 bp, Homo sapiens
cgtggagaactctgttcttcataatagtaaaaccttgagcccgctaagagagtcaattagataaacacacgtacacacacacacacacacacacacaaaacctactaccaccacttgg

SEQ ID NO: 620614 - DNA, 526 bp, Homo sapiens
ggggaaacaaacaaaaataaatggacaaaaaagggggaaagaaaaaaagcccaaaaaatgaccaatgggtgatcaaaaaaccacatggggttaaaaaaaaaaggctcgaaaacatcaatggggggaagaatgcactccaagttccacaaaatacatcaaagaagaaacccaatcccgttcaaaacatcacgacaaaagggacaaaataccccataaaaatttaaaaaaaaaaacctgcccaccacctaaaacatagaggcttaaacacacacaaaaaaaaccccaaacaaaaaaaagaaccaccctaaaaaacttaaaaaaaaagctttccaaaaaaagataatttaccgttatcaaacaaaaaatccctaaaaacctccaaaaggaagaaataaaaaaataccacccaaaaacttaaattaataaaaagagggaaagacccccaaccaaaaacacttaacatagaggacagacccacccgacaaaagggccaaataacaggctcaaaacaaaacgacatctcaca

SEQ ID NO: 620615 - DNA, 372 bp, Homo sapiens
  misc_feature (219)..(219): n is a, c, g, or t
tggtggttatggatcacatgtgtggccagctcatgctttttcttgagcagggcctgtccatgacctgtgctcatcacatgctttataagttctctttgcacagggcctcagctgctgcctcagcctagtttcagagagtgtgtagaagtcctggaatcttaaccagtttgccacctccaatggttgacctgcacagcttcatccaggggaatgttcgcnccacctgtccttggcaaagaattcactttcaacctcgctcagaatttacaacttctatgtgtccttcagctgcagcacacatgcagatctgtgcgcgagtcatagtctctgtgttccatatccatggctcacaaggcacaccttcaaagagct

SEQ ID NO: 620616 - DNA, 1600 bp, Homo sapiens
  misc_feature (767)..(767): n is a, c, g, or t
tggatacttgcctaacatgcttgtgctgtaaaaatagttaacagggaaaataccttgagaattgagtggctatagctttgtgttaaagtgtctttagtgaaattttacatgtgaaacaactccaaggcaataattgtgttaagaaacacgtgtgttatttaaattctcagtgttaaggtggaattaaagagttttatgaatgtggaccttttcaagctatactttctcctcttacgagcttttctcagtgtataaattatagtctcttggggtcccgtgaaacttctcttcataagaggaaattgtgctaccattttttggacaacttatattctccttatattctcccttcttgtggccagcataatgtgggccctctttacacaagtcttatacaacacacaacaattatactcatataaccacacacacatatacatacccataattatatacacataccgtggttctcccatgtgtctccccatgtgaattccccctctcgatctttccttccccacagccgctggaaaaaaaacaaacgtgaaagttttcctctatattatctgttcgcgtgggcggacaaagaggcgcggggcgacactgtgcactttgagatacacaacacacagttgttcagcgcgcgtgtctcccccaatctctcacacaacacttctggggcccattagctggcccaatttttctctaaaaccctctaaagcgaaagggccacaacaaagtgttacatcgtgggtggcccccccaanctcaatgtgcaccatttgcggggggctatacgcatcttttacacgccgtgtgctaaacacctttctgggggtggcctctcccccaaaaatttccacccttttctgtggcgggtactattctaaaagcggcaaaacttttgtcctgtgggaaataaccctctctataatataaggccccgtggtcgctctaccaagattttgattgagaaagccccgttgtagaattcacccatgagacactaaaattcgtagcctccacggcggcttgccaccacaaagaaatatcaacccttttccgctgggatacaagcccccctctctctggttgttttggttgtccccacacacccaaagttgtctttacactgtggggggcggcccaatggtccatcgtcttggcgagcaaccaaaagcgcgcgcagcgagcagaaaccatctatctgggcgtccccccaccccacagagcgtgtgctgctcaaccggggcaccccccgtggtgactccccaatggtgtgtgagccggcccccacaacgagagaatatgttccgccccacatcagcagttattaatcgggcgggccacaaactcctctcctcctatgtgaagtagaccaaggaaggtagtcaataccccccataaaacacaccgctatctgcaacgaggggtccgtactggcgagcgagaaaaaagacgcacgcctggcccgccctagccaacacacaaacggggcggagcacaaccccaccagcactcaagtctagtcagtgcggaccagcacacagcccgcagagatctctgcgtctagctccagcagcgcggcgtattctccaca

SEQ ID NO: 620617 - DNA, 466 bp, Homo sapiens
aaccctggcgtgtttatgctctcaggattgtctcggctactatggtgtctattatgtgttccatatgaaatttaaaggagttttttctaattctgtgaagaaagtcaatggtagcttgatggggatagcattgaatctgtaaattactttgggcagtataaccgttttcatgatattgattcttcctatccatgagcatggaatgtttttccatttgtttgtgtcttttatttccttgagcagtggtttgtagttctccttgaagaggtccttcacatctcttgtcagttgtattcctaggtattttattctctttgtagcatttgtgaatgggagttcactcatgatttggatattattggtatataagaatgcttgtgattttcgcacattgattttgtatcctgagactttgctgaagttgtttatcagcttaaggagattttgggctgaggtgatggggttt

SEQ ID NO: 620618 - DNA, 411 bp, Homo sapiens
  misc_feature (104)..(104): n is a, c, g, or t
cgttgagcaccgaatgtgcactatcatatcacacgctgcgcgaatgcctggatgactttttggcgcttgaggccaagtcgaggagtgcttccgcttctgtctgnctgcctatcggcacaactctgccagtctccaaggacaacgcaggccacaatcgttctatccgtttcagtggccgtcaggatggatcaaacggaaagtggactgggcggcagtactacggcccattcatcgacaccgcgcatcggtttggcatggtggaactatttcgtcgctggctgggagtgagcgacgacgaaattcgcattcaaactgtgagtcgctacctcaacctcgtgagtcgatctggactgtgctatctgctgaatttcagcctcatgcgagtcgaagaggctgggacctgcgtagacg

SEQ ID NO: 620619 - DNA, 320 bp, Homo sapiens
  misc_feature (17)..(17): n is a, c, g, or t
  misc_feature (174)..(174): n is a, c, g, or t
  misc_feature (233)..(233): n is a, c, g, or t
ccgcaatcagctcggtnccgcatgtgctgtaggccagcgtggacgcaccatgcgcctttttgttttgcggccccggggaagggaaccggtgaggcagaaccggtgaggcaaaaccggtgaggcaaaaccggtcaagcggaaccgggcgctagggttcgcgcggatttcctcgangcgtaagacctttactatttcgtaattcgctgcatcgcggcaacccccgaggagatcanggacctctcgattgcggccatcctggcacaggacggcatcacctccggcgcgatctacgcgctgttggcgctggcctacagcacatg

SEQ ID NO: 620620 - DNA, 325 bp, Homo sapiens
  misc_feature (17)..(17): n is a, c, g, or t
  misc_feature (174)..(174): n is a, c, g, or t
  misc_feature (233)..(233): n is a, c, g, or t
ccgcaatcagctcggtnccgcatgtgctgtaggccagcgtggacgcaccatgcgcctttttgttttgcggccccggggaagggaaccggtgaggcagaaccggtgaggcaaaaccggtgaggcaaaaccggtcaagcggaaccgggcgctagggttcgcgcggatttcctcgangcgtaagacctttactatttcgtaattcgctgcatcgcggcaacccccgaggagatcanggacctctttacgataacaatttacacaggacggaatacgtccagcagcatgacgctgtcggagctcgcaacagcaatgccggacacagcga

SEQ ID NO: 620621 - DNA, 145 bp, Homo sapiens
ttaaggatctcggaggtgagtcgcattgcgaggtgaggagcgtgggagctgcgctcaggatactcgtgccaagcaggaggagctggaagcctgccctgagcgggccaagcaggatattgcacgggagctgcgttgagtaccagga

SEQ ID NO: 620622 - DNA, 610 bp, Homo sapiens
  misc_feature (172)..(172): n is a, c, g, or t
gtttgcgacggccagagaaaaggtggggacgttcacgcgcggtacacggtttcttccccgaggctcattgctaaaaccggattggatgcccgcattttcttgagcttttgcaccctctacggaaatttgggttgaactacactgtagtcaacagtggcattacctggcccanccccgctgggatagatttttactggttaatagaaaaaaattgggataatagtacatatatgatgtggcctatggggactcctcctatgtgaagagattttggttcaaggacgcacacagacgactctagctgctgaaggacgacaaagaggtagtaacaggcccaggagtatttcaaaaatggggggaacagccttgtgggaggggctccaaagcgggtagcaacataagtcccggaaatccgttccagaggaaatcccgaattagggcccccctagaacgggttctggacaaagaacgcctagcgcctggaatcattgtttgaaatctgcgatacaacagggacagctttttatctgtcatgtaagataacaatatgtaatctgtaaatcatcaggcccaaggtaggggggagcaatatgccccgccaatcatgacg

SEQ ID NO: 620623 - DNA, 441 bp, Homo sapiens
agtcagttccacaggacagaccctctaccaggcctggggcttgggagtgagtcttctttctggtcatggggctctggtccatctgagactgcatgtaacattgtacttgtggcaccacgcctccacagtggtgcctctgcctgccagggccaagccagcccagatgccagcagagtcggacaggatcattttcccaacgttactgcttcttcactgtaccctctggaaaggtttgctcaggagatgtgtggagggaggttcaacaagacctgccccgagcaactgggaaaggcacaggtgtgccacagtgcagcagggacctcttgtccttcatcacactcgctgtttctaatatgactttccagaaagtgtggttatgttctgtcttatagaaagtgaaatataaataaatttcataatttatccaaccagtaaaaaaaa

SEQ ID NO: 620624 - DNA, 134 bp, Homo sapiens
tgggtgagaatggctgtgtgctacgaaggctatgtggcgggatggagagtatgcaatgagcgattttaggtctgtatgtcgaagcccccatcgctgggtcaatagtacttgctattgaaacttctaaaactagg

SEQ ID NO: 620625 - DNA, 182 bp, Homo sapiens
  misc_feature (37)..(37): n is a, c, g, or t
  misc_feature (39)..(39): n is a, c, g, or t
  misc_feature (130)..(130): n is a, c, g, or t
aaggaagactggtttgccatccgagatcattaaaaangnctgaccctaacaatacgtacaaaaatataaaacgcaaataaaaaatacaaacagattccttcttaaagtacttttaagaaaaaaagcaggnccttggaagtttcgattcttttttcctcccgtcgcaaattctatgtttggat

SEQ ID NO: 620626 - DNA, 209 bp, Homo sapiens
ttctttatcctctgattctagcactttcaaggtgagctgtgcgtactgtatcatactgtagctattagggaagagaagaaggtgcttaagaaagaacatcaccatggattttaaatacaagtagcagggtatggccttggattcaactgttttaagtcttcttcttctcattatggttaatattattattaatttggctggttccgctg

SEQ ID NO: 620627 - DNA, 134 bp, Homo sapiens
ggtcggctatctgtctgaaaaaaaagaaaaattagcaggcgtggttggacatgactggtagtcccagctacctggacatgggaagtgtctactcgtggaggcttggcgtggttctaactccctagagcatacct

SEQ ID NO: 620628 - DNA, 864 bp, Homo sapiens
gactgttccgacgaaaaatggcggggttctccatgagttggtggtccttgtagccctccatgcgtgtacaaggtagctcgcggtctggcaacatcagaagtcccaggccttggtctccgccactccccgagaagactttcgggtgcgctgcaacctacgaaatgcgtggcgtgttgatgcgaataaatttgctatcaagatgttgtgacggtcacgcttacgttgccaaatagctcggggagcgctctgccggagtgagactttctgaggagcgcgcctctgcgagactgcgcagtggagctcttgagaatcacgctgtgcagagaggatactactcagacacttatagttggtgcaaggcactgggcagagaacgcgttcagaactaagtacgtttttaatgtgagttcgtgaacatcagaatgtagccttgacatgattcaggttgtgactgacttactcagtaggtaggaactattggccacacaaactgtaagcaggttagctccccaaggaatacgaatctctggagatcgggtcaatctaacacagtcattaagaagggcaaatactaaagacacattcctgagagcaggtgccaacccctggttgatagcatccaactggaaccctaaagacatatgggaccctgcaagtccaggtttctccaaaccgtggaaaattgccttttatctaacttttgtgcccccaatttctaacatggatgctatggccttgtgagcagtttgatccgatgataatgcggtttggatatttaccttgcggagccccctccgattatggcaaagaaatttggaaatatgcccggaggggggaaaacagagaaggcaaaggggagatccg

SEQ ID NO: 620629 - DNA, 185 bp, Homo sapiens
gcttggcctgaccagacttttaaggctaagctcaaattttatttttcctaaagccctggcctggtggacttccccccccaaaccaaagaggggaacagagagctccaccccttccaattttggggtggatgcctccatttcccatgtaccccaaagccaaccccatggcctccatgactttttca

SEQ ID NO: 620630 - DNA, 322 bp, Homo sapiens
gattctttgctccagctactcaggaggctgaggcaggagaatcgcttggacccgggaggtggagattgcagtgagctgagatggcaccactgcactccagcctggtgacagagcaagacaacgtctcaaaaaaaaaaaaaaaaagtgtgcccttttttacatgtaatagcctttcaaattctagaagatgctctcttctccaaagccttactcaagctaattactcacatggtggctaccaaaccctctcccctggttacccttgtaattgccttcttaaggtgaagttcttgaaaccggacacaatattgatggaacaaat

SEQ ID NO: 620631 - DNA, 228 bp, Homo sapiens
  misc_feature (188)..(188): n is a, c, g, or t
gggtgaaaggggttctaccttaggcaagagggccaaggaatgaaattttccccaaagagaagaatccaagaggaaccctgaatatcaaggagagaccagattttggtgaagaagattccactcagagagaacactgcatgcaagggcactctagaagagagaagaggttggcacattcacagagcttnagggaggtcccggaggaactcagccagaagaggggcttgg

SEQ ID NO: 620632 - DNA, 502 bp, Homo sapiens
  misc_feature (66)..(66): n is a, c, g, or t
  misc_feature (78)..(78): n is a, c, g, or t
  misc_feature (96)..(96): n is a, c, g, or t
  misc_feature (162)..(162): n is a, c, g, or t
  misc_feature (185)..(185): n is a, c, g, or t
  misc_feature (206)..(206): n is a, c, g, or t
  misc_feature (335)..(335): n is a, c, g, or t
  misc_feature (339)..(339): n is a, c, g, or t
  misc_feature (468)..(468): n is a, c, g, or t
caggagttagaataaatcccggggcctgggcttctctattcttggccctccgtagtctccctccgngagagcacaganggagaggaggatctcagnaggcctctagccgcttccagatgcagtctggggagtgggctgaaggtgaagggaggaaggctgttnggccactctcatattctgagagncgtgcttcagctcaggccctnatacactctttgccctgtggcctctcccttttccccccttctggttggaggagggagaagtgggaagtagcttgggaactagttttgtccacataaacttccccattgttccttggcccgccctcaggnaagnagccccctgcccaagtctgggtaagagatgggcttggtccagcagggaccctgaaggaaacaaacccttttccttctgggggagagagtgcccccccctaccatgtagttgaacaggggctaggagctncccacttcccttccctctaaacagcaggctgtgt

SEQ ID NO: 620633 - DNA, 549 bp, Homo sapiens
ccctctttgtccttggtcctgctactagaccatctgcttagggatctggaggagtcataactacttgtgtctcaggtggcaaggcccaccaacatcagtttcatagcagaccctgcaacagctctaagtctcagccccagccctcctctgagagcaatcctgcccgcaaagagacccaggggtgatatgctacccatgccccaggaagcaggcctgcagatttcacttttgcctgtggaccctgaagcagcccaatgacttggttccagcccctcttactaccgttagggccagtctgcctgcccaaggactcacccagtgacctagcaggaagcttaccaggaaacaggaggaagccacaccagtctgtgcatctggtaataggcgcattgtctgcagacctccatcccaacaccagccctactgaccaaggtcctaggggcagtccagtccacccatggaccagacaggatccacacccattagagcccatggtaacaagcttgccaactgtgaactccactgtgacccagctccaaagctgttagg

SEQ ID NO: 620634 - DNA, 441 bp, Homo sapiens
tacctgcaattgggggaccggatctatttttaaagtctgtttactgtacagaatcttctatattggaatcctaaatcctacagcactgttatgtaaataatggttcgcttttctcatgtcatttgacgaactgaaccataatctgcggttgaagatgtcggaaattacagcttgtttgtaattttccacaaactatgtgtgcaattaattatgtaataatctggactgcaattctaggttaatgtcatgaaattattaggatatcttttttttttttttttggttcccctatgtttaaaatataaacgtcagataccactacagcatctgcaagccttttatgctcatttattttcaagttttgcattttaaaaagaattgctttattgaacattttactttgtgaactgttgtttacattcctattaaatatttgtaata

SEQ ID NO: 620635 - DNA, 500 bp, Homo sapiens
gttacactgtgggaacttgcgtataaccgggatacggccaatcacggaaagctggtatatagaggtggaaactcattgttaaccaggtgcctaggctgcacgtggtgagccccatagcatgcctccctcctccagaacgcccaggaacatcacttctgtatgcgtgagctgatgtgacacattttgaatacgctcaaacaagtctacgtgtagatcaagcatatgagtgaaattttgacttagatatgcaattttaataagaaatttaagtacaagatcatttgcaaatacattatagcagccattaaaaatgatggttatgaagattatagcagcatgggagaggaggatgatgtaatattaacctgaataaaaggacaacaaatgccatctatatagtttcatggcctcagtggaaaatctgggtggggaggacacacaggaaaacgacggtaagaacacagcagccgggcagggctccctgctaaccactccgcaga

SEQ ID NO: 620636 - DNA, 922 bp, Homo sapiens
  misc_feature (343)..(343): n is a, c, g, or t
tgcggtaacgtgagacgtacaaacgaaaaaaattggggggcccaccctttgtgggccaaccgccgctttgtatataaaggggggatattgtgtccaacatcaaaatgttttctcacaacagacttaccatttgacacaaattgtgtaggcacgcgtaagattatcaaccggcagccctttaccgatttacgaaaagggcggtccaataatgttactataagttaataaccattcccaggaacggggcggcattatttgtaaaataggccaacaaacttggatgagatgttaaaggagaatatttgtgttacaaagacaagcggagggtgttttttggaagtgntcttacagaataagaacatgtggtccccttttcgacccttgcttgcgagggacatagcaaagggcaaaaagtgtttttcttcaagagaagccccacttgtaattgacggtcggttgtctcctctgtgacgtgttttaaaagatagtcgtaaaggcacctattactgtctagggtggaagtgtctagaagaatgctcccattagaagcagtagatggaagtcgtgtttatcaattcagacaacattggcaaattagtagcacaaacacaacaggactgatctgtagaagtatagagctagagtagacatgtcttgcttatttctgccacatcgtcgactgttagtgaattttcgttaatgtgatgcttttttaggtgcaccatgtttctcatgactcctttctacgtgttatctaagtgtcttcctctttcaatagtgtgaccgcagagaccagtagcatcagcatcacctgagacctgtgaacactgaagctccagcctcagacatgttggggaccattttaataagataccttagctgattttttgcacagcaaacttgaataatgcttgaggtagta

SEQ ID NO: 620637 - DNA, 442 bp, Homo sapiens
ggaatagaaggctgtcgtgtatcacatcagatgtacaatcattacttctgtttactcttttacattttcatcctttgcggtagtgccgaaagttcaacttccaaatatggtgtaggttttgctagattcccatatttttttcttggcatttttgctaattatttttagcaaaaaattcttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttctatcacgtataggtattattgagcacggagtagaattccagggctgccttg

SEQ ID NO: 620638 - DNA, 107 bp, Homo sapiens
gcggatcttactactcaggaggctaggtaaggggatcatcaaagcaggggagattgagtgatgcagtgagccatgattgtaccactgccctccagccttgggcgaca

SEQ ID NO: 620639 - DNA, 1277 bp, Homo sapiens
  misc_feature (1217)..(1217): n is a, c, g, or t
gagcgggaagggtacgagtgacagatagggtaagctgctgtgtgggctaacaggatctcctcttgctgtctgcagccccaggacgctgattccagcagaggccttaccgtgtcatggcccgaagtattcactattggttgaaatatctgccttcaatacctctaaccggcgttgccaaaatggaggaggcgcggccagacggtgggaggcaacctcctagagcctatcggtcgactaacgtcagatagcttgaccgtggcaagtgagctaccgagttagtctactcatggaaaaaagacgggttcctcgtgtgaagatggtgagtgctgtgacatctcttaagcgctttttcatatgcgagtcgtgtggaacgtgatttatgagtttggttgagagcactgccatttggaccagagtacgtgtcattgcccaattgacgcagccactgtatacacctgatggtagacacgactgctagcttctatttggatgtactcgacagagaagtccgtgcaacatttcgcactatcggtagagaaggtgacgaaggtcctaaaccatattcgctggcgctggtggaccctgacgtcgacggtgcttgacccagtttacgtgaagcgattgacagatagatttgggagatacatttgatggttgccatgtacgggacaagataatacttcttgaataagtggagtcgcaatgcacgtgaagatatattttcgatgaactctcttgaacagatggggcaatgtgaactggattaactcttcgtggacattagttaggccattgggcggggaaacctctgggttcaatccctggtcattggccacacgtccaaactaaccatatacataactttgattgaccttgactcttgtccaaaaaagacagagattcctatgtgcttcaagaaaggacattccatcataggcgcgacaaaaaccacttttggggcgcgggaaagcgtttcggcgaaccagtaaactttcttttcgaatgagagccgttcgccaaacaacaaagtgggttagattgggagataggggggaatatcaaggagacagacaaaaaggtgacctcctgttacaggtctttagtggtatggggctcagggcgtagtggagatcaaaagatatcaacgggctccggagcattcggagtaaagaggttaagctcggagattaggggcaaattacattatataaatagtntataagcccaacaaacagtacgtttaggcagaaagatgaagacagcaagagaaaacaagg

SEQ ID NO: 620640 - DNA, 256 bp, Homo sapiens
cgtagatagtgaagtggagccaaatactatgcagatggggaggcacgcctatactatgaacgctgggacctcactcagatggacgacgagctgaggctggacctgggagctgaaagattagggcaggcacgtggtgatgggtgccatactgagaacaaggtggagagcaaaggcaattcacctcctgagctcaggagaggcctgtcgcgaggagaagggcctggctgccgaggatatgtgtaggggataaccatca

SEQ ID NO: 620641 - DNA, 687 bp, Homo sapiens
acacaaaaattggctggacatggtggcgcatgtctgtaatcccagctactgtaatctcagctactcgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcaagtgagcagagatcgcacccactgcactccagcctgggcaagagtgagactgtgtctcaaaggaaccccaaaccacattttacacatggttcgctggtatttacttcaaaccctactcctgggattaaattttcccagtaagggccatccggacaagttgcttgggcaaaggcaaaacccgcgttatccaatacccccaggacctccaagtagtttcaatggcacattcccggggtgcgactgcctttcacccggggagaaaaatccctagaaacct

SEQ ID NO: 620642 - DNA, 420 bp, Homo sapiens
cgtttggccaataagccggcataccaaatcctgagcagtgatggttccaccacgcatcgcacaattcactaacgccaaccaggcggcccaggcggcggacgtggccgcggccatttccctgcaggtactcaagggcaccattcgggccttcgacccgcgctaccactcggtcaaggcccatgtcgcccaggcgcagaccggttgctatatcaagcagttgctgggtgacagccagctgatcgaggagaacatcgactaccgcctgcaagacacctacagcctgcgcgccatcccccaggtgcatggtgcctccaagcagttcatcgcctacgcccaggcctgcatcgacaacgagatcggctcctcgagcgacgatgtggcaaccaagaagacccggtgagctttgccttcaacgcagcc

SEQ ID NO: 620643 - DNA, 819 bp, Homo sapiens
ggtttcactgtgttacgccaggatggtctcgatctcctgaccttgttgatccagccgcctcggcctcccaaatgtgctgggattacaggcgtgagccaaggtgggcagatcgcctgaggtctggagttcaagacttcagcctggccaatcagggtgaagacccggactgtgtgaaaataggataattaggcacgtgatggatggcgagactggtcgtgtgaatccgctagcgtagtacaaggaccacatgagcgcaattagttcgtaagttaccatgagccctagagaatgcaggagtgattgcacgctgatacccgagagtatgatagtcgattgtgcatccacgtcatgtggtaacatatattgtaatacctgttactatctataaattctagtcgcattttttatcgcgacataaaccgacgagacaattgaaattttatagatgcactaagaattccactgcagacagtcgggttacagtaagccgccatagctgcaaaaggtgaacagagaagtaaatttctggctttgactagcgtgtaaatagtgatagggagccacttgctagaatcaagtacaccacgtaatgcatattatcttgaattgactaggtaaactactttaccatcacatgctgcaggtgtgcctaagggaacatgatgtccttcattcatacagtaatcatgctgcagagactttgcagtctggcaccttattggattcaccaattaccttttagttggttgttcagtaataagttgttcgcaggtaaagtctccaataaaggttatcggtctgctaaagacagaatacaag

SEQ ID NO: 620644 - DNA, 113 bp, Homo sapiens
ccaatatggctcatctaggtgggctgtgcaggcaaagcaaagctcaggctggttcccagctggcctgagcaggagggcctgccacctagacccacccacgctctgacgagagg

SEQ ID NO: 620645 - DNA, 1459 bp, Homo sapiens
  misc_feature (723)..(723): n is a, c, g, or t
gcggtgagctcctaaggacccttgtgcgacacgtgtatcacgggtgtgtgtgcaacatgtttgtttgttctccagaacaaccaagtggtgatgtttcgtctgttgttgggggcgccccgtgtgacaccccctgtgtgatgtgttgaaaaattgtggctcctgttgtcacgcaccagatgttggcgcacgaagcgtgtttccaaccgttgaagtgggggtagagaaccccccggggaagaatgttgtggggcgacccgcacgcctggggaaccacattaataggaggggaaccccaaccctttattggagaaaaccccttgggtgcccacgataaatgattttggcgctcggccatgtctttagttcttgggagaaggcctagtttcagacgcttggcggccgaaatatttatgggaccccgccgaaatgtgttcgaaggggactctccttgatgaatcggggggtaaacgcttctccaagggagtataaagttggaccgcccccttgggggaagccttttatggaggccgtaaccatgtggtgttcccccaagtgataaagggggccaaaaacataggctcgagttttttctcgggaaatagaggggtcaacgcccttataacagagataggcttgagggtttatggaaaccctgtgttccacgaacacagacgtgtgcctcttcgctgggtataatatgggggagagccctacaggcttttncaacattggagaaaatcgcgtcgcgtcacccgaagaattactctcccaccggggagtgttataccttctggggggctcacagagagaccttttctctggccttcacaggggcaccacacgcacagcgcacacgtgtgtgtttaagacccctgtggggtctctccccactgtgcgcccctctcacatggtctctcacacacaggcgcacatatatacctgtgcaacaggcccatcagggaaacgccggtgtatacaccacactgcacacgcgttttgccactgaacgcgtgctataaggagagccaccacaattcttatagggaggaatatcctattcttctgttcttttctaaagggccacatcttggctgttaccacacaaaatcctctctgagacaatacacctcgggggcaccacgtggcaccaccctactaatctctcacgcacctttgggagggctgacggcacgggcggagtcacacctcgaggttgggagagttccacgagaccacgcctgagcccacacactggaggaaaatccccctttttatctataaaataccacaaattagcccagcgctggtggcgcgagcctgtaaatccacgctaactcgggagaggctgaggcacggagaatcgcttgaaacccacggagaggcggagaggttgtggtgaagcccaagatcacgccgttgcactccagcctgggccaacaagagtgaaactccatttcca

SEQ ID NO: 620646 - DNA, 126 bp, Homo sapiens
gctgcgtggctgcagggctaactggggccgcgcctttatacatgcagcaaggccaccttcttcgtgttgtttaggttaaaaaagtgtgagagcaaaaggtctaccaagcttcctgactctgactgg

SEQ ID NO: 620647 - DNA, 105 bp, Homo sapiens
tgccaggtccttgccctttgtgcattgtcacaggtcacacgaggggccccgtgtcctgcctagtctagaagccaatgctagtctggttgcgccatttattgtgct

SEQ ID NO: 620648 - DNA, 577 bp, Homo sapiens
agcggatcgtttgagtctgggaggcggaggctgcattgagctatgatcgtggcactgcattccagcctgggtgacagtgcaagaccttgtctcagaataaataaagtatgtgatgaagatgtgcatacattatatgcaaatactgttttttttttttttaatttaaacagccggggcaacaagagcaaaactcgtgtctcaaaaaaaaaaaaaagatttaatctcacaattaatttaagtatgggctcaatacaagtgtgtttagccgggggtgtgggggccacatgtgcccatatagtcgcagcttacctcgggaggcaagaaggcaggaggactcacttggagccccattgaaatttggaggcagcgaggtgagcctatgatggtgccagggtgtactccagtccgggggtgacagagtgagaccccatctctaaataactgggtcaaccccttaaaattatttaaaattcttaaaaattggaaaagattattcttctcaaatttagtggagctttctaagaagaaagcatggggcttttccccacttcaataatcaatttccagcttggactca

SEQ ID NO: 620649 - DNA, 265 bp, Homo sapiens
aacctactgctgtcaccttcaccgtaccagatttttaaatcctgtagtcacgccaaaaaaaaaaaaaaaaaaccaaaacaaaaaaaaaaaacaaaataaggccatgccaatcatattttgtatcctggcccaattcctcggtgtgaaatgggaggcccaatctgggcttcgttgtccacctcccagcaattgtggacttcagcaagcaggataatgcagagctccgggcccttccaatcgatccaccggcaaaatgcttacaagg

SEQ ID NO: 620650 - DNA, 271 bp, Homo sapiens
cccagccaggagcccccccaactattcaactactgatgaactggggcagggtatcagacctcatgtttcttaggttccagaaaggacattctaaaattccttacctcatctcgtcttccaccattaaaagaagagctaaagggtttgctgctgccgccgcccctttgaggaggcaacttgttaaaagttttgcttttctgtgaattggagcgacgggactgggtgataaaattttcatttttggggtaggcggggggtgctggctgggggg

SEQ ID NO: 620651 - DNA, 330 bp, Homo sapiens
tgagatattgacccttccacggggaggttactccagtgacgaaagtactagaagattacaagaacataagtacagagacatcttctgagaaacttatggagcgcagtcgtcaggttcaaaagctccgagggctctatgagagccttagtggaggaaatatcactatggctaagccatgaaggccccctttaagcatccttgaatgcacagtctggggcacttgtgatgccatcagtgctgaaactcctgtgtttcctttgggttattacacctgttcgaagctcggggcgaattacgctggcgatttccatgtgcctcatccttggtgag

SEQ ID NO: 620652 - DNA, 1133 bp, Homo sapiens
  misc_feature (273)..(273): n is a, c, g, or t
ttttcgcgtcgccagccgagccacatcgctcagacaccactggggaaggtgaaggtcggagtcaacggatttggtcgctattgggcgcctggtcaccagggcctgcatctttaactcctggctaaagctggactatcgttgccactcaactgacccctctcacttgcaccctcaaccctacactggctcttacactgcttccaactactgacttcccacccactggcaacacttccactggccaccgcccaaggcctgacgcaacggcgaagncttgctcactcaactggcaacacctcccactcaccactcttccagcgcagccgcacgcatcccctccaacacatcacagctggcggcgcatgcctggcgcctgagctacgctcgctggcagctccacctggccgctctctccacgcaccccactggcaccacagcggctgcgcggcctccactcccgccacgggcgcggcacgccccaccacacgcggctccactccactcctcctgccccccacttcctgccctgcactgccccccccactgctctccgctcactgcggcctgctgcacaccccactgcacgcaccgctcctgcaccaacccacgcctctttcaccggcactcacgtccacgccacagtgccctccccttgcccacccaactccacaccttgcctttatgcccaccccccctgggccccacacgcgctccactcgccattgcgaccacacctaccagggctcactccgctcgcgcacaagcggaccttcacttgaacccaacaggctcccaatgcccccagttccaacctaggccccactccccaagcaaaggacctagctggcgaactggggcccccccttcgccgccggccaccacccctcggcctgcgcgccggctgaccttggcgccccggccggcgcgccctctcctccccaccaaaacaacttcattcccccctggcccctccctacctctggcccccttgctcccaatcgggcctggctggtcgccacacggctccattcgcgcctggctcgcctgcactctgcgtgacacgcctccccctgcccacatggcccctcaccgccgcttccccccacgcgtcgcccacacggtctgtccacccg

SEQ ID NO: 620653 - DNA, 628 bp, Homo sapiens
  misc_feature (51)..(51): n is a, c, g, or t
caacttttgcaagggcggcagcttatcagcaacttggcactttctgtagantcagcttaaacatttaagcgaaaaaagtagtgcgtggcataaagtcaagatgtctcatggcaatttagataagattctatcaaaaatgcctctcattgtcatgagatgcagtgcacacagcacatacatctggtttaccaataggggcaggcatgggcagtatctatgatgttacaaagagcattcatttcctccaggttcttgatatgcgcagcagttagccatttccctataggtctgaagaagagttctgtatgtgcatgacttgtctccataaacagtatgaattcaatagtcccaatatccagctgaatcaccagcaatacatgttgttcgatgtttagatcatgccacaactaattttacatgatcgacacatgagcactggtgaagattctgagcaaaggcaagcaacaacgagactgtccaatgttcatataccagatcttcaactggatgatctccctcagtattgtgtgcttctggaccaaacacacccctgatataagccgagctaaagagagaaagcagggtaataaagcccaccacttagttgtgcctaaggcgtgcaggaatg

SEQ ID NO: 620654 - DNA, 603 bp, Homo sapiens
tactttccacagggccacaggttgaagagacatacccacagaatgggagaaagatatttacaaagctatctatttgagccagggacttaataacaacgaagatataaagagatcaaacgactataggaaaaaagctaataatccaatcaaaacacgggcaaaagatttggacagacatttctcaaaagaagaaacacaaatggcaatcaggcatatgaaaaggtgctcaacaccactgaccaatagagaaatgcaaattaaaactacattgagatatcatcacaccccagtaaaaataccttatatgcagaagagaggcaataaaaaatgctggcaagtatgcctgagaaagggaactttttgtaccccacagggtgaagagacatacccacagaatgggagaaaatatttacaaactatctatttgaccagggcttaataacaagaagatataaagagatcaaacgactataggaaaaaagctaataatccaaccaaaacacgggcaaaagatttggacagacatctctcaaaagaagaaacacaaatggcaatcaggcatatgaaaaggtgctcaacaccactgaccaatgagaaatgcaa

SEQ ID NO: 620655 - DNA, 360 bp, Homo sapiens
tcccatgtaatgtatgctaatccagaaaggaattatgggagcacagagaaggcacactgacttaagtctcagagcattggcaaagccttcctaaaggaagtgacgtctagcccgaaatttaaaggatgaggagttaggcccacgaagaaggtatgaccattccaagtagagaaaccagccgagcacaggaaaaaagtccaggtatgaagaagcatagtgtttttttttttgagacagagccttgctttgtcacaggctggagcacagtagagtgatcgcgcgctcatctgcaacctctgccttctggactcaagcgagtgtcgcgcctcagcctcacgagtagctcggattataggtgcc

SEQ ID NO: 620656 - DNA, 433 bp, Homo sapiens
atacctgagatattcttaaaaaaaaaaaaaaaaatttttaacaggcaaggctggggtttgctaaattccatcttgggatccattcttgggcattcttcactttttgggccactcccaaaatccatttgtattgttcctcctcgcccaaaagggcccagaacaaaaggtttacttcaattgttcccataggaaactcagcttggttggggggtcaggcactttttgagataccagcccacccctggggcccttttagcaactttacaggccaatcacaatgcaggttcagacaatacagctgtataaagggagaaaggctgttattaatgtttaaaacagcaaaggttactcatttgggttttaagttgcaaaagctgtggcaaaaaacattaaagttaataacttccacacatgatcacataacaaccagaaa

SEQ ID NO: 620657 - DNA, 468 bp, Homo sapiens
  misc_feature (6)..(6): n is a, c, g, or t
  misc_feature (44)..(44): n is a, c, g, or t
  misc_feature (143)..(143): n is a, c, g, or t
  misc_feature (158)..(158): n is a, c, g, or t
  misc_feature (193)..(194): n is a, c, g, or t
  misc_feature (220)..(220): n is a, c, g, or t
cgcctngggatgttagcttccgacttggaaatgcaaactcgtantacccgttacacgggtatattatctgctacacggaaggccgctaggaagccttgcttctctcaacgttcagctgttctttagggcaaatcctgttccgngtacctagcatgtgnttcccattagaaagctttaacacgtgtaatctgcnntccttaacgtggcgtaattgtacgtncctgttgtgtttcagtttgtttttcacctataatgattgtaaaaacaaacatacttgtggggtctgatagcaacatagaatgatgtatattgttttttgttatctatttattttcatcaatacagtattttgatgtattgcaaaatagataatatttatataacaggttttctgtttatagattggttcaagatttgtttggattattgttcctgtaaagaaaacaataataaaaagcttacctacat

SEQ ID NO: 620658 - DNA, 111 bp, Homo sapiens
ggatttgctggtgcagtacaactaccgcttaatagggagcatcgaattcaagcttctaacgttagaagcttgaattcgagcctcgaattcgaggttagaagcttgaattcg

SEQ ID NO: 620659 - DNA, 744 bp, Homo sapiens
tggacaatctacaaacacttttattagccaaaggagtaagtgcagcatgggagaaagaggggcccctccttcccctcaaagtgcatcactgccccttcccaaggtggcagcgccatgcaagggaacaatgatggaccccaagggattgcaaagcatgagctgggaattcatgacaaaatgtgatcctgtgtccaggaaacgcattagacgctgcacagacattagagctcctacatattcactccagatgcctgccttgtgaactgcgggcgaggtgtagacacgccactgaagatacacagctgcttgctacttgcctcagaagaaacctggacatctatgcggcccccttgaaaccagttacacggacggtgtgcaaattatcacattctagctaggtactactgaagatcctaagtcttgtacttgcccccttgttctcctaagtaagaagatgtcctatatgacaatctccctatatagcctgatgtgctctcaattcacatcatttctatattctccacacaaatccacccattcatcaagacgtgccaagagcagtgaaaaaggccgcaggataagccaagaagggtccctgagcaaaagtatacggtggccatccttactagcccaagcctctcgcctaatactccacgtaatgcttgttgttgaatgagtcgccaaaactctggccactggctctacccggggaaattgttatgacctcaaagttatgccaagacc

SEQ ID NO: 620660 - DNA, 321 bp, Homo sapiens
aataaagtcagcaagccaggcaagcatgaagtgcagcaagtggcaacttgcaacatcaagcacaccaatgcagacatggccaaggcacagagcatgaaaggaggcagcatctcagcaggtagaatccagaagtatttaccacaggaatagataaaaagtcaaagattagcaaaaatatatgctcatgcaataacacatatatgaagcacagaagcaaaagctggactcagcaacaaaaatagcaagtagagccttacacacactgcgttagccttgggagtagaatgtcaggcagagaagtccacaggcaatagaacatgt

SEQ ID NO: 620661 - DNA, 420 bp, Homo sapiens
  misc_feature (289)..(289): n is a, c, g, or t
ggcttggcctgtttagttagaagttacctacactgagtttattctgggttatgtacatcaattcttagaagagccttatctaatgcatcaagaagtcaccctaaaacctgtgaccactacgaggccagtgaattttaatcatgacctaccaaggcaagttttttccttggtctgataatagttcgtgaatttatgtgggatagagttagaatggattccttgctgtcaggatgctggtaggtacagtgaaaggatcagagcattaggggaaacaatgagtttggctctntgaattatctactgctataaattggtggaaactttagtgttttactcatggcactattggagttacattctttgcatcccaaactgtgtcaaggaataccttagttacaccttcacagataccagatatga

SEQ ID NO: 620662 - DNA, 389 bp, Homo sapiens
ttttttttttttgagaaagagtctcgctctgtagcccaggctggagtgcagtggcgcaatcttggctcactgcaacctctgctgccgggttcaagcgattctcctgtctcagcctcctgagtagctgggattacaggcacgcgccaccatgcccagctaatttttgtatttttagtagagacggagtttcaccatgttggccaagatggtctcgatctcttgacctcgtgaggcgcccacctcaacttcccaaagtgctggaattacaggcatgagcaccacacccggcccaggtggaatatttatattcctaagaccctagcaagtcccactgtctgggaggaaaacagggggagagtggtccgatctattcgtgccaagcaagacct

SEQ ID NO: 620663 - DNA, 477 bp, Homo sapiens
ctgtttcacttacagacattttaccccacatcggttacttaccttactggggcggtgggagagccaggggtagccttccaatgcgatgaccagcggaggcgggagccaacttgttaggcctgtggctgagacgctgcagggcgggttatgtggtgtcctccaatgagacaggaagagcttccctgcttcctccaatagtgttggggctcgggggtgggcttcagcagtccgtctccaataggcggggttgagttagggaagctccccgccaataggggcgtggagaaggagagcggctccccctcccctaccagtcgagggggaaggggcgggaaaatcataagacaggcctcggtggttggctgagtctttgacgggcgggtattgcgtcctgtattggaacgaagctgagtcttccctctgcggggcggggtcgggggagtgggcgggatttcccgggtaacagagaagcggccg

SEQ ID NO: 620664 - DNA, 699 bp, Homo sapiens
  misc_feature (113)..(113): n is a, c, g, or t
  misc_feature (121)..(121): n is a, c, g, or t
  misc_feature (134)..(134): n is a, c, g, or t
  misc_feature (154)..(154): n is a, c, g, or t
  misc_feature (172)..(172): n is a, c, g, or t
  misc_feature (176)..(176): n is a, c, g, or t
  misc_feature (182)..(182): n is a, c, g, or t
  misc_feature (186)..(186): n is a, c, g, or t
  misc_feature (194)..(194): n is a, c, g, or t
  misc_feature (197)..(197): n is a, c, g, or t
  misc_feature (213)..(213): n is a, c, g, or t
  misc_feature (219)..(219): n is a, c, g, or t
  misc_feature (224)..(224): n is a, c, g, or t
  misc_feature (315)..(315): n is a, c, g, or t
  misc_feature (420)..(420): n is a, c, g, or t
  misc_feature (528)..(528): n is a, c, g, or t
  misc_feature (531)..(531): n is a, c, g, or t
  misc_feature (545)..(545): n is a, c, g, or t
  misc_feature (560)..(561): n is a, c, g, or t
gaatccgcggagggagcgcaggctcgaagagctcctggacgcagaggccctgcccttgccagacggcgcagacatgtcagaacaaagtaaggatctgagcgaccctaactttncatccgangcccccaactccnatggtgcacagcagccctgnggtttcggagggggttcntccntccgcnaccnttgcaganccncatatccctcctctantgcccnacgcnccgctccgcatgccgcgcctgcctccccaggccccgaacgacgagggcgacccgaaggccctgcagcaggctgcggagcagggccgcgccnaccaggccccgagcgcggcccagccgggcccggcaccgccagccccggcgcactggtgcagaaggcgcacgagctcatgtggtacgtgctggtcaaggaccagangaagatgatcatctggtttccagacatggtgaaagatgtcatcggcagctacaagaagtggtgcaggagcatcctccggcgcaccagcctcatcctcgcccgggtgtncgngctgcacctgaggntaaccagcctgcacnncatggagtttgcgctggtcaaagcgctggagcccgaggagctggacagggtggcgctgagcaaccgcatgcccatgacaggcctcctgctcatgatcttgagactcatctaacgtggaagggccgcggcgcacaagac

SEQ ID NO: 620665 - DNA, 391 bp, Homo sapiens
atgcagtgagaactgctgagtgtgagcatgtctggtggaacatcctggtgcttgtgtcatgtgtataatcatgtgcatgtgtgtgtgagtggatgtggatgtgtggacagccaggaaggccaaggagagggagagcatacagactaatgcctagaacggtgtagcagagccaggacagtgtgtccctggcttaccccaggggaaagagggggacactgggccagaaacttaagctcctggactctgctgaatctctgtgcattcaaggggagatatgtgcatgaagtcattgcagtgtgacgcctctgtactcatcagatcacccacgtaatctaatgcactcccatcacattccagactcagtgctgccatcagctccctaggagctctc

SEQ ID NO: 620666 - DNA, 125 bp, Homo sapiens
gtaaggtgcatatacacgcagtgtaatatcgcatagttgcttcaaccacatgccaatctgataactttgcaatctctttgaaaaaattacagactttggttgttcaggtgggggcccgatttacc

SEQ ID NO: 620667 - DNA, 203 bp, Homo sapiens
  misc_feature (79)..(79): n is a, c, g, or t
actatcacttaagggaaacaaacaactaacagccatcaatccagaggaaagcgattttacagtagagtgaacgaaactngagaaggaaaacatccaagaggcatctgtttgacgcgagcaacgcaaggaacacataccgtctggcaagaatcccactagggccacgagaaacaaagcaaattaaaacattatccactacacga

SEQ ID NO: 620668 - DNA, 775 bp, Homo sapiens
  misc_feature (3)..(3): n is a, c, g, or t
  misc_feature (147)..(147): n is a, c, g, or t
  misc_feature (162)..(162): n is a, c, g, or t
  misc_feature (330)..(330): n is a, c, g, or t
  misc_feature (341)..(341): n is a, c, g, or t
  misc_feature (553)..(553): n is a, c, g, or t
  misc_feature (592)..(592): n is a, c, g, or t
tgnaggatcgagtgagccgcgtggaggaacatgttgtgtctgctgtttttgaataaccagggtgggaggttggccatctgaatccccacttcccatagcacaggcagagggaaagagaaatggagtggggagcacagagcaggctcnaacaagacaaatttnctgctgctaaaccaccatgatttactttgactttggttacaaactttgctaaaaaaaattttttatatttattgtttccaagggttattttaaaaagtggtggccaccaccccttagaagcaagagaaaaagaaaaaagggaaataaatggagaagggagcgagaggnttctagatggncctggttaggacctttttttggagcttgggagtgggcacttaggggttgggcaaagggaggggttgggttagtattttgttagggggaagagctaagctgtttgggagggttgggggatggaggaaggatgtgtgggaattaccagggcattgttgcatttggggtgatagggtgagtctgctaagctggagggagctctgaggcgtcattnttactggggggtcctattcctggaagagtgctgaatgtnaactcccaggcctcctcttccagcaataaggaagccatgtctgagaggggaagggcaagatgtgccctcagcctcactcaatgagctccacgtagttggcagggaacatgccaaaatggccatccggcccatagccacgccaccagcctttcgtcgatcacctcgatgcccgtgatgaggttc

SEQ ID NO: 620669 - DNA, 649 bp, Homo sapiens
cccaggagatggtttaccttgatccaactaccctcccagtaaaactaagaaatccaatccatgaagaagatcccaaaaatggtatccatcaaggattaaaaggatcatgtaaagcacgtcttaaataacttaattttattacacagattagttattctgttagctaggatccaatgaaacccgttcccaataccctctctcatgttggaaaaggaggaatgttaagacatgctgcagtgataaagtaaccattcttatctaaacgtgagaaatgataacagttaaaagtttctccagtggcattttaagttaatgttaactttccatacaaaactcatttccttcccaatctttcctctctacacaaccacaagtaggtttgccatctacacctatttgtctatatattctacaaataaaagttcccaatatgggtttttattaaaactgaaaatgtgaacactgaaaagccactctacgcactgctgaaagatttgaatgcaataaaatttttaaaatttactcatattttgctgtaaagcactcatgtaaattaaaagagtaacttaaaaactaaatttaagacgtgccttttctcttaaatcaatacacttaaataacttctcaagaaaaaaagcatttcctaagt

SEQ ID NO: 620670 - DNA, 215 bp, Homo sapiens
acgctgactgcgtgctcaagttaagaacgggaagaatgggtggcaaggtggctccgtggaagatgctcaccctagcacaggtgccctgagctcggagccttggtttctagtccctgggggagattaatatttaataaatttttatataattacacttgcgaaatagaccatataacaatctgaggggttggggaagaaacgtgaggaactcagca

SEQ ID NO: 620671 - DNA, 155 bp, Homo sapiens
tattgatgtctgccttctgccaggcttgtgagacatcttctggtgggcactgtgcggaaacttgaggactgaaatccgtgaagctgcatgcacttacacggcatggcctgtctcctcacttgagtgcacggtccatcgcccaaagccctgtactg

SEQ ID NO: 620672 - DNA, 177 bp, Homo sapiens
atcatttatccggggaaggcgctttgtgaagtatgccttatttctcttgttcctttcgtacagcaaggacagtttgactgataatgaaaccgaccctggattactccgcgtctgaactcagatcacgtatggacttttactcgtcgtaacaacacgtacctttccatagctggctcg

SEQ ID NO: 620673 - DNA, 285 bp, Homo sapiens
aaatgttactgtcacttcgccatcttaaaacatttctgaacttttcatttacttctcttctttgataaaaatggtattcgagtttggcccgtgtccacaaatgatcacttagagtagtaattatagaatcttacggcatgttagaattttgagatcactgagaagcaaaaacagtctgttacgtgttcataaagcttatgacatgttttgatttggtagcttcatgtggaagaggtagtagatgtatttgttaacatttaaacataaaggtttaatttctatttc

SEQ ID NO: 620674 - DNA, 346 bp, Homo sapiens
ccatcaatatttttacatttatttgaagaatagttgtccatgcttagtttctatggagaaggtatgttcaagatgggacatccagtcatagcccatgattttaattggcaatttcaactatgtatgccaataacttagcatttcattcacttctcaaacatttgagcacagacctttgtagtgaatgttaaacatgacatttgacatgcgtaccataccatatacattttaatgtatatgcagcatttagcagcacaggtcagtgcatgaccacaggatgtctactgtctttgaatctgatggatatatttttgaaactctaattattatcaccttttacttttat

SEQ ID NO: 620675 - DNA, 1070 bp, Homo sapiens
gagttggctccttaacatttcttggcaacagaaagccccatggcacacgttcagcgaaggagaggaaggcaggtagagcttcggcacgagtaacatggcatattatattatggacccgaaatctagggtatttccccgaggtccacccagatacgtgggctcttgaagctaaaagtctgagaaagcgaagacagggtttgaatgctggggccgttgtgtaggatggtgcctgagcctgttatttatttattaacagcagggccactcgtctagggcaggggagtctgcgtgtctcctggggctggggcagggcattggcaggtatgcggtgggcctgaacctggtctggtgcccccgaacctggtctgatgcgccccatcaggctcgtttgacgaatgcgactgtggctggtagggttttctcctatgtctaaaaatgttctctgctttcctaagtgacagtttggaagtatgggataaccaagagctcaggtcacacgagaccgttggagcccctatctttgcttgcagcttagctttgagatagtaagcaagcgagggacttcactcttgagccggttttttcctcatctgtaaagtggggatagtggtgacggctacctcatagggttgtaatgagcactaaatgtgaagtgcttggcagagtgcctggcacatggtgagtcacagctactgtgagtgtctgttatgcccctttgtttcattaagcccaatggtaatcctttgggacatggggggaagttcttcgggataacccggggtcccagggtgggccccggttggccaggaaaaagggtccgggtggcgggcccacaggggggggccggcccaggggaagggtcgcaaaagcaaaggggtcacgggggaataccgggggggttagggccgggggggccccaaggggaccccagtgttgtggactcccccggctacatagccccaacaacggtggcggaggcggagacaaacaagcatacacaacagcagaggccgtgcaggagcagcagagagcggcggcagaaaatatcaccacccgtaggagcgcgcgta

SEQ ID NO: 620676 - DNA, 559 bp, Homo sapiens
  misc_feature (381)..(381): n is a, c, g, or t
  misc_feature (559)..(559): n is a, c, g, or t
gtcccggctgctcgggaggctgaggcaggacaatcgcttgaattcgggaagtggaggttgcggtgagctgagatcgcgccattgcgctccagcctgggcaacaagagtgaagctccatctcaagaaatcaaataaatcaaataagtgcaataaaaaaaaaaaaaaaaaaaaaacaaaaaaacattgtgttgggcgcggccttgggcccttggagaaagagatttttatgagacaccaattgcggtatggggcggcgggggcccaagagaaggtgaaaggtggacacatgtgggcgccataagagagtggtgcaccaagagggagagacccggggggcaatggacaaagggggcggggggtatttctcaaccaatttaaaanaaaggccgcggggggagaaacaccggaagaggttttgtgtgaaacaaaatattccagaggaggagagagtatctggagaggggaaaaaatgaggggggagactcatatacaagcgaggaggtccacagagcggaagcttggaaaatataaaattaaggccccgaacatgggtgggctn

SEQ ID NO: 620677 - DNA, 3148 bp, Homo sapiens
ggaacacaggtatctgtgcctagtactggctttctcttaactgcagtcattcttcccctctaaagagttagctggtctctgctgaaacctttaagtgaatcacagacctgtgtgttatttatagcactatggctatatagcttaacgactttggacaagtctcttgccctctctgggtctcagtttcctcatttgtagaatatcacagttggacaagtggattccaaaagctttcccagccctaacattctctacctgatttgctcagcacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagtcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggtgtgttttacactgaattgaatcgttgtccttttctggggaggaaagtgaaggatgagaggtggatccacagatcttctctaactgccccacacttttcttttatctcctcctttctattgcttttttcttctaaacaaaaaaatcttttccccgggtctctctaccttcgtttttttcctctttacccctcagctcaaaactcagaatcctagacttttgactagctagtgtaactcgttatttacttccactaatgtctcctcccagttgatgcccaggtctatcgagtttgatcttattcttaagagatagaattggggagtagttcttccatccagtattgggtaaccggggggacggagatccccatcctcatacctttgatttgtgtagcaggactgatggccgaggggataatgtccccagaaggaacacagactcccgcttgggtgagatcccccggaaagaggtgagggaaagtcaggcagggaccaggggagaaaagggctctcactgaccagctccttcacctctgcacactcctggctggcccctccattccacccctgcattctgtagcatggcctttcctccctgcagactcatctggccctctccacgtgcatttcctcagtggggtggggaattgagaggatctgacgctgatttcttcctctctcttccctcaactctcagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620678 - DNA, 196 bp, Homo sapiens
aaatcatagcaggatccccaagaacagacactctggccacactctgggaattaattaattaagcgacacagtgtcactcttggaacccaggttggagtgcagtgacgcgatcatggctcagcatagtcttgacctccccaggctcaggtgatcctcccatctcagtctcccgagaaactggctaatgtctgtcttg

SEQ ID NO: 620679 - DNA, 313 bp, Homo sapiens
tgctgtatttgtttatttcactccatagtgtcttattttttcaaaattaaacttcatttagagacgattgtagattcacataatagtctaaaaagtaatacagatacctgggcaacatggtgagaccctgtctctaaaaaaatcaaaaaattaggccaggtgcagtggctcatgcctgtgatcccagcacattggtgggctgcagaggcgggcggatcagctgaggtcaggagttcttgactagcctgaccaatatggtgaaaccccatctctactaaaaataaaaaaattagctgtttgtggaggtagcact

SEQ ID NO: 620680 - DNA, 449 bp, Homo sapiens
caatgtttcttggtacatgctgagagctgggcaaggggttggtttgctgactgttgggagaagatggctgttgaccctgcccctgtgggtagaaagaggcaaaaaagttattttgaaatttcatcttacttgccctacctaagaccctggcccgtgtggtggagggctggaaccggcatgaggctgagcggacagaggttctcaggggacttcaagaggaacaccaggcagcagagctcaccagaagcaagcagcaggagacagtaacccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620681 - DNA, 3652 bp, Homo sapiens
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620682 - DNA, 151 bp, Homo sapiens
ttttgggggggggagggggaaggggggggcccccccccccccccccccttaaaggggcccccctttttgggccccccccctaaagggggggggggggggggggggccccccctttttttttttttggggccttaaagggtttttgccccga

SEQ ID NO: 620683 - DNA, 3524 bp, Homo sapiens
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620684 - DNA, 429 bp, Homo sapiens
atggaccttcttaaacataagcccatttccaaacatatatttgtgaatacataaaactgaatgcttttaacagcacccaagtcacctcttttatttatttattttattttattttttcaagatggagtctcactctgtcacccaggttggagtgcagtggcacaatctcagttcactgcaacctctgcttcccaggctcaagcaattctcctgcctcagcctcccaagcagctgggattacaggtgtgtaccacaacacccagctaattttttttttttttttttaagatagagtctggctgtgtcaccaggctggagtgcagtggcacaatctcagctcactgcaacctctgcctcccaggttcaagtaattctcctacctaagcctccccagtagctgggactataggtgtgcgccaccaagcccag

SEQ ID NO: 620685 - DNA, 108 bp, Homo sapiens
gtgggaattcaatgtctcaagcctgttttctgggtggcatgtaagttgtagacaggcaccacattttagacatattatggtggtgcctgtctacaacttacatgcctc

SEQ ID NO: 620686 - DNA, 884 bp, Homo sapiens
ttggctatggttctccagagtcccaggggctgggccctggcgggccgcgaatagcgcccagggggtgcgtggtctctctcagggggcttgtgctaccctcgcgcgtatgtcccgcggggcccccctgtgggggggcgccgcgttgtcagttaaaaccgatgttgggtggggggaggagcaggtgtagtcccccgcggtgggtcacacagctgttgttagggtcgccgcccacttcattgaggttgcgctgggccgcccccctctcttggtgtgtggcgccctcgccagcgccccccagttggggtgcgcgacgtcgtctccagcgtttagcccgccgactgggtgcaggtctttcgctgtgtcggacatgtaggagccgccgctggttgcccacggggggctcattaccaagcacccgctgggtcccccgagtctgtcgtgggaactacgtgatcagggcccccgcggtggtgcccagaaggggctctatcgagcgggtctcatcccagtgttttatccgccgcggttcgcgtccccccccgctgcgttgataccccgaggtgtgaccagaccgggggcttctccaaccactccttctctctccatctccgccgtcttcacttcatctaaaggtaacaacatcggttcatatgagtcgccgcccgtctgcagtgacatcctcctcgaaaatgtacaccagtgaatagtttgttcgggggccccacacaatcgggacttctctcttatggcggacggaacgcatataataatgcattctgtagctctcttgcaaccccaggcgctttttgctagtgcaccctaaactgcacccccgaattttcccgacgaatctgacccccttaaaaatacaacccaacataaca

SEQ ID NO: 620687 - DNA, 3880 bp, Homo sapiens
  misc_feature (2523)..(2523): n is a, c, g, or t
  misc_feature (2542)..(2542): n is a, c, g, or t
  misc_feature (2553)..(2553): n is a, c, g, or t
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagtcctggtccccagagtgcccctttcaggccccagcccctttcccatgggtagagcccaaactgggaacggtgagagctgctcccttgatngatctgtcctcctctacangggccccagcncctttcagaatatcagatgtccaacatttcccttcgggctctttttagctcccaagtatctgcttccttaaaggccctgagtcacttcttctctcttggcttcagacgactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620688 - DNA, 3226 bp, Homo sapiens
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcatcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620689 - DNA, 389 bp, Homo sapiens
  misc_feature (5)..(5): n is a, c, g, or t
  misc_feature (41)..(41): n is a, c, g, or t
  misc_feature (59)..(59): n is a, c, g, or t
  misc_feature (189)..(189): n is a, c, g, or t
aacanctaaaacagaaaactttgaaacaggaaaccccaaantcaaacccaacaaatggntccctgtttgtccccctcccggaaatgttttaaaaatttaagttaggcccaaatgcggtggctgacggctgtggtccctagcactttgggaggcccgaggtgggtggatcacgaggtcaggaattccaanaccagcctggcccaacatggtgaaaccccgtctctactagaaatacaaaagttggccaggcgtggtggcaggcgcctgtaatcccagctactcgggaggctgaggcagagaactgcttgaacccgggaggtggaggttgcagtgagccgagatcgcgccactgcactccagcctgggtgacaaagtgagactctgtctca

SEQ ID NO: 620690 - DNA, 318 bp, Homo sapiens
gcgggcgtcatgggcggctcttctggcgctccgcgctgcgggggctgcgctgcggccgtgggccctgggcccgagcctgctagtgcgccaggctcgggagggccctcctggacccgggagcggaccctggtggctggtgaagcccgatggctgtgcaactgtgcggctcgtttggggcacgtgatccgagcgcttttgagcagtgcgggtgcttcaacagcctggtggtggattgaacgattgcttgcaggcaaccagagagctgtcctttgcctgagcactaaccagggacctgcggaggcaagcccttctaccctg

SEQ ID NO: 620691 - DNA, 3782 bp, Homo sapiens
  misc_feature (1459)..(1459): n is a, c, g, or t
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagacntattctgttcttgggacccaagcttcttggctccagcccactcccccactagaggagctggaaagtttggtgctgtggtcataccaaagatgggcaacacccagactcctcacccttttccccagcacattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620692 - DNA, 1753 bp, Homo sapiens
aattatcttggaaacaatcttccggtaggtttaccaactctgaggcttggtccacggcctccccacttgggaacctctccaaaaagctttgggagctgacaggggaggtgcagtttcccccagcaccagaagagccttctgtgtcggttgcccggcaagagtccattttcaatgttggggcactcataaaaatctccacgtcctccctcttcccagacgggatggagctccagggctggggaacgtccgcaagtcaatgctcagagatgcccggagctgcctcttagactcgtctggcccatctacctgctgacagagcatgccaaagatgacgctcaaaagtaatgccattacttcatgtttttttttgtctcatttattttgagatggagtcttactctgtcacccaggctggagtgcagtggcgtgatcttggctcactgcaacctccacctcccgggttcaagcaattctcctgcctcagcctcctgagcagctgggactacaggcgcctgccatcatgcctggctaatttttgtatttttagtagagacggggtttcaacatattggccaggctggtctcaaactcctaaccttgcgattcgcccgccttggcctcccaaagtgctgggattccaggcgtgagccactgcgcccggccagaatggcattatatttaaatagttcataaagaagcacaaaagaatattatttcataacatgtaaaaattatataaaacgtaaatttccatgttgataaataaagttgtattggaacacggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaagaaccaaatccaacccacacaccaaaccaaacatcacacacaaaccgagccacgcacgaagaacaacaacgagagcgcacacacacaaaagcgcacaataaacgaaagcacaacacaaagacacgggaaggcaaacaaacacacaccgaacaacgccgacaccagaacaccgaataaacagaaacgagacaatgacagagagagcgaaaaccaaaacaccaggcgacaacaacaacgacccaccaaccccaccaccagagagaggcacaccaaccaacagcagcatcacaaagatgaagcaagaaatccaccacaaagactacacccatcgccagaacacagacacatacaccaatcaacccacgaacgcaaaaacacaaaaacaaagagacagaaagcacaaccaagacaagcagcacagaacaacaaaaaaacagaacacaccgaaaagacaagacaacaaacagacaaaagcaacgacaacaacgacgaaacaaccaacaacagacaaaagaaaacacctacaaacacaacaacaaacaacagcacaaagaaagagacgcacaaagcagcccacaaaagagcaagcaaggacgaacacactgccgcgaaacccgacacacacaagaagaagacaaccctacgcaaaagccaacacggcccccgcgacgagaagagccacgaaagccaacacacgaagatgagagacgagaagagacagaaggtgacgaaccaacatcgcgacccaaacacagagaaagtacaaccaacaagacaaaggaccgaacgcgcacaggagacagacaaaaaacagcgcagctaaaaccaagcacgcaaggagcaacagacatcaaaa

SEQ ID NO: 620693 - DNA, 777 bp, Homo sapiens
  misc_feature (29)..(29): n is a, c, g, or t
  misc_feature (71)..(71): n is a, c, g, or t
  misc_feature (141)..(141): n is a, c, g, or t
  misc_feature (160)..(160): n is a, c, g, or t
  misc_feature (214)..(214): n is a, c, g, or t
  misc_feature (216)..(216): n is a, c, g, or t
  misc_feature (233)..(233): n is a, c, g, or t
  misc_feature (239)..(239): n is a, c, g, or t
  misc_feature (262)..(263): n is a, c, g, or t
  misc_feature (281)..(281): n is a, c, g, or t
  misc_feature (300)..(300): n is a, c, g, or t
  misc_feature (385)..(385): n is a, c, g, or t
  misc_feature (388)..(388): n is a, c, g, or t
  misc_feature (402)..(402): n is a, c, g, or t
  misc_feature (404)..(404): n is a, c, g, or t
  misc_feature (412)..(412): n is a, c, g, or t
  misc_feature (440)..(440): n is a, c, g, or t
  misc_feature (469)..(469): n is a, c, g, or t
  misc_feature (473)..(475): n is a, c, g, or t
  misc_feature (487)..(487): n is a, c, g, or t
  misc_feature (513)..(513): n is a, c, g, or t
  misc_feature (518)..(518): n is a, c, g, or t
  misc_feature (542)..(542): n is a, c, g, or t
  misc_feature (546)..(546): n is a, c, g, or t
  misc_feature (573)..(573): n is a, c, g, or t
  misc_feature (587)..(587): n is a, c, g, or t
  misc_feature (589)..(589): n is a, c, g, or t
  misc_feature (612)..(612): n is a, c, g, or t
  misc_feature (622)..(622): n is a, c, g, or t
  misc_feature (641)..(641): n is a, c, g, or t
  misc_feature (650)..(650): n is a, c, g, or t
  misc_feature (652)..(652): n is a, c, g, or t
  misc_feature (672)..(672): n is a, c, g, or t
  misc_feature (711)..(711): n is a, c, g, or t
  misc_feature (763)..(763): n is a, c, g, or t
atccagcccacttctctggaacaggaaanatgatcggggagggaacacatgtcagtgttgggacaggtgtnactgtggacacgggggtgggctgtctctccacctcctcacattatgctaacaggaacgcagacacattcntatgccttttcagaaatanatgccataagctcttgaatttacaaaggagatgtgttaataaatcctgcatctnanttccacacaggcagctntttcangctttacaatctatgagatattnntcatatccctgggcactnttgctggacgcagcctganagcagctccctccttttccacctgatctcttcctcctacacatcacaacagccaccacagctcctaggacatctaggacagccanganagccaggccagctncnatgcccantttttttttttttttttttttttttgtnttctttcttattgtgtgtattgtgtttcntttnnntcctttgttgcntgcacatgagcacggtgtttttctgnctctntctccagaagggcaccattcacanctgncccactttctggtaagggttccatctncctgcgtgggcctngntctcccacaagactcgggtgttnctgaggtttnggtcctcccccattcccanctggccagngncaggtgttgtatctccggcngggtaggaagcccaggggcccagacacctcaggggtggncctcatgggtcagagacggggatgggtgggtcacgtgtttttttggggtgtnccgcgcgccgcagc

SEQ ID NO: 620694 - DNA, 155 bp, Homo sapiens
gtcggaccctctcagctccaaagaaatagaaaacatattcacacaaaaatctgcacatggatgtgtatagcagctttactcataattgccaaaacttggaagcaaccaagatgtccttggtagatgactggataaataaatgttattaagcactt

SEQ ID NO: 620695 - DNA, 766 bp, Homo sapiens
  misc_feature (433)..(433): n is a, c, g, or t
cccccccctgtcgttaattttaaatcttttctaaagaaggggtctccccaccgtgccaccgccggcccttgactccttggggtcaaacaaagcatcccccctttgcgctccccaagtcccggagttacaggcggtggcccctttcgccccccccacggataacacaattgtgtgttgtgtgtgtagtcacgtcgtgtgtcgtgtgtgtttgacagcggggtctccatctgttgccccggccgtagtgtaatggtgcgaccctggctcaccgtagtcttgacttctcacggctcacaagtgatcctctcaccctcacgcctcctgagtaagcacgcggttacacggcatgcatcacccaccacacctggcttatttttaaaacgttttttgtggagacacgggtcttaactaatgttgccctggctggtctagnacttctgggctcgagtatatcctccctgcctctggcctctccaaatgttgggattaccggtgtgagcccctgggtcataaccattattttaaaattgttatttaattatttcttaataattataccagactggagtctcactatgttgccccggctggtcttgaatgcccgggctccaatgatcttcctgccttgacccccccaagatctgggattaccggcgctgaacccctgcgcctggcccataaccatttttatgaagactctaagattgatttggattttactgccgttactacttatataattaaattagacttgaccagtccccca

SEQ ID NO: 620696 - DNA, 3469 bp, Homo sapiens
  misc_feature (2523)..(2523): n is a, c, g, or t
  misc_feature (2542)..(2542): n is a, c, g, or t
  misc_feature (2553)..(2553): n is a, c, g, or t
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagtcctggtccccagagtgcccctttcaggccccagcccctttcccatgggtagagcccaaactgggaacggtgagagctgctcccttgatngatctgtcctcctctacangggccccagcncctttcagaatatcagatgtccaacatttcccttcgggctctttttagctcccaagtatctgcttccttaaaggccctgagtcacttcttctctcttggcttcagacgactggcccgggagcaagcgcgagtgtgcgaactgcagagtgggaaccagcagctggaggagcagcgggtggagctggtggaaagactgcaggccatgctgcaggcccactgggatgaggccaaccagctgctcagcgagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620697 - DNA, 1281 bp, Homo sapiens
aaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtgagccactgcgcccggccagaatggcattatatttaaatagttcataaagaagcacaaaagaatattatttcataacatgtaaaaattatataaaacgtaaatttccatgttgataaataaagttgtattggaacacggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaagaaccaaatccaacccacacaccaaaccaaacatcacacacaaaccgagccacgcacgaagaacaacaacgagagcgcacacacacaaaagcgcacaataaacgaaagcacaacacaaagacacgggaaggcaaacaaacacacaccgaacaacgccgacaccagaacaccgaataaacagaaacgagacaatgacagagagagcgaaaaccaaaacaccaggcgacaacaacaacgacccaccaaccccaccaccagagagaggcacaccaaccaacagcagcatcacaaagatgaagcaagaaatccaccacaaagactacacccatcgccagaacacagacacatacaccaatcaacccacgaacgcaaaaacacaaaaacaaagagacagaaagcacaaccaagacaagcagcacagaacaacaaaaaaacagaacacaccgaaaagacaagacaacaaacagacaaaagcaacgacaacaacgacgaaacaaccaacaacagacaaaagaaaacacctacaaacacaacaacaaacaacagcacaaagaaagagacgcacaaagcagcccacaaaagagcaagcaaggacgaacacactgccgcgaaacccgacacacacaagaagaagacaaccctacgcaaaagccaacacggcccccgcgacgagaagagccacgaaagccaacacacgaagatgagagacgagaagagacagaaggtgacgaaccaacatcgcgacccaaacacagagaaagtacaaccaacaagacaaaggaccgaacgcgcacaggagacagacaaaaaacagcgcagctaaaaccaagcacgcaaggagcaacagacatcaaaa

SEQ ID NO: 620698 - DNA, 385 bp, Homo sapiens
  misc_feature (81)..(81): n is a, c, g, or t
  misc_feature (86)..(88): n is a, c, g, or t
  misc_feature (90)..(90): n is a, c, g, or t
  misc_feature (92)..(92): n is a, c, g, or t
  misc_feature (95)..(95): n is a, c, g, or t
  misc_feature (131)..(131): n is a, c, g, or t
tttagctacatgatgactggggcacccatcacttcaacgccacctaagctaggacccagtaacccccagggaagaagctgngctgnnncncngcnggctcagccacccaaaagctccagccctggatctgngggcctatggggtcctggccagtggcatcgaaggagaaaggaggcaggaagacaaagaagagactatcccccatatgagatgaatacaagttgggcatcccaaatccaaaaattcaaaatccaaaatgctccagattccaaaactttttgagcagcaacatgatactccgaggaaatgctcaatgcagcatttcagattttcggatttgggatgctcaaccaataagaataatgcaaatattccaaaatctgaa

SEQ ID NO: 620699 - DNA, 228 bp, Homo sapiens
acatatctactcgtacactaagacccaatacacaccgtcacttacttacgcccgctactaattttacactctacttatgtagaaaaaaatcttacaatacctgttaatattttctacttcaataaacctttgaatcatgatttcataaactcctaatccccaatacattctctaatttttctcgccataaaaacactcaacacttatcattaaaactactactatcta

SEQ ID NO: 620700 - DNA, 4344 bp, Homo sapiens
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggtgtgttttacactgaattgaatcgttgtccttttctggggaggaaagtgaaggatgagaggtggatccacagatcttctctaactgccccacacttttcttttatctcctcctttctattgcttttttcttctaaacaaaaaaatcttttccccgggtctctctaccttcgtttttttcctctttacccctcagctcaaaactcagaatcctagacttttgactagctagtgtaactcgttatttacttccactaatgtctcctcccagttgatgcccaggtctatcgagtttgatcttattcttaagagatagaattggggagtagttcttccatccagtattgggtaaccggggggacggagatccccatcctcatacctttgatttgtgtagcaggactgatggccgaggggataatgtccccagaaggaacacagactcccgcttgggtgagatcccccggaaagaggtgagggaaagtcaggcagggaccaggggagaaaagggctctcactgaccagctccttcacctctgcacactcctggctggcccctccattccacccctgcattctgtagcatggcctttcctccctgcagactcatctggccctctccacgtgcatttcctcagtggggtggggaattgagaggatctgacgctgatttcttcctctctcttccctcaactctcagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620701 - DNA, 2632 bp, Homo sapiens
  misc_feature (32)..(32): n is a, c, g, or t
  misc_feature (39)..(39): n is a, c, g, or t
  misc_feature (52)..(52): n is a, c, g, or t
gccaggcgttggggaaagtggcagaggaacangcagganaacctctgagcangagatttcaggagaaaagtctcccgttctttgggagagggggtgaaggagtgagggaactggaaaggaaggccttttctcttcaggtggcccctgtttttgtcattacctgactctggctttggggtccctctggctgcctgcaggggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 620702 - DNA, 736 bp, Homo sapiens
  misc_feature (28)..(29): n is a, c, g, or t
  misc_feature (95)..(96): n is a, c, g, or t
  misc_feature (121)..(121): n is a, c, g, or t
  misc_feature (133)..(133): n is a, c, g, or t
  misc_feature (161)..(161): n is a, c, g, or t
accgttgactattctctacagaccacannagacattggacactatacctattattcggcgcatgagctggagtcctaggcacagctctaagcctnncttatcgagcccgagctgggccagncaggcaaccttnttagggtacgaccccatctacaaacgtnatctgtacaaggccatggctttgggaaaaactttcttaaaaggaaatccccataaaattcggggggtttggaactgactagttccctaataaacggggcccccgaatttggggtttccccgaaaaaaacaataaggttgggagtttaaacccccttttttcactcccggtggggaattggtttatggggggcccgggggggacaaagttgaaaaccttcccccccttttaagggagaaattcccccccggggggccccggggaccaaaaaattttttttctacaaaaaaaggggttccctctttttttggggggccatttttttcatcaacttttttaatttaaacccccggtgttataacaaataaaaacccccttttttggtatgccccgattaaaaaaggggcctttttctttttttctccagtcgtggtgggggatttttttattatacgaccggatcttacaccgttttttgaccccccggggaggagaccctttatccacgccttttgtttttcggcccccgagttattttttttctacaggcttggataattcctttggactcctcct

SEQ ID NO: 620703 - DNA, 238 bp, Homo sapiens
agctgggaccacaggcgtgcgccacaactcctgactctactgacctgaagtgatacaactgactggatcttacaatgtgcgagcaattatagatgtgagctcactcgagctcagccggttcacctattctgttgcttctaatgtgatgacatgacagtggataaccaccgaggactgcttgtgaacgcattattcatgttccaacaatgagagataatcacagtcatactgctccaca

SEQ ID NO: 620704 - DNA, 249 bp, Homo sapiens
tttctgcccgttctgccttctgcttctgctctgcttctgcgcttcctgcttccaaaatggccgcttcctgcttctgccgcttcctgcttcctgcttctgccatgtgatgtgcctgctcccccttcaccttctgtcatgactataagcttccggaggcctccccagaaaccaagcagatgccagtaccatgcttcctgtaaagcctgcagagccatgagccaattaaacctcttttctttacagattacc

SEQ ID NO: 620705 - DNA, 167 bp, Homo sapiens
gagctatagaaaggagtcgagacgcaggcaacattacaaagaaaggattggaacacagccaagagtacaggtcttctgataaggaagaataaaaaagaagaggttcatttggctggacttttcattcacctgcaaacactttttctcgcagtccaaatatcattccc

SEQ ID NO: 620706 - DNA, 634 bp, Homo sapiens
aagtgtctggccattggctggaacggcatcaacttgaggacagtagatcgtgctcagatctatggttgtctcagctgatggtgatggtggtctcagtagcatctgtcacacgagcgccttcttgggtgggctgagcattctccaggagtggagacaagtccctgtggcttctctgcttgtcaaagtgtccttatgagcatagacactcactatcatatttggtggccaccataagtcctgatatcgacaccgacggatgaggtgtcgaggagcaaggttgatttcgtattcgattggtccggtcttctccttgggggtcacccgcactcgatatccagtgagctgaacattgggtggtgtccactgggcgctcaggcttgtgggtgtgacctgagtgaacttcaggtcagttggtgcaggaatagtggttactgcagtctgaaccagaggctgactctctccgcctggattctgagcatagacactaaccacatactccactgtgggctgcaagccttcaatagtcatttctgtttgatctggacctgcagttttagttttggttggtcctggtccatatttgggagtggtggttactctgtaaccagttacaggggaacttgaaggcagccac

SEQ ID NO: 620707 - DNA, 336 bp, Homo sapiens
  misc_feature (27)..(27): n is a, c, g, or t
aaaggagaagaagcctcgtggggacanactccaccgtttgagccaacgacgccatgtatttattatagtaaaggttactgttttaaaacattaggtgagggtggtccatatcttatttgccatttgtctttaaaacattttacattatttgcatcataaattgtaatttttatgactatacataattggtttttttcctgacccttggaatgttagtttcatgtaactttttttttaatgggggggtggcagactaaatgtgctgataactacatactgaacacgtttaattaccgcagtaattaaaaagtcctgatctttacttcttaggatgaa

SEQ ID NO: 620708 - DNA, 1054 bp, Homo sapiens
cgtctgttgcctgccaccccagcaaggccctcattgccagtgctggcgctgatgccctggcccaggctcttcgtatgatgcccacctggccctgccctggccgccacgctggctggcggtgtagcggctcgcggtcaggtgcgggctgacgggcgactcctcagcctcgctggagcgtgcagcaggcctggcctctgtctgtttgccgtggagcctaggtaggtgctaacggccctttccccaggacatccctccccaacggctgccttccccaagcatccagcctggcggatggtgcccctttcaggaatcacccccgcaggatggccgtcggggtttccccctgctgccctgacagccgctcctggtatcacgagctgctttccagcagggcacgctcgagccagggccgggctgtcatcaaggggatcaggttattatccaaggactccagaaggctgcaggcttctcccgcttgagactccctgctcccccatcccccattcctcccagcagctgggcaggagcatgtgccgcgcggaccgggtggccgccgggcgcctccgagcctgagccccgggccctggctgcccgctcccctccgggccctctccactgcttctcagacactaaccgcgggcttccaggctcgcggcattcggcccaactctctcctatggggcaggcccttcccagtggctccgcgtgggggtcgccccattggttcgccgcctgggttcccttgtgcgcgctcccctgcggcagtggctggtgtggagctggggcttcggttcgcgccgtgctctcgccggatacgccttgcctaccgtaccggggacttttcccatgtccggccggaccatctcgcaataataccttggatggagtggatcccgctcgggaccctcgcatatttgagcttttcctctaatatatagctctctgacgaggtcaccctgagtccgcggaccaatcaggttcggtagatggtcccagcgactgtccccgactattaagactgtcacaatagcgttggtgctatatcaaacgaggc

SEQ ID NO: 620709 - DNA, 916 bp, Homo sapiens
ggtgtccgcttgtgccctgggcatgttcgatgagcgttctgacgttcatcgacatcaggtgacgaagatcagttttgcagaaagaggacagaattgagatgtgcggtcatcgtagtctgtcataatagagaatccttcaacaggctggtggagcattcgtgatttattctgaatgtctaatgtgagctgggatttcagaagagaactcggaaggttgaacttcatgttgatgttaggctacagattattgaagcctgtgatgtgtgtctgaaggaggatgatatagatgtggaatagtgtgatgaacaggtggtatccctagtcttgatccttgtgacccaggatgaagcaggaacgtcttctgaatttgaaaggcctatgttgaaaggggggtcaaattgaaggcgaatggtgaaatggccgctgtctcgtggaggactggcaagtgtgtaaggcacatgctttttccagtgtgatcggctaagaatactctctgtgaagatacaacaggtgtatttgcagccttattaaggagtgaccaggatcttgttggggccaagtctatgtaaatcaccaaagtgagaatggagtcaaggttagaacaatgaattctggagtggagtttcacccgtggacaaaaaagcaacagccttttaagtagtaactttgtgagtgtgcttgttgcatgtaagaaggagtgctgccgcctcagaaggtcagggggcaatgctccgcaagtcacccacagtacagatctttcccatgtcgggtttatgcccacggtctttgggccaccttgcagtttccacattctttttttgggccctcttcttgtcacacgcagttgagaagcttatcaaagtaacacttgtgcgtgcacaggacactttgtgtaacacaacactcaacagcggac

SEQ ID NO: 620710 - DNA, 237 bp, Homo sapiens
tacagagtgaatgtgctttcgtgctgttcgcttttgtctcttcgatcacccctgggcccaacaacaccatgttggtggcctcaggcgtgaatttcggctttcgccgttcgatgccccatgcgctgtggatcagcatcggcttcatgctgatggtgatttgtgtggggcttggcttggccgaggtgttcaagctgttcccgtgggcctacacgctgttgcgttatgacggcgccgcgt

SEQ ID NO: 620711 - DNA, 301 bp, Homo sapiens
accaagtctagagtgccagtcacataatctgtatttatttctccatacagacacacatcagtgattaattacaaatctataatgccatctttctctctcactggaatattatgtgctcatgaagaagctcctatgtctatctagtacctgatcgtctgcgctgcataacagattacctgtctcatagaaggtgcacaataactattttgttgcgtgaataaacaacgggaggaggagctgcaagagagctgagatggcaccactgcactccagcccgggcaacagagcgagaccctgcctc

SEQ ID NO: 620712 - DNA, 230 bp, Homo sapiens
  misc_feature (228)..(228): n is a, c, g, or t
taaatacagaagagaacaattttatgacaactttaataccaatatggaagacattggcagctttgtaagcagcattacacacaacatgagcaggacacgcaagaccctccattgcctcatccgtgctttgtttccactttgagtaaacattgtttgcacccctacacaaagatccaccaaatttttattttattatctccaccaaaagcagtaattttttgctattgntt

SEQ ID NO: 620713 - DNA, 355 bp, Homo sapiens
  misc_feature (4)..(4): n is a, c, g, or t
ctgngttagtctttcccagacaagcaaaaactagaccagccctacttgaactcccttaggcacttcttgtagggctgggctagtttttgcttgtctgggaaagactccgcctctccttcatttatgaaggacagcttcgcttggcagagtagtcttgactgccagttttcttttctttctttcagccctttgaatgtatcatcccattttttcctggcctgtagggtttctgctgaaaaattggctgtctgatgggggttcctttatatgtgacttttctctggctgtttttagaattctctctttgtcattgacttttgacagcttgactagaatgtgctgtggagaaaacttg

SEQ ID NO: 620714 - DNA, 374 bp, Homo sapiens
  misc_feature (22)..(22): n is a, c, g, or t
  misc_feature (35)..(35): n is a, c, g, or t
  misc_feature (97)..(97): n is a, c, g, or t
  misc_feature (101)..(101): n is a, c, g, or t
  misc_feature (110)..(110): n is a, c, g, or t
  misc_feature (118)..(118): n is a, c, g, or t
  misc_feature (293)..(293): n is a, c, g, or t
  misc_feature (368)..(368): n is a, c, g, or t
  misc_feature (374)..(374): n is a, c, g, or t
agcagccgtgtaccccgcagancgccagccccggnatgttccgagactttggggaaccggcccgagctccgggaacgcggcgggtacggcggccccngcanccccggcgnagcgcagnaagcccagcagaagttccacctggtgccaagcatcaacaccatgagtggcagtcaggagctgcagtggatggtacagcctcatttcctggggcccagcagttaccccaggcctctgacctaccctcagtacagccccccacagccccggccaaggaagtcatccgggccgtgggnggccctccaaggggtacgtcgaaggccttgtgaacagatcagcccggagaaagaggagcgccgccgagtaaggcnacgggn

SEQ ID NO: 620715 - DNA, 679 bp, Homo sapiens
  misc_feature (168)..(168): n is a, c, g, or t
  misc_feature (314)..(314): n is a, c, g, or t
  misc_feature (388)..(388): n is a, c, g, or t
  misc_feature (457)..(457): n is a, c, g, or t
  misc_feature (482)..(482): n is a, c, g, or t
  misc_feature (513)..(513): n is a, c, g, or t
  misc_feature (531)..(531): n is a, c, g, or t
  misc_feature (589)..(589): n is a, c, g, or t
  misc_feature (591)..(591): n is a, c, g, or t
  misc_feature (595)..(595): n is a, c, g, or t
  misc_feature (625)..(625): n is a, c, g, or t
  misc_feature (627)..(627): n is a, c, g, or t
  misc_feature (629)..(629): n is a, c, g, or t
  misc_feature (636)..(636): n is a, c, g, or t
  misc_feature (667)..(667): n is a, c, g, or t
  misc_feature (670)..(670): n is a, c, g, or t
  misc_feature (673)..(673): n is a, c, g, or t
  misc_feature (677)..(677): n is a, c, g, or t
aaacacagtgttatattagattgcgactatatcgctttaacactatctctgtcgctatccatatagttgtctcgtgcgcgatatctcgcgctattgtgtttagagatattttgtcgaccactcatagtgtctctatatagcgagtatattgtgcgctcgtgatgtgtnttctcatttcttcgtgtgtgttgtgctcctctgtcgctcgtgcatctttgtgtgatactcgtgtgttgctctctaccactctgcatctttttagtatctcgtgtgttgctctctaccactctgcatctttgtgtatctcgtgtgtnttgtgataagatatagatgtatagtagagagagatatatcatcctctcctctcctacatatttttcttcgtganataatgatgtatctacgatgatattcttctttctcctcataaatatcaccacgacgtctttgtctgctntataattagtgcttcatgcgacaanaatattctacgacgtcccacagaatacttcntacttcctgtgctcccgntgcgcccctatctttcgtagcgttgattcagaagaggtagtataacttcctgtcgtcncncacnatatatctctcgcttaccaacgacgcgcgngngngtgcacnccctacgtatgctgtagctaagcagtcgtcngcnggncacngc

SEQ ID NO: 620716 - DNA, 726 bp, Homo sapiens
ggagaggagatttataaacggagcaatcagcctggtctttcagcaaggtatggtccctcattctcatggagtcactgaaatcacccccccgtggaaaaagatgagtatgcctgcgatgtggaccatctgactttgtcgcagcccaaaatagttaagtgggatcgagacatgtaagcagcatcatgcaggtttgaaaatgccgcatttgcattggatgaatgcaaattctgcctgcctggtttttaatattgatatgcttacacgcttaccctttatgctccaaatgtagggttataataatgttaacaaggacatgatcctctttataattttactttgagggccgtctccatgtttgaagtatatgagcaggttgctccacaggtagctataggaggggtggccacttaaaagtggggatcatacaattctcttatcccacatcaacatcttggtcagatttgggctcttcaatctcttgcactcctagcctgttaagatagttcagcgtgcataagttaacttccgattttcaacccccgcttagaatttgggggaaaaattagaaaaataaatgacaggattgttggcaatttgttataattaatggaaccttttgtcatttaacactcaaatttccttcttattcatttgataaagtaaggcaagggtgtggtttttttggtttttttttgttccacaagttaaataaatcataaaacttga

SEQ ID NO: 620717 - DNA, 610 bp, Homo sapiens
  misc_feature (108)..(108): n is a, c, g, or t
  misc_feature (244)..(244): n is a, c, g, or t
ggctctctgctcctcctgtcgacagtcagccgcatcttctttgtgcgtcgccagccgagcccaatcgctcagacaccatggggaaggtgaaggtcggagtcaacgganttgtcgtatggggcgcctggtcaccaggtctgcttttaactctggtaaagtggatattgtggccatcaatgaccccttcatgtgacctcaatatacatggtttaaccatgttccaatttatgatttccacccagtngcaaattccagtggcaccgttcaatggctgaagagaactgggaagctgtgttcatcaagtggaaatcccatcaccatcttccaggagcgagatccctccaaaatcaagtggggccgatgcttgggccgcttgaagtaaccgttccggtttggaaggtccacttgtgggcggtcctttacacccaacccattggacgaaacggcatgggggcctcatttgtgccagggggggaagcccaaaagggggcatcatcattcttcgttggcccccctctgtgttgattgccccccagtgttccggtcaatggggtgtgacaccattggcagaagtattgacaaacaagcctccaagatcattcagcaatgc

SEQ ID NO: 620718 - DNA, 224 bp, Homo sapiens
gtgcccaggagtagaggggcaggtcttccatgtgtgagccaataggaccaggtggcaaggcgaagagggacaagcagaggacggtgctgagagccacctgggctgtgaccacagcaggaaaagagctgcgatgcaccctccgttcaccactcctcctaaactgcacttccatgctgtcagcttcccgaagcatggctctccagagctcccctttgccaggcctt

SEQ ID NO: 620719 - DNA, 362 bp, Homo sapiens
  misc_feature (116)..(116): n is a, c, g, or t
  misc_feature (165)..(165): n is a, c, g, or t
  misc_feature (268)..(268): n is a, c, g, or t
  misc_feature (276)..(276): n is a, c, g, or t
  misc_feature (309)..(309): n is a, c, g, or t
  misc_feature (324)..(324): n is a, c, g, or t
  misc_feature (347)..(348): n is a, c, g, or t
agaatcatttgaacccgggaggcggaggttgcagtgaactgagatcgagccactgcactccagcctgggtgacagagcaagactgtctcaaaaatggaaatggaaaaggaaaaacnaaaaaaagtgatactgtgttttgaatacagttttgaaaagataagtggntattacttggggttgggaagtctgagaagacgtgcccgctcacatgctgctgctgagaggtgctaaaacattctgaaaaataagttggctgggcctgacacantggctcangccttaatcccagcactttgggaggccgagtcnggcagatcactcgangcaaggagttcgagacagcctgnncaacatggtgaaac

SEQ ID NO: 620720 - DNA, 336 bp, Homo sapiens
atttggggggtttgtttgggtccccaaaggggggggttttgtttttgttcccctttggttaaggttgggcccctcccctttggctttccctggagacccaaatttttaaagggccccccaggggtaaggggggaatgggccccctgtttatccgggtttttggggaacctcccctgggggggaaaaaaaattggggttttccccgggcggggtggggaccccccccccccccccttccccccgggtcggggccctttgttttccccttcaaaaatggggtggggccggccctttcccaatgaaaaaatttccccttttttaataaaaaaagtttta

SEQ ID NO: 620721 - DNA, 678 bp, Homo sapiens
agcgggggggggcgccgccaggcggcgatgacacggcgccgcggcggccggaggcgccgggtgggcgtttgctgaccggatcgcggctacccgccagcgtgtcccgcggcgcccgcgcagcatgggctgtgccccgagcatccagggggccgacgcctggtggccgaggacgcgcctagccccgcggcaccgcgtgtcgtccggcgggccggcctcccgcagggccagaagacggccgcttgccccggacccgcggcgccggctctgggagtcggagcttcgcgacggcagcggcaagaaggtagcagtagctgatgtgcagtttggcccatgagatttcatcaagatcaacttcaggtacttttagtgtttaccaaagaagataaaccaatgtaatggattctgcagggcatgtgaacaaaagcaggttaagtgtacagttaccaaggaggctcaggctgtccttgtcctgtttcctgggacaaaccatcatgacattatcatcatagaccacagaaatcctcgaccagctggatgccgagggccctgtgcaggtctatcagatcatcaaactctcagaaaacacaggttattgtgggttgtagtaccgcagggtggatagagaagactcgcccgtattggctttcattctctgctgggtttcaggaggtttgtaac

SEQ ID NO: 620722 - DNA, 154 bp, Homo sapiens
taaagaaaatcttaacctggcaaacctaaaactaaaacaacccattgacagcacggccccccagtttaaaaaaaccaaacgttctttggctagtggtgaattctaaattggaaacccactgactaaaaaagggggactctaagtatttttaaaa

SEQ ID NO: 620723 - DNA, 125 bp, Homo sapiens
gtcagctatttaattaggtttctgtaagacatttagaacaccaatttgtgaggatgagatgccgattcaagtagagcaacgacagatcacaggtagcgcatggtagctgaggatagcttagactt

SEQ ID NO: 620724 - DNA, 117 bp, Homo sapiens
  misc_feature (55)..(55): n is a, c, g, or t
gggtaacacagtgcggtgagtctctgcaaagcgaaggaacttctgtgtgtcaggnggcaggcttgaggagatgtgcatagatcagggctcccgggagaagaatggtcagggaggaag

SEQ ID NO: 620725 - DNA, 271 bp, Homo sapiens
cgtggcgctgtgtgcagaccgggacaacagccctctccttacctcccatcccccatcccgccccttccagcctcccaagcacacgccctcgcccccacccgccccccgcgttaattcgcgccatccagggcgctctgtgagtctgtcattacccagcgcgagtcaggcccctcctgtgcccctcgccagccccgaggggcgcccgcacacagtcggcgccccacacgcaagtacctggaagagaacaagaggacgccagcgggcgcggccg

SEQ ID NO: 620726 - DNA, 723 bp, Homo sapiens
  misc_feature (32)..(32): n is a, c, g, or t
  misc_feature (36)..(36): n is a, c, g, or t
  misc_feature (62)..(62): n is a, c, g, or t
  misc_feature (66)..(66): n is a, c, g, or t
  misc_feature (73)..(75): n is a, c, g, or t
  misc_feature (79)..(79): n is a, c, g, or t
  misc_feature (82)..(82): n is a, c, g, or t
  misc_feature (88)..(88): n is a, c, g, or t
  misc_feature (91)..(91): n is a, c, g, or t
  misc_feature (110)..(110): n is a, c, g, or t
  misc_feature (115)..(117): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (130)..(131): n is a, c, g, or t
  misc_feature (133)..(133): n is a, c, g, or t
  misc_feature (140)..(141): n is a, c, g, or t
  misc_feature (149)..(149): n is a, c, g, or t
  misc_feature (151)..(152): n is a, c, g, or t
  misc_feature (154)..(154): n is a, c, g, or t
  misc_feature (173)..(173): n is a, c, g, or t
  misc_feature (179)..(180): n is a, c, g, or t
  misc_feature (186)..(186): n is a, c, g, or t
  misc_feature (189)..(191): n is a, c, g, or t
  misc_feature (204)..(204): n is a, c, g, or t
  misc_feature (219)..(220): n is a, c, g, or t
  misc_feature (226)..(226): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (241)..(241): n is a, c, g, or t
  misc_feature (243)..(243): n is a, c, g, or t
  misc_feature (247)..(247): n is a, c, g, or t
  misc_feature (251)..(255): n is a, c, g, or t
  misc_feature (258)..(258): n is a, c, g, or t
  misc_feature (260)..(260): n is a, c, g, or t
  misc_feature (263)..(263): n is a, c, g, or t
  misc_feature (269)..(269): n is a, c, g, or t
  misc_feature (289)..(290): n is a, c, g, or t
  misc_feature (292)..(293): n is a, c, g, or t
  misc_feature (297)..(297): n is a, c, g, or t
  misc_feature (302)..(302): n is a, c, g, or t
  misc_feature (305)..(305): n is a, c, g, or t
  misc_feature (309)..(309): n is a, c, g, or t
  misc_feature (312)..(313): n is a, c, g, or t
  misc_feature (316)..(316): n is a, c, g, or t
  misc_feature (343)..(343): n is a, c, g, or t
  misc_feature (348)..(348): n is a, c, g, or t
  misc_feature (359)..(359): n is a, c, g, or t
  misc_feature (541)..(541): n is a, c, g, or t
  misc_feature (556)..(556): n is a, c, g, or t
  misc_feature (575)..(575): n is a, c, g, or t
  misc_feature (583)..(583): n is a, c, g, or t
  misc_feature (610)..(610): n is a, c, g, or t
  misc_feature (616)..(616): n is a, c, g, or t
  misc_feature (621)..(621): n is a, c, g, or t
  misc_feature (631)..(632): n is a, c, g, or t
  misc_feature (639)..(639): n is a, c, g, or t
  misc_feature (707)..(707): n is a, c, g, or t
gccaggcgctttctcggacgccttgcccagcngccncccgaccccctgcaccatggaccccnctcnccccctnnngctntcnattctnctncttttcctgacggaggctncactnnncnatnctnctcannanccaacannaaataacncnnanatctgtctcctgcccctanactacnnaccctnccnnnccctacttctccnttactactaccacanntacacncananctnccnccantncctntacnnnnnctncnacnccaacnccaacaatttctacacctcnnanncttnccacnatncttnctnnacnatacaaaaacttcccaaactttccccnctccnactcactctcnaccaccactctcacccctccacacaaaactatttctttaatctaacttccatcacatctcaaaaattcttttcccctccctctcaccccaaccccattcacaacacctttccacatcaacctacttcgtatcgcgcgttctcgccgcaccaaacgaaaaattcccatgcatttttccctacnactccaaaaacatcnaccccactcctcgctctcnccaaatcntcgactcccctgatttattttttaatnccaacnatganacgaaccctnntcgatcncttttccaccctgatgactcccgctcgtcccaccccgatgcgacaaatgaacttttcgttgacgcacncgaccgatttcgcaaa

SEQ ID NO: 620727 - DNA, 609 bp, Homo sapiens
cactaactcagctgagtagaactgagtgaatgtcgaagaagatatgaagaaacccaaaaagaagtcacaatttaaatcagctgttgtaacacaaagaagggcagatgtgcgacatctggaagatgatagagcataaaagagagaagatacaaagactcagggaagagaatgatattgctaggggaaaactggaagaagagaagaagagatccgaagagctcttatctcaggtccagttacattacacatctctgctaaagcagcaagaagaacaaacaagggtagctctgtaggaacaacagatgcaggcatgtacttgagacttcgaaaatgaaaagctcgaccgtcaacatgtgcagcatcaattgcttgtgattcttaagggagctccgaaaagcaagaaatcaaataacacagttggaatccttgagacagcttcatgagtttgccatcacagagccattagtcactttccaaggagagactggaacagagaaaaagttgccgcctcaccaaaaagtcccacagctgcactcaatgaaagcctggtggaatgtcccagtgcaatatacagatccagccctgagcatcggaactgcttgtcatgtg

SEQ ID NO: 620728 - DNA, 277 bp, Homo sapiens
gtgttcatgatcagcctgggcaacaaaagcgttggagaattttgctccttagttcagctaaaatccggttcttgtcacacaaccatgaaaatttagacatgaggacaggacacactaaagggtgagtagagcaaggttttattgggcaaaaagggaaaaaaaaaaattctcagcaaagcgggatggagtcctgcttacaggacccccatctcacagatggaatcccaggccctcacccaggaactgaaaagagaagctcctccccagagagccggaa

SEQ ID NO: 620729 - DNA, 405 bp, Homo sapiens
cgggttcatatattgagtcgttaaacttccaagaaacgggcacttcatcagtggcatctgtcatttagcatattggacgtagctaggagcgctattgacctagatcttggccgtccgactgtgtagtatgattcttcacctaccaaagcatctagttctctgtcgtcacgtcattctattggtggagaatttactctccacaagctcgcccatccccctggctttggcttactggcctgtcgttttcggtcttttctccgttcatgattactgtcacgatgtgtcttgtaccgtttgtcacgcctgggtctatacagaccgctgcgaggacattcggctatgtccccttctgctagccagtgtcttcttcaagctctcggaaaggagcttcttctggtgtttcac

SEQ ID NO: 620730 - DNA, 852 bp, Homo sapiens
gaatggtggctcatgcctgtagtcccaatgctttgcgaggccgatgcgggcggatcacctgaggtcaggagttcaagaccagcctgaccaacatggtgaagccccgtctctcctaaaaatacaaagttagccagacgtggtggctcatgcctgtactctcagctactcaggaggctgaggccaggagaatcacttttgaacccgggaggcggaggtgcggtgagccaagatcatgccattgcactccacctggggcacaaagagcgaaactcggtctcaaaacaataaacaaccactaaagacaaacatttttcattggacccatctccccgcaaggatgtaaacctgaatcattttctatcatatcacttaggtaaaacataaaactgggtatatatatacaaaaaaaaccacttctttaggcatttggtgcttatacctaagccttaaaatcaaacgtggtgtccaaaagtagataattgtaaaaccgtgaatttccacctgactgtgttaacctggaaaattgtgtgggtggtgattatgctgaactgacacttggaggaattgggggtggtcggcaaaggcacaggaattcaagacgaaggaagaacccggaacgggggccttaaggggcccccgagtggggtgccctaaactgggtggtacggaaactggggacaaccccagaaagagaaccaagaaccacaccacagcccagaccaacagactgcgtaggtgcggccgccccgcgccccccgacagaagagattcttcgagacacacgcaggtgggcaggcacgccacgccaccccaggcaaccctcgcgcgcccgcgggccaccaggcggggtcc

SEQ ID NO: 620731 - DNA, 249 bp, Homo sapiens
actcaggcgactccaaacagccagctaccaatgcaggtagagggctagtaggggagggccagagcccagacagggtcatggggctcagaccagaccactatagagaatcactctgaggctccaacttccttcctaaccttcggggccagtctcggccgaagtctggtcacgctcagacagagctgaccagaccaaaccgcatgcctatacaagcattttagccctgctaacaagatgagcttctaccga

SEQ ID NO: 620732 - DNA, 126 bp, Homo sapiens
ccctaccacccaactaggagggcactggcccccaaacaggcataccccgctaaatcccctagaagtccactcctagagacatccgtattaactcgcatcaggagtatcaatcacctgagctcacca

SEQ ID NO: 620733 - DNA, 366 bp, Homo sapiens
gtattagaatgccagagcgcctgatctatattggttcatcccaaaaaacccacactaacaacacccgcctcaagaatgcattgctgtaattacctacgtacatgcccccaacgcaacgctgcccaatgtgtgcggcgtacccgactcaaccccaaccaattcgaaagcctcacgagccacagctccacaagtgcacaactcactcacaggtcacagcccatccgccagccacgcgccggtcgtactcatcgacgacgctcgtgtcacactcatttcgcgcccttgggggtgagcccgaagccgaagggaaagagcgggtcgtagtgcttgtcgcccacgttcaggggcagatgagtccaccgattt

SEQ ID NO: 620734 - DNA, 295 bp, Homo sapiens
tgcatcagggtctgcggggcatgatattcttccattagatcgtcggattttttgtaggacggctcgagggtcagcatatgagtaatgatgccggcggcattatacatatgaaaatgcgcaccgccaggcatttttgtctcggtatctccagcggagagcaaagatccctcgcgccacaaggcgatatgcaccggcggctccagaccaaagccaccgcatatagtgtcaaaatcaaactcgagctcgccctgcattttttagcctagattccatcctattcttcgatggcttcgtt

SEQ ID NO: 620735 - DNA, 592 bp, Homo sapiens
  misc_feature (206)..(206): n is a, c, g, or t
  misc_feature (539)..(539): n is a, c, g, or t
  misc_feature (561)..(561): n is a, c, g, or t
  misc_feature (573)..(573): n is a, c, g, or t
  misc_feature (582)..(582): n is a, c, g, or t
  misc_feature (586)..(586): n is a, c, g, or t
acgatggttggcaagatgaccccaccccaaccagcgattcctctgtagcccctagccagaagcagactcagtacataaggaccatttcacatgtgcctatgattgcaaccccaaaccaatcagcagcacccattccctagcctgccgtgtgccaaactatacttgaaaaacctagctggggctgggcgcggtggctcacacctgtnatcccagcatttgagaggccgaggcaggcggatcacttgacatcaggggtctgaaaccagcctggccaacctggcgaaaccccatctccactaaaaatacaaaaattacccaggtgcggtggcacatgcctgtaattccagatacctggcaggctgaggcacaagaatcacttgagccctggaggtggaggttgcagtaagctgagatcctgctgctgcactccagcctgggagacagagcgagactctgtctcaaaaaaataaaataaaataaaatccagctggatgccgcagtggcacacacctgtaatcccagcactctgggtggccgangcaggaagatctcctgaggtcnagagtgcaagancagccttgncaancatcgt

SEQ ID NO: 620736 - DNA, 429 bp, Homo sapiens
gtgcgatctcggctcactgcaccctctgctatccgggttcgggcggttctcctgcctcggcctcccgagtagctgggattgcatgtgcccaccaccacgcccggctaatttttgtattttttagtagagacggggtttcaccatgttggccaggctggtgttgaactcctgacctcatgatccaccatcctcggcctcccaaagtgctgggattacagattacaggtgagcaacgagcccggcctttttttttttttcctaagattttgagaggtgaaaattaccaagtaactatgtgattagggtgcttctacttgtaagaaaaagtgagtgactacattttgcaattcagtgctgggtcagaatgagagtatattaacacccagcttcaagtgggaagggaatattcacaagttacagctgtgctac

SEQ ID NO: 620737 - DNA, 242 bp, Homo sapiens
  misc_feature (21)..(21): n is a, c, g, or t
atgtgtgtgtgtgttacctgntacttgttgacagagggaagagtgtgagtgtctgtggaaccattgcggatagtggtgctggcacgtacaggttgaccaagtaagagaagccagactctaagactatgtttctgggtgtcaggttacaggccagaactctctctctctctctctctttaacaaggccaatgtgtgtcgacagccacacattactcccagactctggtcaaatgaatatatac

SEQ ID NO: 620738 - DNA, 787 bp, Homo sapiens
gaatcacgtggctgccacccaggtaagaaagaggccgctcttcctggggttcgtgtctccgtgtgacgtgtggcctttgagatcaactctcctgtaccagcgtatgccgtagtgatgtggagagggcgggttccccgcggtcatgttcgtgcaggagggagggctctctgctcctgtctttttgttgtggatgccggcgctgctgcctgtggtcttccctgcgctttttgttgataccccgagtcttgcttgatccatggctctctggaaggccctccgacccaggtcctcgccgggctcgagtttccagtggtctcggctagtgttcgcggtgctcgagatcgttctgccgcgcttttgtttggttgcgctcacccgagaacggtcgccccggttgagtcgcccagggcccgtggtggaagaagccgctttggaaggtctggcggtcattctcattccctcatgataacatccgtctattgaggtgggatagggatgatcaggagggcctgacacgtgcatgggtgctggttgatgatttacaagccatccggtgccttgcctcccaatgctttgacacggatgccgttcggtcttgtgccaccctttacgaggggggccggaggtatttgcattgcctgttgtgaccggggggaacctgtccgtacggtccgtgggtgcgcaggggtccgagtcagttctgatctctcacgtccggcatgagaccctgtccgggttcgtgagagcccggggagtgaagctctgcttcagggtgttggcccacatc

SEQ ID NO: 620739 - DNA, 134 bp, Homo sapiens
ggctagcgtggacacgtcacgacggaccttgagaggctgctgcacataaggtctttgaaggaaatcgcccaacaaatctattgtgtacacaaagctcacacattcatgcttgtagccttggtcgcaatgtatga

SEQ ID NO: 620740 - DNA, 415 bp, Homo sapiens
gcggggctgtatcgctggctcttttaaaagtgcgcccacgccctgatatctttgaagtttggattatgctcttctaatttccaagaaaatcttgggcatatatatctactttcacagttatccagctccagagtctctagactgtccattttctccttctctggaaacaatgacatctaggtctccggccctgctgagggggtggggggctccgcctgctagtgggacgcggacatggaccaggccccccccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagagca

SEQ ID NO: 620741 - DNA, 726 bp, Homo sapiens
  misc_feature (552)..(552): n is a, c, g, or t
gggaatgatgaaaaatgaagaaaataaaaatgatctctaattatactgctgctattatttttctttcccttttggtgtggaggtgggaaacaagactcagatcacttgtgcttgttttaatatattatagacctgtacaaaataatttcaaataatttatgtagatactttgcctccaaggaggtgtcgcataactctctattcttatgggtgagttgtgtgtaatgacttccttctaagaagtagggtatggaaaggggaaaaaagcaattttacagcagagaaacctgacaggcactacctcagccaggtgatcaagattaacattaacaaccacaagccatgtcgatagcacatacccttgatatggtgggatgagaatggcactttatctctgcgttctttctccccaaaagacataacctttgtctaaccaggaggcaaacatcaggcaaatctcaactgagggaccttctacaaaatacctggtcagcactcctcaaaactgtcatgaattaggtgcttatcaatctcatgcataatgtcacatanttgttatgtatgtgtccccagtattgtcgcatcttatcaaatttctgtgggcacgtcgtgaatagtagagactgggtttcagcaagtttggcaggctggtccgagctcctgactcaggtgatccgccgtttcggcaccagagtgtcgggatacaggtgtgagcctccgacctgg

SEQ ID NO: 620742 - DNA, 191 bp, Homo sapiens
aggcagaggcacaataaggaggtgggtggcgggggagcaacggaaaaggttaacagtctggagagcaagggtcgtccctccagccactgatttcaccacccaggatgtggcgcatgggtcctcaggggtgatatctggggctggttccgggtctgggtcccaggtccccttcgttggtgcctcatggggga

SEQ ID NO: 620743 - DNA, 550 bp, Homo sapiens
acgctctagccaagccatactccagcaggagggcatgtcggctattcagcctatagccgccgacctttaagatattccacgtcaggacaaaaaaggccttctgggcaaaagttactttctggccagatcagagagagactcaaaaaatgacttgacatcacagttacagctgacaaagcctcagagtctcctgggtaaggtcatctgtcctcttgcgggctatcccaccagagctctggccctcgggtcatgtggagatccacctgatatttctgttgattgtcttcagtgtgtataacattactgattgccagacctcatctgccttactttaccagtatttgctggccgtcgtttaaaatcgttttggacggggactgccaaaatccgtgagctctacacagctgcttgtggtctctatgtttgctggctaaccataagggctgtgacggtgatggtggcatggatgcctcaggcacgcagagtgattttccagaaggttaaagagtggtctctcatgatcatgaagactttgatagtagcggtgctg

SEQ ID NO: 620744 - DNA, 344 bp, Homo sapiens
taggggacagaggtgatggactaggtgattgataggaagttttacttcattatagtcttatgggacaatggttgataggtggtctgctgttgaccaaaattttatgtggcacgtgactatattgaaggaaccccttactatcttcacattttaatgaaaggagttaaattggatgatctctaggatctcttacagttctgaaatagtgtgacttaaaaatgctagaagaccacttagctaaactctttcatttacaggcaaaacggacccagaaattgaatgtaacctgacagcctggagactgaactgggattaggacttgggtcttttgagtccccattcag

SEQ ID NO: 620745 - DNA, 153 bp, Homo sapiens
  misc_feature (150)..(150): n is a, c, g, or t
cgacgttaacctgaccttcttttctgacggcctaactaacgaaacaacgacaacgctcctgtgtgtacttttacgacgcacggacttctgtcactcaccacacgctctcgactacctggtcactacacacacttttacactttacaacgncac

SEQ ID NO: 620746 - DNA, 261 bp, Homo sapiens
actatacaatcagctctgtaccttacagctgtgctgtaacacaagtagatctgatcttcaattaatccacacatcattaatgtattctatctctctattacattttggtctctatactacattattaatgggttttgtgtactgatacaataatttagctgtttcaaactagtgcattaattgattctctcctgattatttttcacatatccccttagccagttgtattttattcttgttggtttgtgtacccaatttagt

SEQ ID NO: 620747 - DNA, 175 bp, Homo sapiens
aggtttacagtaaatttttctaaagaaagctgtgtcttctagtagacccagacgaatagggcacagccctcgtcacttgcacgtgccttctgtcattgggaatgatatagattattacgagaaagggacttgtcctagctgggtagaggccttacagttgtgtatctcctttctt

SEQ ID NO: 620748 - DNA, 1441 bp, Homo sapiens
cggtgatgtctgctgtgcggcgcagtgttgctccgccggggggtgatgcgttgtggagatcacccaacacgcctgttcgttcgagcagcttgcctgcgtgttctcttcatattgttgttatgtaccctccgctgtccgcccctctgtgatcccctctttttgataggggggaccctgtattcatggcgccgtccctttctttaatggtggccctccttcccgggcgtgcctgtgtgcccacccacgtggtggtggtgtatgcctcgccgttcgatctactccgagcgtgtctcagttgataggtggtgcgtctgtcatccatatgacatgattatgggggcgcgcgctcgtttggtggtgctgcccgactgactcgccgcgttgagtgatccgccatcgtagattatgtttcccccctccctgagtagtttgtgtggccggccgtcggtgtggtttgttgtcaatcacgctcggcgagggaggtggggtctcgcctaccttttttctcctgacaaggggcggcgccgctctggctatcattaccgcacttacgtcgcgccggttcggtgcttgccccccacatgtagggggggcgcctgctttcttagtagtaattatttctcgtggcgggtatgttgttattgcccgcccgtcatcttgtttagtgtttgttccgccccctcccccgaggaggtggttgtgtgtgtgttgtgctcgcacagcgaggttgtgtttctgtgatcggcccactcgttgtctcacacgtgtacaccggccggtttaggccgcgcgtatgcttcctccccctctcttttagagaggggcgcgtccctggagcgcgcctctcacacactgagcgcgttctcccccccccgtttgtatttgtctcccctccgtcgggagtgtgtcgcgcctctctctctctagaaacagcacactcgccgctctgttgattctctctcgcgctctctcgcgaggtgtgtctcatctctctcgcctcgcgggtctccccctcattttgttatatagggacaccgcccgcggacccccactattatgtgtccagcccccgcgcttgttgtgccgcaccttgtttcgcgcggtgtttctcttgttgtgccctctctctctctctcacacagcctcctcgcggtgttctttcgggtttccccttccccctctttccccggccttttcgcgggccacacacactttttgggggcccccgcggtttccccgcggtttcccgctccctcttttggggccccttttcccccctatatgtggttctatcccccccctcaaatttccccttaacacacccccaacactcacccttgggtttgaaaacccccccccgagatatatctcggccttttttaaagaagtgggttgagaatatatttttggatatgtttcccttttttggaggggggtttta

SEQ ID NO: 620749 - DNA, 1787 bp, Homo sapiens
aataataatagaaaaaagcaacatataagaaatagaagaagaaaaagaaagaaaaaaaaaaaagaaaggagagaagcgagagacagatagacgtgatcgcatgaagcaggagagagagagagaaggagaagagagaggagagcccgagacggagaaggcaggaccgcgcacggacgaacaccgagacgagcaagaaccagtcgtccatcccacagagccgcgacgccccgcagacagacacggccacgccacgcagcgccggcaggtacgcggccacggagcataggagagaagcatagccacgaggaaggaaaggccccacgaggacgacaggagcgacaaccagcgcagccgacaagacacccaaagcagtcatagcgagcccggtgagtgacaggcaagaagacacacgccaacgtgccacacagaccgaaagaacgacagaccagactgacactctgcgaacgcacgagagagaggagggcggacaaggcaaaacgcgcagagagaccgagacgagacgcgcgaacgaccgacggatgagagagcgaagagagaagatgagccgcacgagccacgagcgacggaaaaacgccgaccagccgaacaccaacggagccgcgcagactgaagccgagacgactccagccgaccagtagagagaggaagagcggggatggaacacccaacgacgaaccggcaaccagacaaggagagagatagaagaaccacgcacaatagacgatgcctccagaaagcaaggcagagaccatgccgacccgcaacaagcacacggcagcaagagcaggacgacacgagagacacagacagcaagagaccacctccatcccgtggaacggacccagtaaggaccggaagcaagaagaggagcacggaacagaacgaaacgcgtgcaccggcctaaccacccatcacgcgacggcacgggcacagcaagaccgagatcggcaacggaagcgacacgagcagagagagaacgacacatcgcccagaccgatccagccgtgcatctcgcaaccaccagatcctccagcatacgagcacggagtcgacgagctcgcacgctcacatccaccatgcacgcgacgcgcagctcgagagagacgacacgggcgcgaagagcgaagccgacagacgacagcacctgatcgagcaggagactctcacccgcacgaacgcacgccgcagcgaggcaagtcagagacgacacccaggagagagctcacgtcaggtccacaggcgtgggagggtgggtgatacgcaagacgaggctagactgacgaccgagccagacgacacgggcagacaggagcagcggcacgtcacgaggagaacgagagcggcaagcgctagcacgcatgcgaccgggacacaaacggaggaggccagagcagagcgtgggagagacgcgtagcgacgagcgagagcgctccgcagagacaggacaggcaaagacgagagcagcagacagaccagaggacatcagctaccaacaagccagagcacacagctcacgccgcaagacactcagactaagccgacaccaggcaagagcgagaagagcaggagaaggacatcgaacacgcagctaacacgcagcagaacgctacccccagcacagagcagcatagacgcagatagagcagagccaagaggagagctgacgagaggacagcaggcctaggccgttacgtcagacggacgaggagagagcagagcgccgagacgacacgacggctggtaccggtacgaagaagaaggggctg

SEQ ID NO: 620750 - DNA, 176 bp, Homo sapiens
  misc_feature (10)..(10): n is a, c, g, or t
taggctcggncctgtgatcgggtgtgactattcgcaggcgggttatgaacttgaccaacgtactaccagcaggacccagcgtcctaccagtcctactctcggcaaacgattgcagtgccttcctacgtccttcccgtaggtcaaacacatcaccgttgcattcagtgttactagta

SEQ ID NO: 620751 - DNA, 269 bp, Homo sapiens
cgggttctatctgctgtccagcctcacggatgcggcaggccacagcagtttatagcgccgcccccttcccgctgccatcctctgactggaggagagacacatcacccatttccggagccagcgtccttcactgtctcagtgcgtaacttatggcaagtgaggatgtatcttgtacgagggtcccatccaaaccctactgtcactttcagagcgtccagcccacggttttctcgtatcctgttcaccacagcgggcatgcctgcgccaca

SEQ ID NO: 620752 - DNA, 414 bp, Homo sapiens
aagcatacgacaggcagctccagtcatatgtcatcaggtacggcaataaaacaacaatcagaaaccactagacagactattagaagggccaaaattcagaatactgacgacaacaaacgtaggatgtggaagggcaagaacttttattcattgctggtgggaatgcaaaatgatacagctactttgaaagacagtttgtcttacaaaattaaacatactcttaccatatgatctagcagttttctccttgattaacccaagttaattgaaaactaatgtctacacagaaacctgcatatggatgattatagcagctttattcataattgccaaaacatgggagcaaccaagatatccttcagtaggagagtagatcacagtggcatatcctgacaatggaaaatcattcagttc

SEQ ID NO: 620753 - DNA, 419 bp, Homo sapiens
tttcaaataattaagaataattattttttatacaggacacattatgtttccacagtgcaattaatcttggaagcaacaacataatgttaatgaaaaatgtaccatgtgcttaggcatttaaaaactcatggctggacacagtggctcacccctataatcccagcactttgagaggccaaggtgggtggatcactttaggccaggagttcgagaccagcctggccaacatggtgaatccccgtctctaaaaaaaaaaatgcagaaattagtcaggcttggtggcacacccttgtaatctcagctactggggaggctgaggtgggaggatggcttgaagctgggaggtggagattgcagtgagccgagatcgcaccactgcactccagcctgggcggcagagcgactccagctccaaaaaa

SEQ ID NO: 620754 - DNA, 150 bp, Homo sapiens
atagactagagttcctggctggaacggacttcagagccatgtctaagtcacgggaggaaaagcaccttcatccacagagaagcgggtgttggtgacggtccagtttggagtgcgtctgcgtccacagcccgactctggccggtagccatt

SEQ ID NO: 620755 - DNA, 274 bp, Homo sapiens
gctattcactagggcttctgaaatctgccagactggtctaagggaacaagcctcctgagggtatctagcatttgctactgtcaggtgccacctacacataacttactgtagccagacttttagtttcactctatcttagtcattgtccagatgttgctttagtgtttaccttataggctgtcttgtattttgaacattctcagaattatacacacatgtgggtctagggaaaaaaacaagggacttttccggagaaaaattttttccttacccc

SEQ ID NO: 620756 - DNA, 140 bp, Homo sapiens
tatatcgcaagggaccatcggcgtgtggagtctccatcctgttcggacatgaaaaccgtgttagtactctacgagtttcccctgatgggactgctttttgctcaggatcatgggatcatacactcagggtaagagacatg

SEQ ID NO: 620757 - DNA, 817 bp, Homo sapiens
  misc_feature (270)..(270): n is a, c, g, or t
taatacattatatgtctgatacatatacggttgggaaacaatcaagtaacaatgaaaatgtgaaagtacccatatctgacaaaattccctgaatttttatccttggctggcaacatttaagactcaaagtcacgggtatatgggattaagttttttccggtaagtgcaattatagaaatacatcggagacacaacaatgggtggccattacgggtttcataaaattacacggactgggcgtgttactggatcttaggaaacagcacagtnttaagatatggtgaattctgacttatactttatataaaggcttgtaaatctaaatagatccggtgggatgtgaggggtctagtccagttatatttaagtccaggttccactgtgggccacttggttggaacacggggttatcgcctgatgtaaacggttcgagtgaagaattaatgcgtagtatgacaacaatacacattgcctctccccatctcagaagaggggagccagagtcgagttatctaaattgatgtgggcacaagtggcaggtgacaacgctaacaccttgcggtctgttgtactaagagcaggtcttgaacttctgtcctggaaagatttctgttgggtcgaatggaattccaatgcatcacagtgcgggttcaactgcttagccagggcactttagtccccaggacggctcgcaggggcggtggtgggcagcgacagcacctctgtcctgggcaaggcggggtcccagacgactcgtggcccctttgccacaacaatacttcgtagtactacagtcaaacatgcgatcctccgccga

SEQ ID NO: 620758 - DNA, 552 bp, Homo sapiens
  misc_feature (518)..(518): n is a, c, g, or t
  misc_feature (544)..(544): n is a, c, g, or t
ggtgaatactatttgcatctggcactgttatgagttggatcactgtgttagaattcgcaggttttttgcagcgccgcaggagcggctgttatcgtaaagctgcggtaacgacacgcaattgtggctcttttatccagaatagccgctaaaaaaggcatgatgccactatctcagtccaccactgcccgcacgttgaaacatacgcgtgcgatcactatcgaagcgttttcccgtgatgatggtttgtgggattttgacgctcgcataacagatcacaaagaacgtgatatccagctcgcttccggcactcgcccgcaaggcgtggctctgcacgacctgactttgcgcgtgacggttgatttgcaaatgaatgttgttggcgtggctgcttgttcagatgcggttccataccccggatattgcgagtccatcgaccctgattataaaaaactcattggtttaaatctgatgcgccagtttcgccagggcgttaaagaccggatgtccggcattcaggngtgcacccatctgaccgagttagcgnagattatg

SEQ ID NO: 620759 - DNA, 227 bp, Homo sapiens
  misc_feature (17)..(17): n is a, c, g, or t
gatactactgtggtgtnacgttaggactgtagtcatcaggatacacgtggcagttgtggggcctgtgctacagtgctaagactcaagctgtgacggaacatcacgtgaagctcagggtccttcccaccgtggtccctgtgtaactggactggtcacatcctcacgaaacccacccttggtgggaagaagagatggagcccaaatgtggcaattctgggcaccaaagg

SEQ ID NO: 620760 - DNA, 305 bp, Homo sapiens
tcaacgctttatacttccccagaggtgagatacttaattttatttattattttgtgttttggtttggtttgtttttgagacggagtctgctctgtcacttgggctggagtgcagtggcacgatctcggctcactgcaacctccgtctgccaggttcaggtgattccctggcctcagcttcctgggtagctgggattacagcacgtgctaccatgtccagctaattttttgtgtttttagtagagatggggtttcgccatgttggccaggctggtcttgaactcctgacctcaagtgatccaccga

SEQ ID NO: 620761 - DNA, 701 bp, Homo sapiens
  misc_feature (441)..(441): n is a, c, g, or t
  misc_feature (452)..(452): n is a, c, g, or t
ccaggctcaaggagttcctccagcagtgtgaccgggaggatctggtggaattggctctgcctcagctggctcaggttgtgaccgtgtatgagtttcttctgatgaagcgttgaaaaagatcatctagcaaagccttttttccccagctactatataacggaatttgaagagttgcactaacaatggcttaagaacacatgctgccaacgattacctcacgtagttctggctctcgtgttcccacggagaccctggacaataacacaactgataacggttgcctgagctcactctacgcgaactcacacgaactctcctacgcgacacgaaacgcacaatacagcccacgacacaccttggcacccatagcaccctcagcccgagcacactggcatggggacgcagactcgcacgggcagctacgcagccgagcaagagggnaacgctgaggnctgccggacggacgggacctggcctccagctgcccacaggccccagcaagagaacggccctgtcccaacgatacccactgcactctcttggctgcccaacagcagacggcccggcgcagaagccccggccccttgccttgccttctgcggccgctgggtacaactagctgtctcacggacgaagcgcccttgctccccgtgactgactgcccagcggcgtgccctgcgcgctgggccccgctcaacgga

SEQ ID NO: 620762 - DNA, 403 bp, Homo sapiens
aaacaaaaatctgtttgcccctgtttaataacctcccagtaaagactctattgtactcagtataaaggaatataaaagaagctatggaaattattgttgtctacatggagatatatttcgctattagaaatccacatttttatcctgatgtgtggaagtgctatttttgtgtatgcatgtttaggtacatgtttctttgcgtgagagtttatgtgtgcatatttgtgtatgtgtgtgtggatgtcgtagcttattcttaaggtggtggaatattccgaattgtaacaataagtcccttgaggctaagatgtaggactgactggtacagagaccccagtgagcccctattaattagtcaatgtcagtcatggacgtcgacgcggccgcgaatttagtagtagta

SEQ ID NO: 620763 - DNA, 1714 bp, Homo sapiens
caagacctctgagcccgtcaagcgcggccgcacggccctcggcagcgatggcactgaacggactacgcgctagagaaggaaaaggttacgaagttcttacaagagttctaccaggactgctgaactcgggaacgaagcagttcaagctactgggaaccagtatgattcggctggctcatcgggcaacaggtggctctgctatgtcggaccctgcgaccgaccgtaccccgcaggcatgcacccccgagtccggtggacctcacacatcgctgcacgcacactgcccaggacgcctacgcccaaacgcgtcctttgccctgactgcacgctaccaaccgacgacctgcatgccctccaccatccaacggcacgacgcgcaccgctcggatcccactcaccccactgcaccccccccacccatccccaacacatccaaaaccaaatacaaacatacaactgactccacacccaaccccagaacatcccccccccccaccctacccacactaccacccacacactaacaacaacaaccaaccactctctcacctcaccccccatcaccaccacaacaccttacacctaccagacacacaactaacaacaaaacctcacccactaccaaaccaaccacaccaccaccacacaaacaaccacccacacacccaaaccaacaaccatccaccctaccacacaatcatgacacactcaccaggataccaaaacacgcactccatccgcaaaccactcatgccacaccaatcccaaagaccactacacgccaacacacacgaccccacccgaccacaacaacaacacacactagaacctcgccacgcacctatgaccgccaacacctccacaccaaccaacaccccatcacccccacccacccaatgacataccctaccccaaaaagacaccacgaccaccaacaagcccaccaaacaccaactaagacgccctcacgcgcccaacgcagacaacaaacacaccacatcacccacctcaataccacaccactccataccacacatcccaaccacatcctctattgccgcacatcaccaacaccccaaacaccacatccctactcaatcacacacaactcaacacaacgaaccacaccccacccacactcaattcaacacccacccgcccccactctcacatacaaccctacaatgacccaacaaccatacatataaaccacaaacaaaaacacaacatctctacccacacactaaataaaaacacactatttacataaacacacttacccatcaaaccataacacaacacaaactataaaccaataacaatcaacatcatcaatcaaatcacaacacaacattacaacaccaataatacataaaaactcacatacatccactcacctcccatctaaacacaacaatccaacacacaaatataatatcacacaatcaccaaatacacaaatcacatacgtctcactcctatcgaacacttcaaaatacaccaaaaacaattaccacaccaccaacctcacacacaagccaaacacatgtataccaccaacctcaccatcacacatccgaccctacacacctctaccacccacgatcaactcacaacaccacgacgacactcaccaccacaaatgcaccatctacacactactcactccaacatcgctcaaacactccaccaccaccaaacacaccaaaaatac

SEQ ID NO: 620764 - DNA, 234 bp, Homo sapiens
tatttatatttagactatagagtaattttctcaaaccacataaaaccattttgacacctggtccttttaaagttcatgaacttcaacatctgaaaacatgtgtgagattgtcaaacattccagtgccctccctgggggcactcaaacgtatgtaactgtgtatatcacaatatcatcatatgccatcaaattttcttgaaaggaaattcctgggtcattttatcaggttagcaa

SEQ ID NO: 620765 - DNA, 165 bp, Homo sapiens
tagtaacttaaggatctcgtacagctcgtaccttcgtacgtcgtacgagcgcctcgccgcgcgcggaggcgacagagcgcagttaggaccgaaagatgtgactatgctggcagtgcgacgcagagaaactctggtgaagggtcgtagcggtctgacgtgcaaatc

SEQ ID NO: 620766 - DNA, 385 bp, Homo sapiens
ggtggccccccctctcaggaccgggtttttggaacaaaaaaaaaccacagcttttccaagggggggggtgggctttcccagttccctgcccttaaaaggggggagggggttcaaaggttttcccttgaaaaaaaccagcttggggaagggtttctcgccccgggggaattttaaagggggggggccccttttccaaaaccaatttttgggggggggccccccccccggtttttgggggtttttccccaaatttttccccccccggggttccaggggtttttggttaggcccccccccatttggcaaaaaattgttggggccccaggcttggctgaaaattttgggggatgggaacccaatggcccccttttaaatttcccgttta

SEQ ID NO: 620767 - DNA, 104 bp, Homo sapiens
caccagctcgctagtctgggttattgtcgtccgggttattgtgttattgtcgtccgggttattgccgtccgggttattgtcttccggatgtataagtaatccgg

SEQ ID NO: 620768 - DNA, 458 bp, Homo sapiens
tatccgtgtcggggttggaagaatcaatattgttaaaatgtccatgctatccaaaacaatctacagattcaatgcaatccctaccaaaataccaatgacagtcttcacagaaatagaaaaaataatcctaaaattgatatgcaaccacaaagacccagaatagccaaagctatcttgagcaacaagaccaaaactggaggaatcacattatctgacttcaaattatactaaagagctacagtaactaaaacggtatgagactagaataaaaacagacacatagaccaatggaacagaatggagaacccagaaataaacctatacatctacagcgaactgttttatagacaaaggtgctaggaacgtatattggggaaaggacctagaggaaggcacagactgtcctcctggggacatggcatgagggccgcgtcctcacagtgcattctgtgttccag

SEQ ID NO: 620769 - DNA, 565 bp, Homo sapiens
taatccaatccaaggttcccaaatcgccccgcacatccagcgctgttgggtacgggaggttcgtactatgaatgttactcttactcgatcggactggaccttttcccgggcgcgaaggcgcggcgctaattaggtggtgggtaggcgcggggaggtgccgggttctctttagcgttaaccttaatagacggcgccgactaggctatctacaacgacaaaaagccgaaggggcgtcgtaaagtaagttaaagggatgtgcgatttttagccgagcgttaatgcagtcagctccggtgggtataattttgttgtggctagagagcggttttttatttttattttttttttaattgttattacccgaggtggagtggttgccgttttggggttgggtggtacgctttgggtgtgtcgtctttttatgctgcgctattttgttctggtgaggggatcgccgtttttggggtgggcgcggtccttggaaggagggggtatagttgcgattctttgatggtcttagcgtcggattggtggcggttggttatcgagttttagttttgggtgg

SEQ ID NO: 620770 - DNA, 142 bp, Homo sapiens
cttaggtaacaactgggagagttaaaactagagcaggaagatgcagtcacatttttgaagactaaaatctattcagtagaagctcttcctgttgctgctgtaaatgtgcaaagcacacaataaagtgaagatcaaccttttc

SEQ ID NO: 620771 - DNA, 706 bp, Homo sapiens
gtcgaacgggctatgcgagaaccaagtcatgataattgaacatgttgcatagactgattatgcctaagcaatatcgcctgcgtctatgaacttatatagcgtataggcattcatccgaaccaagagtaacatcacacagactccgcgtggaagcctgaccgtgagacagtgcatgacaagactgatgaatccgagagataggcagagtacatgacagagctctctctagctgcgcagtctgacttctaacacaggtgagattccaaatgctgccgacctccgtctaatccgaccgattaactccgcgcgcagccactgtgccacgaatcttgcccagttgcaacttaaagacgatcaaggtgcgaggcgctgcaggcagcaaagtcctgaagcccattccagaaaaagcacccaggaaccaaaccaacacttttcgaacctataacaagtcgtaccgaggaggatagtctttttgaccagtcctccaaacaagccgttaccacaaactctactgctacaaaaatcccaactaagagcattccccaacaaagccacacgacatccaatctttccaagcctttgacctaaacgcccaaatactatgaaccaaagcgggtttattcttctcacaaattactccacaattctccagttcccaatacataacctggcttgtgaaacaacacatccttatcccggttgccca

SEQ ID NO: 620772 - DNA, 339 bp, Homo sapiens
ccgattgggatctgttcctcaagagctcagggacaagtaacctggggtgccagcaagcccgaaaccgagcctggtgctctccctgtatcttcgatggctaggccgatcaatcagccagcatgacggtcggcaccctgtcgttattcgccagcagctaggttctcaggcttcaggtccctgtggatcgatgtcctgccggtttctctgtgttaaaactctccagaatctgatgtatacagtggctggcatctgcttcactgtagtactctctggccacaatgtcttcaaacagctccccgccggtaacaaggtcaaacacgaggtagtgaaacccttctt

SEQ ID NO: 620773 - DNA, 1215 bp, Homo sapiens
ggagtctaggctagactttgttggcatgttacatgtattcgctgtaatcctggcgtcagacttgtcaacctatgttgatcccccctgttctacaagacaacaaataagtgtgactattctggtcagcggtgattgtagaggaaggtgtcatgatactgaggataggacattggttgaaataaagagttgagagataagagactaagagactatatgccatcatgttggtcaagaaacagtgtaaagcagaaaatgtagatatatacgagaatccaacacatgtcaggattgatgaaatcaaagcatattcagtattatcacttggggtactccagtagaatagacactcgttcatgatttcgaagtctgatttgcaacataccgtccagtttaaacaatacctcgtggagaaacttaggatccgtatgccatagattgcataaaccatagtaattaggtgtacccagttgcaatgtatgagaatgtgccatcccaggatagcttgattacaagcgttcacgtacaatcacgctgtctgatactgggagaaacacaaaatcgtggatatttactagcattcatgtccaaccttggcattcgtgcttgcgacataacctttaccgtatacagaaatgtaggaataccatcaggatttccatacaggaatccagtattgagaatccctggatgaaccaacttgacaaccagaaattttgccgaatatgctcgaggcctgcctgtgaccgacacatgtataattccaaattatgagcgcacgattacacactccgggctagtgccgacttacacaactacatgttcaaactagccaccatactataattctcaccttggcaaactctaatcaacgcacatgaagtgcacgaggagacagcggaaaccggcaggagaaacatggtggagaaaccggcagataacgaaaccacaggaggctgtagaataggagcacggacaagcaaacactaacaaagacggacacagagaaaaacaatacggccagaccagcaaagacgataaacccagcatgtgaataaaatggaaacaacaagagaacaaaaaagagtagtgcaggtgtgtgcgtgttctgtcctctccgcttcctcgacacgaagaacagcgcgacacagaagagcgagaaggaacatacaaaagacaacaaagacacgcgagagaaaaacgtaaagaggcaacgaa

SEQ ID NO: 620774 - DNA, 165 bp, Homo sapiens
tgaagaggtcacgcgggcagagatccagatccgaatcgaggccaatgaggccctggtgaaggacctggagtaggggagccagtcgccaagtttgacctcagcttcggagccacctctggatgaactgccctcagcccccgccccattaaagacccggaagcctga

SEQ ID NO: 620775 - DNA, 206 bp, Homo sapiens
  misc_feature (206)..(206): n is a, c, g, or t
cccacctatatgccgtgtgaccccaccttatgccgtggacccacctatatagcctgtggggtgactatccctggtcaccaatggcagtgcatgcatagtaggggtatcctattacctatttctataaagtatgtaccgaaaatcataccactataagtatctattgattatgtcaccatatcctatcacaataaaatgcaaattan

SEQ ID NO: 620776 - DNA, 156 bp, Homo sapiens
  misc_feature (150)..(150): n is a, c, g, or t
cttatgtgtctgacccacccagggactacaggtctaatggaggtggagcatagagactatgaggtcaatggaggtgtgagtcacagcggactacagagtcaatggacggtgggtggcacagggaactgcatgagtcagtggaggtggagncacagt

SEQ ID NO: 620777 - DNA, 126 bp, Homo sapiens
agcagcgcagtgcagtctttattagcagggggtcggtggtcccaccacccattcccctcgacgtaccatcccttaccaccccttctgtcgtcttctagcagcagtatagtagtagtaggcggccgc

SEQ ID NO: 620778 - DNA, 192 bp, Homo sapiens
atcagctcgtgtacccagtgaattcgactcgggtactggatggatcctcatatgatgtcacagtgctccatgcttaactgagtatttggatggtcagcactggtgctcactgtgtcgacggaacttgtacatgggaggcatgcacctgcagtgggttgaatacactgtctgacacatggctccatgtcttaa

SEQ ID NO: 620779 - DNA, 487 bp, Homo sapiens
taccctctcttctggaagcccctctgcagcactcctcttgtgagtagaaaaggaagtggtcaaggtcgacctgcaaagcatttctcgcctctctgcggcctccattctgctgcacacagactggttctcctcctctaactactggccaaaaagggaagggagtacaagcatcaaagacaaatgacctacatttgggagctgatccatcttgctctcagttacgcccagcccttctgtggggaccaggaaaatctttgctcacctggagaagctgctggttcagcccaactttatctaacgccaaagcctcatttaaggcactgacttgacagctgcagcccgaagatcagctacttctttcttcatttggggggggagggcgacacgcgcatatgacttctcgtcctaaaaaacaaaaaggattaaagatgttcatatttgcgatgtgggtggggcggttttttttttttttttttttaaaaaaaaa

SEQ ID NO: 620780 - DNA, 282 bp, Homo sapiens
accccccccccccccctttttttcggggggggggagggggtcccccccctttttttttcttgggccccttttttttttgggggaaaaggggggttttttaaccccccccccggtcaccccccccagggagaggggagtttttgtggggcccccctgggttttttttttggggggggggggttttaatttttttttttttaaacccggcctttttttgggggccccccttcccccaaatttttgccccggtttttggccccccttaaaagggtttttggggga

SEQ ID NO: 620781 - DNA, 293 bp, Homo sapiens
gtaagttaattacaggactgagacatctactgtaaactgctacccctggggcctccagaaccccggggtgatagcctcctgcctgcctagctgccctgtcccagccccaggtcctgtgcagggacacctgcgtggctaacagccaggctcttactccagccggggctgccaacgcatccagccagcccagccctgtgaaagatggagctgacttgctgcaggggacctgataatagggcaagagaagtcacactccggacctctcagaattcacttgaggttcaattaaatac

SEQ ID NO: 620782 - DNA, 1310 bp, Homo sapiens
  misc_feature (1256)..(1256): n is a, c, g, or t
gtggaagtgacatcgatctttaaatgcctgcgtttgtaaatccctgacgcatcgtcgtgatgcccatagcaagtactaggccgactggaagtcctaactacttccttaatgatcatccaactattggtatgattatcctgaatatgttacacttgatgagtgagtcagacatatgttgggctccaagtctaggatgcagacacggatccgacatgtcctcttcgtcggtgcgaatggctgtggctgctgcatcggcactgatcacctcatgtacttcgcaatgcctcgatccgaggtgcacctgcgaaatacaaccccagtctctgggatgaaactgctgcactcatactccgcggcgggaatgtgggcttaagtcgttcacgctaatgacggagcctcacctgagactcacgaggacaatagttcgctgggccaagtaaggtatgccatagcatgctagacccgtagcctcgggtgccatattgacccaatgttgaaagctcacctgatggccattgggcccaggaaacaatatgagatcctacggtggccccgcaggacatgaaccgtccttattctggcccatggcttggtacaggtttcctcacaacactttacaaaattcgtccaagtggcgacagcacaattggatacgtcccctgatgctggaatgtttgcacgccatgactccaccgaaccttgggacggaccccaaacgtgcggaagtccacgaccgacaacgtccaacgtccattgtctgcgaaaccattggctccaaattaatacttcccccaccgttgtcatccactttagggggcatcgcatcaatcccaggtagtggtgttaccggacaaagtggggcaggacaaatcctagcagacccccttgcaaggttgcctcgcaataatccaccaggaaggggaaaaccttcgttgaccatattcttcagggtttccctggggaaaagggatggaccccggggaaattgtttgcccccaggttgataccgtgtcgctagtgcagaattcgggcgttaccctcgaaagctagatcaagagcattcaagagttaaccgcgccgatatacgtaattgcagtcacagaccgggtttaccaaaacgacaggtcccatggggaccttgtatctggtgagcaagaacgggaatttaagaggcggtttacccaccttggctacgaacaagggcgtcacaggacctttatcatgagaacatgatatccactacgtgcaccactttnggtagaccgatatgagaggccaccctgtgacgccattcgatctgccacacccga

SEQ ID NO: 620783 - DNA, 138 bp, Homo sapiens
ctgactcatctgactcacccatcctacgaatggccccgcagactgcataacgttttaaacgtgggcagttaaaccatgcctgtgcacctatgtacaacctcggccacgattcatctcggatggtgtagtcacagcacg

SEQ ID NO: 620784 - DNA, 259 bp, Homo sapiens
  misc_feature (27)..(27): n is a, c, g, or t
  misc_feature (57)..(57): n is a, c, g, or t
gtcaccataattaggaaacagactgtnttctttatttgaaacacaacagtataaatnctatagtaaagttgggtgcagtggatcacggctgtggtcccagcactttgggagaccgaggagggatggtcacttgagcccaggagtttgagaccagcctaggcaacatagagagaccttgtctcaacaaaaaaatttaaagttagccaggtgtggtggtttgcacctgtggtcccagctactcaggaggctggggtgggag

SEQ ID NO: 620785 - DNA, 204 bp, Homo sapiens
  misc_feature (167)..(168): n is a, c, g, or t
catctagagatcctatcccggtcctgggtagatcgttgagctaggagtcaagagatctgggtatgagggtaataaattattctcaaagggcatggtggtgtacacctgtggtcgcagctacttgggaggctgagatgggagcactgcttgagccccaggagttcaannggctccagtaagccatgattgcaccccgtgcaactc

SEQ ID NO: 620786 - DNA, 150 bp, Homo sapiens
acgcacccctagggttttcttttttcccctttcttgtatacatgataacattccgaaaaaaaacaaaaacaacacaaacaaaacaccaacacccaacaacaacaccacaaacccaaaacacacacacaacacacacaacaaccacccaaa

SEQ ID NO: 620787 - DNA, 263 bp, Homo sapiens
cttagtaaaatattgcctttgtattacctatataaataactcttcactcttgcccttttgttgaaccttttgatattttaccaggtaggaaaaaacctcttttcatctcaaggataggcttttaatgacttatgggcctcgcatagagttaagagttaacgttcccattcttgcttgtcacatgcttatttatcgcgcgcgcctctggagaacccctcgcgtatatctatatataataatagggatataaagggcgctacttg

SEQ ID NO: 620788 - DNA, 147 bp, Homo sapiens
cctgcggaggcagctgggagatgagtggagtctggactagagctgtagatggcacagctgcttcagtagaacctgggcgactaaggctcatttgtccaaaggcgctgctgagcacatctgcctgtgagatcatgtgattattcaagg

SEQ ID NO: 620789 - DNA, 836 bp, Homo sapiens
ccgtgattggttgtgagtgtgaccgccccccccactaagaagattagggggggggtggtggggcaagatgttggcgctgttcggagggttgttggtgggtggcggacaaacacgccgtctggaagtcgtacaacccagcggcggaggttctcacacacacacagctcgattgtgggtggttgtcgccgaccgcgaccgaacagatgttgtagatgtctcgagtactctcgcactccgccccttttgttgagggggggggaccatacatagggggaaataatgtttcaccccacgaagagggggctttcgtgtaaatatttctcaccaggagcgcactcaggccagaaattgtgtctccttcctcgtggggcaaattttctcgctcccttgagggatgaataagaacaattttgtggaaaaatttctgggctgaaaggttttggtgttggtttgtgttggagcgacacccgggcctcctccccaaacccgtcttccaagagtttgttaccactccccaggtcgggtgttaaggatctgcgttgtaagatttctgtatttgtgactgctgtttcgcgttttttctcccacccctcctggcgaacccccccaccatccccccttttgggacagatctccaggaattttatccacggagggcaccaagaaatttgaaataggacgcattgccacccaaaaccggatccccccccccaaatttgttcccgtccccttttggggggttggttatttataaaaatttttttatgttgtattttttcaagttgttccttaatgggggaaaaaaaaacctaatttatttcccggatttttaaaca

SEQ ID NO: 620790 - DNA, 769 bp, Homo sapiens
tttttggttctgccgctctgctgccttgtgctttttcttccctcttccccttcttcttccaacgctcctcgccggtgttttcttgttctttcgtggccctcgcgtctcgcgcctccattgttgcactcccccggggggtgtactccccttttcttctctcctcggtgagggcgctcttcatctagaaagaggtgcgccctccctccggatggcgcatctgtccccacagtcgtttttctgccgtggattcttcccgctgtggttgagcacccacctgcgccccgttggcaccccctcgtgtttatacaggaagtgttgtctcttcgtgcgttaagaagggtttctttctggcccttcgtttccacacgattttgggcccctctattctgcccttccccctgggcgcaggcgcctttttactcaccccggatcttgcagatattatcatgggggggtctcaacgggtgaatcccacgagccgctcctccgagattttcttttcggcccaaaaaaacaccttcttcccacaacttgatgaagcacctattcttactgggaagatgtcatagaatgggcgccacagcaccgctgagcaccacgacttcccccaaccacttgttatacacccagggggaatggagtcccaaagggcgccccaatgattccccccccaatttttgggggttaacaaaccgttctgaaagaatttggggaatcctctcttcctgggcccaaagttttcccctttaaaagtttttttctttggtga

SEQ ID NO: 620791 - DNA, 100 bp, Homo sapiens
gtgacctagaggatccctccttctggccacgcagttttaatggaggggtcctggagcggaagggaagtttctaggtggctgtcctgggtgattcagagtg

SEQ ID NO: 620792 - DNA, 246 bp, Homo sapiens
tcctacgagcagttgctgttgacagatgatcatagggtctcagagacctgtgttgtggctgcctggatcccctcccttcctgatagaagtgttacctagaagaggccccactggtcagaagtgagatcaccaccagacccctcatgcctcccaggggcctccagcctgtgtccatgcctctcaccagccgtattgccacttggcttaggggagagacatctggtttcccgaagcaggaactggagt

SEQ ID NO: 620793 - DNA, 1159 bp, Homo sapiens
aggctgtttggttctgtgtgttcgtgtgtctttgttttcttcttctgtgcttttgtttctcctcggtggtgggtgggtgataataaaacgcgtctgttttttgtcggtctccttttctcttcgtattttgctacttcccccccctgtttgttgtgcccgctctgataagttacctcctgcgttgtttggtcactctctccgtttttttgttttactatatccctcgtcgtgcgtgtgtttctctcttgttttctaccccctggtttccttttttgttgcccgctttgtggccctttttttttgttggtccgttcttttttaggtacctcgcttgtgtttctccctctataatctacacagctctgttgttcgctctcttccgctgagttgtttttccccgcggtagtatttttttggtatccacccccgctcgctctgttctccccctctttggttgtttttgtccccttgtggttcccctctttttttatccccctcttttccctctccgtaaagagtggtgtttttttttagtgggcgcccctcttgtggtaaagcctgcccccccccacgttgtgcgcgctctctttatttccttcataacattttttctccccacaccttttgtttttttataatatcttcttgtatttactcttctttatattatttttttttatataatatattctctctttttaacaccctcttttttttttcccccccctctctttgtaatacctcctctcttgttttatatataaaaaaaccttgttagaagagatcccccctccccctctcaaaaacaccacctctccccctgctttttctaccccccacatatatattaaatatttaaattctccccgcgattttttttttaaaaaggggacacaccccccctattttttttatccgcgcgctctcttgtggggagaaactatatatatttcttttctccctctcttgaaataatatattgtgctctttttttccccacactctttatattttttcaccccctcgtgggtttttatatataaaaattcttctttttttttacacaccccctcactcttaaaaaaaaatttctttttatatatattttttttttcaaacacacccaaggggaaaaattttttttgtgggtgtcccccca

SEQ ID NO: 620794 - DNA, 366 bp, Homo sapiens
gaccggtgctagaatggagagggtggcaccatcaaacaagagaggctagcgtctgagcttaactgactggaaagacgaagccttgggcgatacactcactttggtctgtatgcaatccggcatacttgagagcagagttgtgaggctctgttccagtcgcatgacaagcgctaaacatgtgagcttgctcctacgaagggctgcaatatagccaaggcttgctagcctaagagtgtttgaatcagtgtatgtgtgtgactcgtccgtggaaaccactgcttgatcttgttattgaataatcctgttaaggctacttcaaaggtatttaaaagcactacattaggtggaaagacaacaaaagagagc

SEQ ID NO: 620795 - DNA, 218 bp, Homo sapiens
tctcgatcgtacccaggcgtagtacagtggtgtgatctcagttacagcaaccttcgcctaccaggttccagcaattctcctgcctctgcaccctagtagctgggattacagtgtgcacgtcatcacacctggctcgttttttgtatttttatgtagagacggggtttcaccagtgtgggccatggatatgtctcgcatctccgtgacgctcatgatcc

SEQ ID NO: 620796 - DNA, 889 bp, Homo sapiens
  misc_feature (3)..(3): n is a, c, g, or t
tancctcagtacgagcagcgaccagatagacaaagaggagcgcgtcaatcaagcgcctaagccagcgcggctgcttattggtcccaaataggccgggaagaactccttgacagtctcgttcaagtgtccaaaatcaagggcccgaaggaacaaccggggccaataacccaaacaatttgccgcacatggttgagcccgtgcgtcaacttgggaccatgcggccgaacaattaagacacccacacgatgttcttgcgtggccgagcaccgtctttgcggacccccgggggggaatcccccggtgacaagcggcgccgtcaaattcccggggggacaaaactaactggggcggcacagccgaggcccgggaggccacggcggattcaacgagaagacaggagaggggcatgctgatcctcaggaaaaaaatccgcgccccggccccgccaaaggttgcgcaacgcaaggagagcgaccgccgcctgttcgtgtggaaacaacaagagggcccggcccccaataaggcacgaagccttctggggggcgggaaaatggagaagcgcgtaatccccctgtcaaggccggtcgcccccctgtcggggcgcataaaaaaagtgaggtctccccgtacacaccctctttgcgaaatactacgcccccgaatcctggttcgcccatatagacataagaccgagcaattgtcattctgcagtctgttgctcaaacaagcgctaaacagacagtttttttgcacccgtcagcaaaacaatgcactttttcagaagggggccttacaaaaatactccctcggttcgcaaacgcctcgctgatgcgcggtaacccggggtgtcccccttatgtgtcgagaagaaaccacaacaaccaaaaca

SEQ ID NO: 620797 - DNA, 902 bp, Homo sapiens
  misc_feature (125)..(125): n is a, c, g, or t
  misc_feature (228)..(228): n is a, c, g, or t
  misc_feature (450)..(450): n is a, c, g, or t
  misc_feature (485)..(485): n is a, c, g, or t
  misc_feature (511)..(511): n is a, c, g, or t
  misc_feature (524)..(524): n is a, c, g, or t
  misc_feature (536)..(536): n is a, c, g, or t
  misc_feature (540)..(540): n is a, c, g, or t
gcggtgattcacgcctgtaatcccagcactttgggaggctgagtcaggcagattgcgaggtcaagagttcaagaccagcctggccaacatggtgaaaccctgtctctgctaaaaatacaaaaatnagccaggcgtggtgacacatgcctataatcccagctacttgggaggctgaggcaggagaattgcttgaaatggggggtggaggttgcagtgacccaggatcgngccactgcactccagcctgggcgacacagcaagactgtctcagggaaaaaaaatatatatatatagatacggaccacagaagctcaatatagcagtgagttccttagctatctatatgtacaattgttctttaagtctcattcctgctaaatcacctgagaatcctcattggaaaaccaatgctcttcccgagtctgcaggccaatttagggttaaacaaantggggggttagggagggccttaatttgtatcaaanccaaaaaacaacatgagaaaaatcanggttagaatagtncaaagaagatcnggtnctgaccatgataatgtcctatctaatagggtctaggaagaagagggctaagacacaagaggctggataagtcccattgtggagagaaagttagtgagtctctaggtgactaagcacctaccaccccaataaactttgtctgcctttagatattcctcaatgtcggtattacaggccgttggctaaggcagggaattcggacgggcggatggctgaccttgaccacggagtgccgttgtactgaaactgccacacacgcactattaacacagggggaggcacatgtccccggggagagcagccgataactccagtcactaaaatgtggctattgagaaggtctcttcaaatgcacgcctcggt

SEQ ID NO: 620798 - DNA, 301 bp, Homo sapiens
cccgtaggcagcgcagcccatcaatcacaagagagaggacagggaattctaagcccgtgagtttcagttactttaaattagaacttttctgtatctttttgtcattagaaaaaatgagatcctgttactgttagttcagttgtgaatgccaactaatttttatgtaatatttttaatgtaaaatgccaagcaaatgattaagctgttgtattagtatcttattgcattaatatcactattctgtatattcatagttaaattgcatattaccaattaatattaatctgtaaatttaatgata

SEQ ID NO: 620799 - DNA, 115 bp, Homo sapiens
tgctgggattacaggcatgagccactgcgtctggccagtgatcctttttttaatcctatatgtatatttgctttttggcatgatggacagatttcctggaatctagagcgcttgt

SEQ ID NO: 620800 - DNA, 229 bp, Homo sapiens
ttttaatccattatctacactacccttatcataacagtaatgtccggaaccatattagtaataatcagctcacactgactactcatctgaatcggattcgaaataaacctattagcaataatcccagtattaataaaaaattttaacccacgagccacagaagcagccacaatatatttcctaacacaagccacacggctccataatactagataatagccacggtaac

SEQ ID NO: 620801 - DNA, 502 bp, Homo sapiens
aacgagggtccttcagctatcacgaggctgaaggaggagaatcgcttgaacccgggaggcgaaggttgcagtgagccgagattacaccactgcactccagcctgggcaacggagtgagactctgtctcaacaaaaaaaaaagaaaactcgttaaggtagattcctcgggtaccatctccagtctgataaggatctaaaattatcttcaggccaggcacaggggctcaggcctataatctcagccctttagaaggctcaggcgggaggatggttggagcccaggagttagagaccagccgggacaatagagtaggacctcatctctataaaattagccgggcatggtggtccacaacggtggtcccagctaattttatagagctgaggaccatcgtggcaacgatggtcctcagctactcgagaggttaaggcacaagaactgcttgaacccaggaggcagagggtgcagtgagagccaagatcgtgccactgcacgggaccc

SEQ ID NO: 620802 - DNA, 424 bp, Homo sapiens
agtaattttctgatgggaggaaagtagcagtcatcatctttttgtgtgcaggctgtctcatttatttttagccatcgtcgtttcattcattttgtgtaatataaaccgtgtgtcatgtcaaagtgaaagacatttcaaatctgtagcataggctattatctccccaccatcaacctagggaccccctgctctgtttactgtgccataaccccttagtgtcgccttttttcttgggtctccctatggaacactccaacgggcgccttttttttcatttctactgaaggtgggaaattcaaccccacaaattgtccggaagtgaaataaacacccttgtttgtcacacaaaagccttattggttggttttttttaaacaaaaagggtttgacaaattggggaggggggggtattaacaaaccttta

SEQ ID NO: 620803 - DNA, 179 bp, Homo sapiens
cgtttgtatgtccttgacgacgcggcttactgactgcgacctgtgacgtgcgttcgtacgtttgacgtttgctacggccgacactacgtacctgacggactgtagacgtccagtgggacgacttactgacgacactgacctcgcgtccgtgtaacacgctctcacgggcgcgttatgga

SEQ ID NO: 620804 - DNA, 291 bp, Homo sapiens
gtaactttccgcggctgtttttattgaggctgtaggtgagcgtgtcgtgtatcatgtcactccagcttggacaacagagcaagactccgtctcgagaataaataaataaatcaataagagaaggccagattaggtggttcacatctgtaatcccagcactttgggaggccgaggtgggcggatcatgaggtcaggagtttgagaccagcctggccaacatggtgaaaccccgtctctaccaaaaatacaaaattagccgggtgtggtggcaggtgcctgtaatcccagcta

SEQ ID NO: 620805 - DNA, 517 bp, Homo sapiens
ggacacggtgacaaaagtcaataacaacagatctttagatggattcttgaaaaccccagctcaggcggggaccttatggataaagagaatattaaaatttggtgggaggggcaggtgattaggaaaataaggggggagaaagggtggggaaatacttctcaaaaacaagaatgcccagggtccttaagggataggacggggggtgagaagtacccagtaatctggtgtacaggtgtgtaaggggagagagggtgagaagagagagaggcaggacgagggagagacagagagagggagagagagagagagaggagggagggggcagcctataacaacagtaggcggggtatatagtggtagtactctaggggcaacaagcatccatcgtcccttctccctccaaaagctcaggctgctcacccacactatccctggtaaacagcggctcacacagataccatacacgcacacacacgcagggggctgtgaccttgtcttccctaccagtcgggccggg

SEQ ID NO: 620806 - DNA, 1043 bp, Homo sapiens
tccgagggtttacttttttaaagaagcctgccggggaaaaacctcccaaccggtgtttgaaaacacacaaaatatttttttttccccaattttaaaaaaaaaaaaaattttcagacaatttttaaaacccccttcctttatatatattatatcgtgctgggattaaactcgtgagtataaaaaaaaccccgcggttgaaaagtcggttcgctcgagacctattatcctatttctttagaagaagagggagcacgccgtgatgcccacgagtggcgatgacaacgggggacgcaggatcttgttgcctcactcagtgaccctccgccctctgcgtcggtttcaagcaagattgtccggtgccctcagccctcacaactgcgcagcggcgacatcaacgacgcggcgttctcaccaaccacacgcagtgcgcgcgaggcataagtctattattgtatgtatgttgagaacacagacaagagagtgggggttaccatccacgtgtgtgggcgacacggcgcgggctttgtgatactgagcatcttatcttataatgcaggaacctgtggggaacatatggctctcgcccaaccaccagaaaacaaccagctgtggtggaccgacggcttttaaaaaaagggatgccccgtggaaacaccagtatcatttttttcgaagaaacactacggtgcgtgaggcaccaatcgtgtggccgagcaagcctcctattgtgtgctcactcctcgaaagaacctcaagaaagctcacagcaacccagaaaacgcgggctgcaacgagaacaacaaactgcgccggcgtccacacacagctccccaaaatagtcgggctctcagaaagaggcggacaaaacacttcatcccacaacacagacgggtccccggcctctaagagggtgctctgaccacaaccccgggcgggccaccataccagcacaccagcggggggctccctctctaacacaacagcgctcgggggcggcaccaacaccctttatgaatacaccccttgggagagacaacctggac

SEQ ID NO: 620807 - DNA, 557 bp, Homo sapiens
taaatgcactggctaaagtaataagagaagccccacagaatgacgcaatacaggttcatgcaatatatcggttgctagactaggtgtgctgctttactcgcacgcaaaccaaaaacaggtgaatagcctatggatcttcattcacatgctgtaattctgatcgaccgctctgaagctcggaagtgcgaggttatcaggcacacgcagcgagcctagtaatatccagagtgccacccggcgaaggcatgcaggattgcgtataaggagccatgctttactcatttacacaagctgagagatcatgcaccacaattttcacctgctgtgttgaagccaggagctgtgtgccacaggtctaaaccggcagtaagacccttgatgtggggacatcgcagacgcgtgcaatgtccgtggcgacgtggagtgttaggtctcaaatttacgcgacgatgtatcatggacttatgacagtaagagcaggatcctgtgcaccaagagtgtgggagaactggtggccctgggattactgcggaatctgagcaaaaaacataactggt

SEQ ID NO: 620808 - DNA, 459 bp, Homo sapiens
  misc_feature (15)..(15): n is a, c, g, or t
  misc_feature (459)..(459): n is a, c, g, or t
cctacctccgaaatncctatttataattttgaaaatgccatacctgttgactgttaacccccagatgtaggaatcctaatctataacagtaaaagccacatatatgaagtaaatttaatgtagcacctacttataatggaaaaaagaaaaaagaaagcaaaaacaaaaaatctagaagcccagtcagtcttggtggctcacacctgtaatcccagcactttgggaggccacggcagggggatcacctgaggtcaggagtttgagatcagcatggccaacatggcaaaaccccatctctactaaaaatacaaaaactaaccaggcatggtggtgcatgcctgtagtcccagctacttgggaggtagaggcgggagaattgcctgaacctgggtggcagaggttgcagtgagccgagatcgcaccactgcactctaacccagggaacagagcgagactctn

SEQ ID NO: 620809 - DNA, 244 bp, Homo sapiens
gtagtaggactctccttcaacttgagtggagtaggtgtgtccacaatgccaattctaatgtccatctctacagtttctgcttcagtttgttaagctcgtttaatcttcaccaaaggagcaccatcagtcatgctgctgcccgttttcttccgatttctatgttttacctgtttctacattcttccactaacctcagagacggagtctcggttctttcgcgtcactcctccgatttcccatgctg

SEQ ID NO: 620810 - DNA, 441 bp, Homo sapiens
ttgctctacctcagctcctgggggaggagaactgggacaatgtgaagcaggactggtcccccatgaaggatggcagcagccccaaagtggaattcagcaatgcccacggactatactgctggacacgagtctggagcctcctctgtacggacagacattgtgtgacaacgggggaggtcattgccagctacaatcagctctcaagtttccagccagcccaaggtggttgcgctaccgcgtggctccacctctatgaagatgatcataacaacccgacggtgacgcgcgagcacgctggactaccagcaccactcagctggctgaggccttcaagcactacaacatctcctgggagctgcacgtgctggaggtgaccacctcctcccttcgccgcctcctcatcctgccccactgtgacctcagcaagattggcgatgagga

SEQ ID NO: 620811 - DNA, 251 bp, Homo sapiens
ctagggtcgattaccacaagcatcccgtgtaatgcccccatgcgccaaaggtagctgtttggccatggcaatgggaggggctggaggaacagcatgtggcatgtagggatggtccggtccctgccatggggagtggggcgaagcggagcggttctgtggcatttggagccttgcaaagattgggactgaaaagctcagagactcaggtaggtcagccggtcagggacaagtacactccaccggctctcttc

SEQ ID NO: 620812 - DNA, 338 bp, Homo sapiens
ggcgtaggccagctgtgcttcgctctccaccatatacggaatcggattgactgcaagaccctcgacgcgaacttcgtaatgaaggtgcgggccggtcgaacggccggtcgagccgacatagccgatgaggtcgcccttcttcacgttgtcgcccgcggcgaccgcgaggcgcgagaggtgggcgtagcgggtctgcatcgaggcgccatgctcgacgctgatgtagaggccgtagctcgaataccagtcggcgcggctgacgatgccgtcggcggtggcgtagaccggggtgccagtaggcgcggcgagatcgatcccggcgtgctggcggcggccgc

SEQ ID NO: 620813 - DNA, 306 bp, Homo sapiens
ggggcagtgtctctcacccagtctggagtgcagcagcgtggtctcggctgactgcaacctccacctcacaggttcaaaggattcttgtgcctcagcctcctgagtagctgggactacaggcatgtgacactgcgcctggctaatttttttgttatttttaagtagagacgggatttcgccatgttggccaaggcaggtggatcacttgaggccagaatttgagaccagcctggccaacatggcgaaaccctgtatcactcttttaggcccttctgtcgtcttataaacaccccgcatagtagtagt

SEQ ID NO: 620814 - DNA, 173 bp, Homo sapiens
tggaaaaccccatctcaaaaaaaacacttatttggtatttatgtaattatactatttctatttcaaagtgtgccacacacccttcgtgttaataaaagcgagccattgggtaattctaagcactgaaaaaaaacctttctttttcccactcccaactctcctatccaacagtg

SEQ ID NO: 620815 - DNA, 350 bp, Homo sapiens
ataacagaggggactctgataaaacgggcataacaggccggcgggacacctggggcaagcggggttataactctagaatgtcactggtcggtcccaccccgacttcttccaccccacttcttccttcaccaacaggcaagtcctttccttcccggccagccagatagatggacagatgggaaaggcaggcgcggccttcgtggtcagtagttctttgatggtgaagggggcagcacagtcatttaaacttgatccaacctcttggcatcttacaaagttaaacagctaaaagaagtaaaataagagggcaaggctggtgggaaggtacagggcatatgggcggcacccgg

SEQ ID NO: 620816 - DNA, 464 bp, Homo sapiens
  misc_feature (16)..(16): n is a, c, g, or t
  misc_feature (24)..(24): n is a, c, g, or t
  misc_feature (237)..(237): n is a, c, g, or t
  misc_feature (258)..(258): n is a, c, g, or t
gtgcagtgcaggacanagaaggcngtcagagacgctgtggcagacgcaagccactcgggctcagtgggtgggtagggtggtgtgaaacctggcatttggggcgtctacctcctggaggacaggaggtccgccccctggggctatggtggactgagaggtgggaggggggaaactggcactggctatctctgggcaaggtccagccgccactggcctctcccaggcatggtcccaaancacatgtctggagacttgaanagggtaaaagccaatgccagtctcggtcagaatctcagtgtgcagaagggagtgccgtggcagcgctggggaagaggcccaagcttaagggaaggacagcgaacactgagcccatgcaccatcctgtctcctagcacccgtcagctggggccaccagggacttcatgactcccagcgcagacacccggtctttcccagatccccgg

SEQ ID NO: 620817 - DNA, 1204 bp, Homo sapiens
gacgcctctttgttctctattttctgtgttggtccgtccctcatcgtttgtctgtttctttcgtcttttgttcatctctctcatcgctcttctttctcttctgtgtgcgtaatgcgttttactgtctctgtatctgcgttgcgtctttcgtcgttggttgtctctctctcctgtccgtgtatgctcttggctcctgtgctccatcggttgtgaacccttgagaggctccccatggggtccctttccgtacttctctcactatggtccctgtgttctttaggcgctgccctgggtcctgatcttgtatgcctcgtggccggtttataaatttttgccagtttgcgcctcaccggtgggatgtcgttcgtgccgttggcttccggtcctgtcgtgcctttcgtgtgtgctctatgtgcggccccagttcctgtaaatgcacttgcacggttcgatatctccctgatgtctcgacaatacagaaattgccgtgctcattagtctgatcgcattatggtgcaaggcctgcaggactcagctcacaatggaagttttagccccttttcttcgtgacagggacccggatacaataggagacggtccatgtacgatgtgggaacagctatcgactagggctaaggtctggaaaagttcacgcagacaatgacagtgatcgaagcccgactgttctgtcttctcaaccgtagaatgctcctgtcgctcacttcaagacaaaggacatggaccacttcttgtacggacctctcggatcgagatgatagcaggctccacagagagcagctctttgctgtcagccacagacaagctcctggccgtgagcgaataggtacctcggcactggtgaagagcacacacggcctggccatcctcaggacaccgagaacccgaaaattgccaaggacccatcctggatcatccgatgagcagccgtggcgctcgactgcacaggagccacgagactaatacacctccgagactgaatatgaaaagtcagataatgtctactgctttttcgcaagaatattactgtcattgatgtgtcgccaaagcccttgactggcgagtcaaaaacctcagatctatattaagagtgacccaggaagaggttcaattgaaataatcatgcatgaagcaccaaagatgcaccatgtagaattgtcacttacgtacctggcaggctcgttta

SEQ ID NO: 620818 - DNA, 569 bp, Homo sapiens
ccttatctagctacctagaggaccccggcactgctcggatgtggatatgcggatactgtggaagtgtgagaaaagaagtcagggaaggcttcctggatgaggaggcctgagttgagaaacagaatttgatttaccagttgatagaagccctttcagggatgtgcaaactgcatgtgtaagagcctggaggagacaagaggaaggtgaatgcatatggagtgagcagagacagtgctagagcatccttcccactcaggaacttgccaaagccctgagaggttggtaagagaagcacctctataaagacacggtactgacttcggacttaaccctcagggaaatgggaggtcacacagaggttttacagagaacagtaacatgatcagattttctctggaaagatccttctggtttcatataaatgtgatggcttggagggaatgtggagaagctatgagagtacagctgtggtggagatgatgatgaaaactagggagaacctaggtggaccagtaagaagtgagtgcatggatggatgtaggggacgataagggtgctaattagataga

SEQ ID NO: 620819 - DNA, 700 bp, Homo sapiens
  misc_feature (38)..(38): n is a, c, g, or t
  misc_feature (85)..(85): n is a, c, g, or t
  misc_feature (180)..(181): n is a, c, g, or t
  misc_feature (183)..(183): n is a, c, g, or t
  misc_feature (227)..(227): n is a, c, g, or t
  misc_feature (241)..(241): n is a, c, g, or t
  misc_feature (279)..(279): n is a, c, g, or t
  misc_feature (281)..(281): n is a, c, g, or t
  misc_feature (319)..(319): n is a, c, g, or t
  misc_feature (356)..(356): n is a, c, g, or t
  misc_feature (367)..(367): n is a, c, g, or t
  misc_feature (373)..(373): n is a, c, g, or t
  misc_feature (377)..(377): n is a, c, g, or t
  misc_feature (380)..(380): n is a, c, g, or t
  misc_feature (385)..(385): n is a, c, g, or t
  misc_feature (388)..(390): n is a, c, g, or t
  misc_feature (412)..(413): n is a, c, g, or t
  misc_feature (425)..(425): n is a, c, g, or t
  misc_feature (479)..(479): n is a, c, g, or t
  misc_feature (481)..(481): n is a, c, g, or t
  misc_feature (494)..(494): n is a, c, g, or t
  misc_feature (503)..(504): n is a, c, g, or t
  misc_feature (508)..(508): n is a, c, g, or t
  misc_feature (523)..(523): n is a, c, g, or t
  misc_feature (557)..(557): n is a, c, g, or t
  misc_feature (575)..(576): n is a, c, g, or t
  misc_feature (699)..(699): n is a, c, g, or t
tcacaatttataaattgttttttttattttaaaataanatttaattttttttttactcattattaataaaccaacatcataaatnatcttatacatattaatttattttttttcccattaaatctttatcatccatcaaatatacctttttttttttttaatccattcaattatcttcannanatattttattacactttcatttaccttaattcacttcaacattnacaaaataacactnacaaacaaaacaacagaaaacacccataaacattaatnanaatttcaacaaacattactctccattatttttcttatnatttttttaatttacattttaaattccacattctctnaaatcttcatntaaaanacanttntattngtnnnttcttcacacacacttacttcnnctattacttttntaccttatattttaaaataattttttttatccatttttcataatattctactcntncaaaaataccatntctattttnnattncacatccactaccangaacaattacaccaataaccattctcattttatntttctcacaaacaatttnnccaccataatccccctcacatggtcctgatccaatcttttcagccccagcacatatttcagactcattcagagtcaccttccctcgatgatgctggctgcatttctcatttcccattatatana

SEQ ID NO: 620820 - DNA, 418 bp, Homo sapiens
accggggatcaccgcctgtgaactgggaatcgccactgacggaggacaaacggctcatcaggaagaagagattacactagaaaatcctgcagatgtgcctgtctatgtacagtggatacctctggctatatataccaacccttcagggggggtagactagttagtagtcaagggtttaactagaggtaagggggcaaagcatgagtggagaacactaggaagtttcaagtcttcagaaagcagggctcatccactgcagaggtgcaacaggatatatggagggcctctctcgacattgaattttaaacctaagttgaaaacctggagaaaagaaatctgtcaaagtaaagtttactccagttcacaacagaactgtatcttcacttatcatagtcagaaataacctgacggtgatgga

SEQ ID NO: 620821 - DNA, 640 bp, Homo sapiens
  misc_feature (122)..(122): n is a, c, g, or t
  misc_feature (198)..(198): n is a, c, g, or t
  misc_feature (295)..(296): n is a, c, g, or t
ctttatgttaacgcaagccactacccataatttggtccctaagtctattaaggttaaagggaattgagatctattttaaaccaaagtaacttctacataagtccagcctatataatccaaantatgtcaatagtcccaaatctttgaaacatcaagttatttcatgatatagcacagagttcttaaactctggttccnttttacgtacattctatagaatgcctgattagcccagaaagtgagaactctaccctgtctctttatctacatctcactgtcttaatttctcttttannattcatataccactgttgttctcttaaactttttgtgtttaaaaagtgacaataatggacaaccttgtgtgtagaaacccaggaaaaaataagcattgctttttacatgcatccagtatcttgggagttatgccagacccagttaatcatggttgcctctgggaaggaacacagagtatctggggcacagagcgagaagggacactttccatggtatactattttatatcttaataattttatatcagataaatataatctttattcaaaataattttaaatagacatgagaaagtccctgattccccccctagttccaccctccagatgtagtcactgttggc

SEQ ID NO: 620822 - DNA, 120 bp, Homo sapiens
ttacatcatcatcccaatcctctaaccacaacgtccgactcgtatcatccatcatctcatcccagcctccaccgaatcttaaccatcacctgcacccgcgtctcccgtaagagcccaagt

SEQ ID NO: 620823 - DNA, 378 bp, Homo sapiens
  misc_feature (85)..(85): n is a, c, g, or t
tcctgattcttgttgttcactaatagcaactcacctgggtagcatatctggtcttgtcacccctttgatgcttctgtttcacacntagcaaagttggggttatatgtgtgcaacaccaaaacccaatcctcaagttttctcttcctcttcctctttctttcttccttccttccttccttccttcttttctttcttccttctttctttctttctttctttctttctttctttctttctttctttctttctccctccctccctctcttccttcctgctttcctcctgactcagttcatttatgcttcctcttgtagctgagaacagtgttcacaaatatcttctccagacactaaacagaagcaataactatgtcgacgc

SEQ ID NO: 620824 - DNA, 1068 bp, Homo sapiens
  misc_feature (542)..(542): n is a, c, g, or t
ccccacggtattatggtgcgctcacatggatgtttgcccaatggaaaacgccctcagcccttgcgtggccccatcaaggctctcaactcggttgtaacgaacaagaggcatatctccttaccacttacacatatcctcatggggaacgaccaaggtgatgaatgtaacaaatttctcgtcttcgtagagatcttgagtgcaacaaaggtatgggcaattggttccccgatctgcctctgtgtattctgttcgcgaagatacgtcacgtgatatagcgtgccaccgcctacccatgtttttaggaacagctagtgttctcgcgcgtaccgtcctctccatcatcgccactgcgttattactacgggagctgtttggctaaaggcatcgattgatctttttaaccagcgatcataattgtacaggatcaaaattctggctgtttttcaacaaggatagtcagtgtcaatagagagaacatggtgctcttaggcaaggtcgcttggccagctaatagtccagattcctgcatgggatcccagccntggcgctctcctggaacctctgaacatgctgtggaaggaattggccaggaccttcgacctctggagagtagggtctaatggcgagggaaaagggtgttcaccatgataacctagtgcctccatagatgggcgctttggaaaaaattccaggtccgatttctttgtgtgtcagctggactgtcgcttgagctggattgttccgcacatgtagcacctctccacactttggcactaagaagctcctgagacaccacttctcatgcattctccctccctaccagcggtgcaaggctttggagccagctctgtattagtaactccagattatttaaagagaaaagtacaagacagaaatcttctagcatctttgtaaacacagtgaataacctcttggagtattgtttggcgtttatataaaacaaggtgttttaacttgtaatagtataagtgcgcattagaaaatgcaacagggcatatctttgttaaagtagatttttcaattatcctacgaggattacattgtcaa

SEQ ID NO: 620825 - DNA, 172 bp, Homo sapiens
  misc_feature (41)..(41): n is a, c, g, or t
  misc_feature (84)..(84): n is a, c, g, or t
  misc_feature (110)..(110): n is a, c, g, or t
  misc_feature (141)..(142): n is a, c, g, or t
  misc_feature (166)..(166): n is a, c, g, or t
  misc_feature (171)..(171): n is a, c, g, or t
gcttagtgtaaccagcggcgtatatttttaaggcgcctttncgaaaacctagtagttaatattcatttgtttaaatcttatttnatttttaagctcaaactgcttaagantaccttaattccttaaagtgaaataattttnnccaaaggggtttcctcgatttggngcttnt

SEQ ID NO: 620826 - DNA, 100 bp, Homo sapiens
gtgcacatgtgtgggtaggtgtgtgtgtatgtacgggcacgtaagtcgtgtcgtgttgcatgcatgtgtgtgtactggcctgacatctagtgacgggtac

SEQ ID NO: 620827 - DNA, 1584 bp, Homo sapiens
  misc_feature (1465)..(1465): n is a, c, g, or t
gccctgcccgacagcagacagcaccaacagctgccccgggctcgacctcgctgccgaaggccagcttggagagaggcgagcggccagggccccgcaacgcgccggcagcaacagacagtggcatacgccccaaaaagcggacgccgcaatcgcacccgcctgaaggagcagaagggaaaactcaacacagagaaagacgcagaagcacacgagaaaccgagcagggaacagcaggaacaacagagagcccaccacgagaaaggcccccaggagaccatacacagagacaaaaagatagagcctacggatgacacacacacaaaagacacatagagcacaccaccgggagaagatgaaccgcagaaagcagcagacaaaagaacagcccagacgcacaacacagaagaaaaagaggagaaaatggagaaaaacaacaaacaacaggtacaaacacggagcaacaaggacacacagaagagcaaaacggcaccaaacagaaaacacaagaggaacaaaggtaacacacccccctagactgcgcgtaacaaacatacaggaacaaccacaaccagcggaagaccagcaaaccgaagacaagcgaaaacagaaagaggcaacaacaagagagcgaaaccacaaaggagacaaggccaacagaaacaagacacacacccaccggagggaacacaacgaacgtaacagaaagaggaacaccaaaacaacaagaaagaatcaccagtaacgacacacccgcgggtgtaacacagccaagaaccggggggaaaagcagcgggagagacaaccaccaacaggcgcacaaccagaaacaaaaagacaaaacgaagaacaccggcgggaaaaaacaccaccagcgagaagaacgaagcccaacactcacgacgggaggaaagccacgaaacagcgaacacacagagcagacaaaccaccacccacggtggaccagcaacccaccgacgcgacccaacacggcagcgaggaaaagaaaacaacaaaagaagaagggggacacaccaacgacggcatatcgcacactcacgaagagacagcacaaaaaaataagcagaagcgcacacgcagagagacaaagtaaatcaaccaaacacagacgtacgaacacagaggaaggcgaaagacacacaacaccgcccaagggagagagacaacaataccacgcagagggcgacaacgaggaataccacgccagcacatgaaacaacaaacgaacagaaaaagacgagcgtaacacatatagcccacatcggacataaatacaacgtcggaggaagacgttccaccaacacaacgaacagtgacacacaacaacggaggagacatacagacacaaaagacaagaacagtagaacaatagaagcgacaacaacgaagacgagcacccagcaacatagcacgatataccgatcagacgaaccacataagaagaggngacagaacacagtcgaatcagctaacgcaaggaagagagcacacacagcacaaaaagaacgaacacaaacataataactagacaaacagagtccacgaacataagccagcaaagcagga

SEQ ID NO: 620828 - DNA, 165 bp, Homo sapiens
agtactaatactctacatatggaaatgtaataggaggagacagcctatgcctccatatcccatcttatacgactgtgaacatcactacctatcgtcaggaccaacttcaacgagtctcacgtataacgcgtgactgcgcgcctccgcccactgaccataacagca

SEQ ID NO: 620829 - DNA, 131 bp, Homo sapiens
aacatgccctcctgttactcatactaggtttacatccacttccgtatttaaaaactctcatgaaagtctcaaatgctccttgacatgcatgcaatgggtgaaccctggctgggtgatggagatggacaatg

SEQ ID NO: 620830 - DNA, 129 bp, Homo sapiens
ctatgggacacccagaaaggtgggccagtgacggaagaaaaaatggaaggaaggcttgaaaagtccattacaaaagtacagggctttgaaaaagatttcaaagatattagaatgaaaactgattacatt

SEQ ID NO: 620831 - DNA, 811 bp, Homo sapiens
gtcgcacgcgcagttggtccttagtactgcggccgtcgttgggtgagttggctgccggggcgttgaatacttatgctcccgaaggaagattatttcaagctggaatatgccattgaggctatcaagctgtgttctacagccattgggtatccagacatcagatggtgtgtgcctagctgtggacgaagagaattactgtccccactgatggtagcccatcagcattgatgagaattgtagagattgatgctcacataggttgtgccttgagtgggctaattgctgatgctatgactttaattgataaagccagagttggagactcagaaccactggttcacctacaatgtagacaatgacagtggagagtgtgacccaagctgtgtccaatctggctttgcaggcttggccgaagacacgatgcatgatccaggtgccatgtctcgtaccgttcggagtagcgattattatcttggaggacgttgactgcagaacaggaccccagcatgtttcatatggacccatctgggacctttgtacagtgtgatgctcgagcacattggctctgcttcagagggtgcccagtagctccttgcaacgaagtgtaccagcaagtctatgactttgaacagaagccatcaagtcttcactcatcatcctcaaacaagtaatggaggagaagctgagtgcgatcaaacattgagctaggcacagtgcagcctggccagaatttccacatgttcacaataggcaagaacttgaacgaggttatcacggacatttccggaatcctgatcctcagaacttctct

SEQ ID NO: 620832 - DNA, 729 bp, Homo sapiens
aacctctatgctttcttcttaaaaaaaaaaaaaaaggaaaaaggaaaaaaaaaaagggaaagaccaaaagccctgctgtttgtttgtgcccaagcccttccaccagaaaaagctagtctaggggtgagagcccacttggtctgtggccatcaaaagtaataataataaacgggacagttgacaatcgtgggtttctttcaaaagggcctttttgggaaagaagaaagggcagtcaccgtttcccactgggggtttgggttggtgcaacaggcagggaggagtggggacgcgttggtctagctgtgatttccatggcaacagcagcggcacgctgggaccccagaacccagcaccctcatccttggtggccagagggggccgggaccatttggaccccttttcagggatttccaccacgagccctagaccggtcaccggtgacccggggggcatgcattggtccccaggggacacctttcctccgtccttctcccgggacctccctttccggtctgggcctcccttgcttctccagccccttccttcttgcccccaccccagttttcccagtggagaatcctgccagctgggtggggggcctgggcgcatgagtgtggagaggctgcactggccaggatggctatgacctggggactgtgaagctgtgacctccgagtactggtcccgagatcttcgcataagcgtacctcgtgtgcaccgcttgggggc

SEQ ID NO: 620833 - DNA, 205 bp, Homo sapiens
aataagggaaaaacccccccctttttccttcctttttttcccccatttttgggttttttgttgggtggggccggccccctgtggttttttttttccccgcccactttttatttccctgggccgggtgtttaaaggcaaaaaacccccccttgttaaccaactggggtactgccccaaaccgccctttttaatcccccctccctta

SEQ ID NO: 620834 - DNA, 668 bp, Homo sapiens
gtttcagcctacatcaaggaggtggaggaacggccggtacccagcccgtggggctccaagatgcccttaggggaactgatgttcgaatccagcagtagctgcggctgggtacatggcgtctgtttggctcagccagcgggagccgcgtggcctgggtaagccatgacagtcaccgtgctgcctggctgatgccagacaaaggaagtatgtgccgtcgcagtaagcgtctggccatcgtgtaaactacttattcgagctgactggcgctgaccgttcatacgacgagactaactagcctgtgtggctagcgggctcaccagactgcttcccggtgctgttcaccatatgacgccgcacgcggggatgctgagcttcgtgcgggcgggtggacgttcctaagcgagagcgtcgcagccgtggtcgttgacggaccgcgagcgcttccagaacctggacaaggaaggcgagctccgagggtgggatcggatgcgggcgcgggcctagactcgttgcacaagaacagggttaggcagatctcggtgctcagtggcggaaggccgagtgtctcgagttctgcaggcagatgggatggatgggggagtgagtatctgggatgtgaagagcttggagtatgcttgaatggactgaagatgaatgactgtgaggat

SEQ ID NO: 620835 - DNA, 209 bp, Homo sapiens
tacatgagaactattgacatctccaagactgctcaagaaaaagaaaagctctagagttgaagatgtgcctgaagtcttgacagaagctccaagtgccacaaccactactaccataggtatctctgcaacctggacgcctttggcaggttctcatggtagaagaaataataccatcactacaaacagttcatagaggtccaatcttccgg

SEQ ID NO: 620836 - DNA, 327 bp, Homo sapiens
tgtcgcattataatcctctttcaagggacttcgaaaactctactcccagctaagtagactattttgatgacttctaacaagcctcgactaacctcgccttaccccccactattatcctactgggagaactctctgtgctattaaccacgttctcctgatcaaatatcattctcctacttacaggactcaacatactagtcatagctctttcctgttgtcaaaatatttaccacaacacaatggggctcactcacccaacacattaacaaacataaaaacctcattcacacgagaaaacaccctcatgttcatacacctatcccccat

SEQ ID NO: 620837 - DNA, 231 bp, Homo sapiens
tctgtgtctagctaggggtgagctgcgacagcagatggcgagcaatctaatccaaatggactaccgttttgctacacaattgtaattcctgtgtcttagcctaattccaccaacttcaaggcagcctcaattgcacaactttttggaataatacggaggccaagtcaaggaaatccaggtattgaaaaaagcaacttgggagtaactatagggaagtgcaaaagtaagctg

SEQ ID NO: 620838 - DNA, 592 bp, Homo sapiens
gagagagagagagagagagagagagagagagagtgagatagtgagccacccatatcatcatatatctaggactttagcacaaggatagttgccatatgaatgaagctcttagagtgatttcttagggaatggacacaccaattaactgtcttctggccccacctttgatgttttcttcacagcagtgcactgacggatatgagtgggatcctgtgagacagccatgcatagatattgatgaatgtgacattgtcccagacgcttgtgaaggtggaatgaagtgtgtcaaccactatggaggatacctctgcctttcggcagaacgaacctcaggggcaaccaccgcggttgtagctgtcagcagcatggcaaccagtgtagtgtttcccggaggtgtgtttgtcggcagtgctgctgcagtcgcaggccctgtgcatactggcccagataactttgtcattcggcggaacccagctgaccctcagcgcattccctgcaaccctttccaccgtattcagagtgcatcaaggctactagccaagtgtacaccgcgtgccacgacatacacgagtgcactgcagggacccaccct

SEQ ID NO: 620839 - DNA, 950 bp, Homo sapiens
cgtgcccttcgccttctgctatctctggttcgcgtccttgccccctggtggctgctttgcggtcctcacccgagccgattcgggcttcccttcgtggcacccttcggggccggttagccctcctctgccccaggggtccaactggtcccgggggagctggtgaggcctgctcctcccctcgggagctatgtagtccttggagaagtttgtttcccgccctcctctttgaggcctgcctgagactggtggccccccatccctgggcccggaagactgggaattcctgcttaagtcgtggcttctagagtgttttgtgtggtaccccgctttctgctgccttaagggcgagtgggcatcctgtcgatgccatcgtcccactgtccccgacccgtccactaaggtggccggcccgggcccagcgtggggaccccagcccctacctctccaggccagaaccgggtggtcccgggccaccactgggcctggcctcttcccagccttccaggatagctcttgtttattttgggcgtccagacccctcctcttgtaccgtcgtccatccaccgctggtagagaccccggagtgcctgagttgtccccccggggtggcgcccacgctctgggagcccctcacgaagatgggatgtgtgggtggaggatgccctgtctcggtcagctcaattcctgcctccttcctgagcccgttcacgggcctgggggagagccccgcttggggtaatggacagtttataatacctgttttattttgggttgttgttggagtttacctttgctagatttttctctttcaccccgtgtgaactttgggtgaggtttccaagtagcttcaccccccgatggcttggttccccgggaccatcacgggcctcgggggccccgctaagtacaacgaagctttcgaaggagaagaccattaattcgctccccca

SEQ ID NO: 620840 - DNA, 936 bp, Homo sapiens
ggatatatacctgtcccgcggtaccacgtagtgggcgcaattgccctttcggaactaccattacgggtgttttttttattcgccctccccggggggacggcccaaaatatatactcgcttgtgaatgtccctgataaagggttgctaaaattgattgatgatgatcttagaatgagaacccgataatacccccggtagctactcttgtagtgttccccgcccaatggcccgtagtgcaatccgtggaggtgagagagctcctgaacccgtctgtcgcctcccagtttgtatgggcactattcctttccggaaacacgggataacggtcgttgatacatccccaccatggggcttggttgttgttaaaagcagtgttacgccgatttggctcgcccgtatttgataaaaaggggggtgtgttccacaaggtgggggagcgaccatgtcgcgacatgaatatgtgagaaatttgcttccggaatgtgctttaccacataataggctatcttctaaaatagtttgtggcaccttggtgaggagactcttcttttagggaagtagtggtgaaagccaagttgtggttataaaaatgtcccggcgtatgtgtcaatcttgtgggtgaacaccacgtgggatctaggcgggcccggtttagattaatggccgaggtgtgggtacttcgtcccagacccggtgttgctagaaatatttggcccaacagtggttacttgcccacgatagggcgtgtgaccaacaatgcgacgtatgcgttgtttaaaagcagggggcgcgcatcacccttcggcgggccattagataagtaaggggaactctattataggacaattttttttccggggggcaaaaacggaaattagggggggcaccaaaaaataaacgggtgaataaatccgattgtttatagtaacccgaaaa

SEQ ID NO: 620841 - DNA, 123 bp, Homo sapiens
tgaagtgctcctgctcgagggtccgttctgcaattccctgtgaggtagatgcggtgtccaaggcttctgcagcattgaggaaggaatggggccaatcctatagcagagcgaagctgtgctctc

SEQ ID NO: 620842 - DNA, 1019 bp, Homo sapiens
gtgtcattaaaccccgtaactggctggcatgctttcctgctctgtattcatatacattatggctggatgaaaccaaggatagttacaggtatcattgtccaaaataacctaactgcagcagaacatgtagcacagtctgcttagtacaggcttctcacttcctacagacctgaattcaacattcggcatagtctgcagattctctaaatatcccaaagcaacaccactgttcatcttccttgctgctatcatcacccaaccactaacatccatgctcgcttcaccgaatattagtatatggcgaaaggcaccataggcttgcagcaagcagcttcaccagctcacaatccagggtccaatcatcatcacgattcatcatccaccttcattaacaacccaactggtacatcacatgacttgcacggactcacacgccttacgatgccatctaacaccgatattaccaatatcggacgacaccctgacagctaataggtggcccagcagtgcacttaggataacacgttcactacattacctgagcatacagaatatggcaaacacagcttctggccagacctcgtccaaaatgtgctccaatcactaaaggacttcaatcaaaaaaatcaacactgtatacacactaccaagcgcacaaacagcacgcaaaagtgtcaacacctttacacaacacacaatgaatgcagcgacaaaacactagtgagaagacactagagattaggaccagtaaactagccatagtggcatatcattataggcaaacacgactatcaaacattcgtcagccgtctcaccataaccgtataacggaggaattaatcaatgggcaccatcttcccgttcaaaaacgacatattatccgcatctagaggcatgtagacccatattcaccccatagtaggctagtggaacacaagtattttctcaagaaacgatctaacattctactcattaggtagataacatttatatagtcccaaactattttccccccagac

SEQ ID NO: 620843 - DNA, 511 bp, Homo sapiens
cgtggagacgctccacaccctccagaggatgtttggctgcgactgggccggacgggcgcctccttccgcgggttataaccagttcgcctacgagtggcaaggattacatcgccctgaacgaggatctgcgctcctggacctgccgcggacacggcggctcagatcacccagcgcaagtgggaggcggccctgtgaggcggagcagtggtaccctacctggagggcctgtgcgtggagttgctccgaagatacctggagaaggggaaggagacgctgcagcgcgcggacccccaaaagacacaggtgacccaccaccccgtctcttgaccatgaggccaccctgaggtgctgggccctgggcttctaccctgcggagatcacactgacctggcagggggatggcgaggaccaaactcaggacactgagcttgtggagaccagaccagtaggagataaaaccttccagaagtgggcagctgtggtggtgccttctggagaagagcagagatac

SEQ ID NO: 620844 - DNA, 939 bp, Homo sapiens
  misc_feature (427)..(427): n is a, c, g, or t
  misc_feature (592)..(592): n is a, c, g, or t
tggcagtaaacttcttttaaagggtctcttgaaagttacaataggaacatcatgtgcaaaactgacagccgtccaaggggcccagccgacaggacttggcttcttccctgtgcccgcttcggccgggcccttccccgagcggggacacacttgcagggctgtggcttgacgccctgtggttggacaaggcaaagagcctttccaccccgcactgaggctcggtgtcccttcggaagctctccctgtgctctcctttcacagttaagaggacctgtgggccgcccggggccattcttgcaccgggcgccttcttccctgtggccaccaccagagggcttgacacgcaggctctgtgggcaggttctcctttcgtggaaaaggcctatattgagcagactgtgcgcgcgagaagggtgtgtgggttgcnccccccacattccagctgtgttccatctacagtgcgtgaagttccgtggtctcacatgttctgtgcagcccacaggcgcccctcaagtgctcgctgtgcgtgatatgttccgaagaatcatatgcggctcccaacttcttatccccccttcttggagtggttgcncggaaccgggctatatcaagaagttgttgcccgtgtggcccttgtttcccctatgtgggtgggtgagaacgtggacttgtttggggttgccaccagggggccccgcccaggttgccttgtcacaaagcgtgtctcaggtgaataaactgccgttgtgcacaatccttttaacgccacaaagggttcctacacgagggaaaagtttttcttcgaaaagtgtgtctgggtcgtgttcccttttacttcgaggggacatttacaagggggctcttcaaatacccaagacagagagggcaaatcttggcgggtgtgttcccccgttaaaaagtcctgcccggcaaggtttg

SEQ ID NO: 620845 - DNA, 573 bp, Homo sapiens
cctgccgggccgggcacatggatcccctgttacagcaaacgcacaagcaggtccacgaagatcagtcttgaattgtacaactggagacagcacacaagaagtgtgtgcacatattacctaacgggaatacatgttaccatataccaggattttcagtcgtctataacgtccggggattctgacaacagggggccccctttcaaaaagtaaaatgccaaactttctgttgaccagtctaagtttgatgttcacgctcctgttaaacagggtcaggaactcccaccactggcgccaaacaatgttacagtaggccgacacagagaagtgagcgtcctgctccaaccttcaccattaatgactttgacaccaccataccaatggacgagatactgcatttaacctccgcattcagagaggcacaacgccccggatgacctaattttagatgggctcaaaacaaaagaggggactgacgacccaaagactgaccattgatggggcctcataagacgatactctgaaattggcgacattctgtgcatgagcaacaacagtgttgcggcttaattttta

SEQ ID NO: 620846 - DNA, 350 bp, Homo sapiens
tttttcgttttttgagacagggtctcaatctgttacccaggctgaaatgcagtggtatgatcttggatcactgcaaccttcgcctcccaggctcaagccattctcccacctcagcctcccgagtagctgggatcacaggcatgtgccaccacacccagctaatttttgtatgtttagtagagatggggttttgtcatgttgaccaggctggtctcaaactcctggtctcatgtgatccacccacctcagcctcccaaagtgctgggattacaggcatgatccaccgcacccagtgaattccactacttctcccatatgcttataaatctcacaagaaagcctcttggact

SEQ ID NO: 620847 - DNA, 405 bp, Homo sapiens
cttcatacttagtccagtgaaaacaggtgaccctggagcacagccagactctcaagtgcctttgggctcatcagagacaggttacatatacaagttcttgattggaacttgaggaaatatcaactctatcggccagtcaatggtgctgtgctgtaaatggctactcatttgaacgaatgacctcatcccagttcctctgggcaggagagaacttaccactgttggggcaagaggacagtttctggtggatatgtagattaaggtgcccaggagtcctctgaccagggaagtgttagggtgccatttctgtaccaaaagctgggtgtgttgcatgttaagcactgtagccaagaacaagcgactcttgactcttaattaaacagccctgttttctctttgcctgtg

SEQ ID NO: 620848 - DNA, 623 bp, Homo sapiens
cgcaacttgatctgaagtctatacatcagacccaactaaacccctagctctacttagatcaacaaatatttcggctcctgtaggcctgcgtcttccatctgagactagttaactgcatgcacaggaccacactcagaaatgagcacataaacgcgggcccaacaccagaatagagccagtacgacccacagttgaccaagaatgaacattgactaccacaccacacgtcagcatgagatcctgtatggcatcaaattgcaacttgagcagtaatgagcagcctcactatcaactcaagcactcagggcacacaagatgcagtaacacaacatgactagaccagctctggagtccagtaactcactgtcagcacggtttcgcgatatagctcaagaaggtctaaacagagccaggcacagtaccaaggcatgctcaagggagctattgcaggcttctaagatacgagagttattccattctgagagcacggattcgacctcccagaggcctaaactcatcaccgtatcaaacgatttcccgaggtacctcaggtattgcccagctgacctccgcagcctgcctattcatgggatgactgcatcctcctactggattctcctctc

SEQ ID NO: 620849 - DNA, 794 bp, Homo sapiens
gcggagctgacggcagctgcagtggaaaccgaggcggcgggacgcaaggccagcagacaggccggcagagggtcatctgcgtccggcacccaggaggctcgtggtcctgcctttgcctgggctgagggtctctggccccgcagctctcttggaggcgggcctgtccctaagcccgccaaaggggcgccgcgccgatgggctgcggagtgtggcggactggactgcccccgaccccgtggaaggggccgttcggccgtgtggcctggaggacgagggctctccccgctcaggaagtgtgcccctggtgctgtgttgtgacctgggagtcctcaaacccgggacttgaggcagcggtctctggggggcgatcgacgggcgcgtctgcctctgaccccacgacgtgcaccctggggtcatgacaaggcaagtcggtgacaggacgtggatcggtaccaccgctgtcctggccaacctagctgctggaggaggataacaagttatgtgcagattgcccagtctaaagggccgcgatgggcctcttggaacattgctggtgttcatctgcattcgatgttgctggaatccacaggaatcttggggggttgcacatatccagggttaaagtcaggtaaaccctcgaccattggactcaagaaccagaattcagtgcattgcacagagatggcgacaatggcaaggcaaaccgagtttatgaagcctatcttcctgaagactttcgggacctcagaaagacccagtgttgaaggattactcgagacaatatcacagaaaag

SEQ ID NO: 620850 - DNA, 614 bp, Homo sapiens
ccaaccaaaggggggcaggcctaacttctcaaaaaaaccatttttaacccaatctctgtgtgtagggcaaaaccccggggccggtttttgtcccaattgaaaaacaggttattttagtttctgtcgtgggaaaggggaaagcatcccaacaaaaggtttttaatgtagatttttttttttgccccccatgcgtgttgattgctaaatgaacacgtctggtcggcccgccgaataaatgtcttttttttaatgggctggggaaaggtagtcccctcttaaacccttttggtaaatttcccccacagtggaaagttaaaattccttcagggggaagccaggttttttttggaatttaaaaaccacccggttggggggaaaaacccttgtcttcggaaaccctgggggagtttaaataaaagtttctggtgtgacctgaagttcccccttaaaaggggttcccccaaccaaatcatgggatggttaaaaaagtgattggtggcccctcccatgccatatattttaattgaataatggggcccaataaaattatagatgggaaagaagcgtggggatcccttatcatggggaaaccaaaaacgattttattttcttta

SEQ ID NO: 620851 - DNA, 916 bp, Homo sapiens
tgtaaacccttggccctgttcttcgtagctgctgtgatatcccttgccgatgttttgtgccccctacattaagccggggcacactttctctggtgttggttcttgtggcacttcaggaatggttcacaaacagggggtttcccctcctaggcccttccgttgtgcgaacgctcttttgtcaaggccatgtaatgtgcccattttttacctggctgtggacaaaggttatctgctcttggccctctcggtgtgttgcggccccagagtttgaagaattggcacagggacaccgattggtattgttgcccccctgtgctgaggcctgaggcctcttcctcagctttatctccctgttccttcactcagggccctttcccccgtccctatttcccccatcccctcccggcttatatggccccccaggtgctaatttgttgtgctggcccacaggcgtggggctacccagccaaggcttggcatatacccaaggccaagctgcatggccactcagtttggtctttttcctttgcggtcatgttggctttcacagctggagtcacaaagttttactttcccacgaactggtggcactttgaggttccccactcctaccacctctcaccccacctttcctgccccaccctaaaccctcgttttagtaaatttgtagtgagctgttcccttccctttgttgccacggggaaccacggaggaaagggaaagatgttgccatatttcctactctttaggcatggactctcctttccctttgttagtgtcctgggttcccactggactccacgggatttgttggctaaggttttctctgtgcaaataaaaaaaaaaacatatgtatatatattttaatacacatatatattgtaccagaattaaaatgttttattgaaaaccacca

SEQ ID NO: 620852 - DNA, 205 bp, Homo sapiens
tggtaacatcggtactaataaggggaaaccggaaccgggggcccccttatgaatatataaggtgtctaagggatttggagttaatataaacggataatatggtttccaaaggttaaatggagatcttccactttctatctagttagagggcagatgtccaaatttaaaattattccccttcttatatactaaaagggtgggggat

SEQ ID NO: 620853 - DNA, 1028 bp, Homo sapiens
ggcggcgcgcgcgcgggcggcgggcgggctggggatccgccgtggcagttgccagcgccagatgcgagatcccgctgccccgcgctctccggcccgtcgacctgactcttgggactcgcgagcccggtactcccgccctgctctgttcgctgtccgacgtatgtgatgctgctgtgttagtcgaacggtcgacccaggcacgcgccccgggaccgggccggtaccgcgcggcatgcatggggtgaccgaggcgatgtccgtgccagagcctgtcgtccgagctggcaggagcgcatacggtaccacacgcttgcctccgtacatatccaggtgcgatgcaagactgggcagataaagcctgtcacgatgcgggtaagatcgctggccttacgtggcatggctggcaggctatggtggacggagccgagtctgcctgatgcagcgtagaggaggctcgtatcgcacacactctgaggagcgaatggaaacttaaccatgcgcgtactcggcgtcactcttgatcctatggcgagtccgtgaaactgcgcgaatgagggacgacgagcacttacaaggatctcacatgagaggtagccggggacttggccagtgacgtcgcattaggagaggcatcacctacaagacgtgagacgacatgacgtataccagcaggcatcctcagttaaacacccgaagccagaatatagagaccctttgatcacttagttcgttaaccgacccggtgagcccaaacaggcataggtacgttcgtaccgtccgcgaacacaaagacaccgcaggcggcgcaaactttggagggaaacgcgggttggcctctggtggttccacccttacaggtaacaacaatcgcctcaacaagaatgaacgaaaacaccaagagcgcacatggccatgattagcaactggggccaaccaaatggcaagaagtacccacttggacgacgcatatcaaattaccttgacacacccggagtggtccgtagtcactggaacccccggttgaacgc

SEQ ID NO: 620854 - DNA, 177 bp, Homo sapiens
ctctttgagcctttctgtctcatatggaaccaggaggaacaggaaggggctcctggcctctctgtgtactctgcagtgggggttgtggggggcgcagcatccacgccttgatgcccttctttcatgaagtctgtttattaagtgctggtaccccgcgaatattttatgcagaagaga

SEQ ID NO: 620855 - DNA, 504 bp, Homo sapiens
ctgtcggtgtaggctgtggccaggagagactgtagaagctcggtccctgtgtatgtttgcatatgacatcatgcattggatctgcttttgtattttttaaccatacctatggtggggcgggtgccggtagcttggtacagtcaccatatctgagggcgtaagtgagcacatagttgatcgtcctcttggccattttgaccctgagtgtacagtcacagcttcaggtcatgtctgagtgtgacacaaattccccccagcttcccttggtcagccccactccagcacggggtgaacggaggcccaaagttctagggaaggaggaagggaggacatgcctcttcttcctcctttctttccccatctgttcatggaaaaagtttgtctttattatctttaagcccctttaccctggtcctgtactgatcagtgaaggaaaccgtggttactgaggccctgttgaaaagtgcacgttttgtccaataaatcacgctgcagttggtgtcc

SEQ ID NO: 620856 - DNA, 119 bp, Homo sapiens
gctggccctgacactgacattgaggcaggagaatacttgacactcgggaggtggaggttgcggtgagctgaggttgtgccactgacagctctacctcccaggctcaagaggttctcctg

SEQ ID NO: 620857 - DNA, 210 bp, Homo sapiens
gcgatcccctgtgtagcaacaaatactaacgtacaatatttttaaatccatcaagtggttatcatttacattattctatagaataagaaatgtcattatctagagaactagaaaaagttggatgttctgccgtttggagcaaatgggacacaagcattagtgatgaattatggagaggcaactcgctttcgttctgcttattacatcttg

SEQ ID NO: 620858 - DNA, 111 bp, Homo sapiens
gggagttgtgggacagctgatttgtggttgttaggtagagacagcatctgctcgtcaccaggcagttatgggtgcagggcgcaattatggctcacttcagccccgacttcg

SEQ ID NO: 620859 - DNA, 395 bp, Homo sapiens
gttgtgtagacgacctctgggaactctgggagtcacaggccagcaaaagaggttagaagggggaaaagattacggcaggcagatacgtaggctgcacgctggaggcagatcagtgggctacaagctggacccagaactccctaatgagagagaagaaaacaggcatcagatcgaaggatgggtcagttaatttagcttaaatccagactggaaacacggcatcagcagcagagagagaagggtcacccggccctagacacaaagcacccaaagctcttgtggtgggtgcctgacatagtattcaagatccccagccgggtgccgacgtacttcccctaacatctgacccctgctgttccatgccccgccttggccttgccatatgcaagggtacc

SEQ ID NO: 620860 - DNA, 106 bp, Homo sapiens
atggctgaatctagaggatcccgaaacctaattacggagtgctccatcccctacctgactcaatctggcaggtgtggaggaggaagccaaaggggctcctgccttg

SEQ ID NO: 620861 - DNA, 994 bp, Homo sapiens
  misc_feature (994)..(994): n is a, c, g, or t
ggcgtcatctattctatcatgtttgcacgcacgctcactcatagcgctaagctcatgctgattgtgaaccgtgagtatgcctagatatgatcatgttagctgccatgccagtactaatgaaaaaaattctgcctcgttccacttagtagtctgccatcaatgtatccctcctcatcggcaacgtcaaacgacattgcgataaatccttgttctacatatgactgaattcctcattcaatgaggatatattcctactcgggacacagtgaaacgcgattagaaagcaaatgagtaccaattgcaaattactcagtcatttataatcataaatggtctcatagacgacggagaatactcatgcaataagtcccgctgttgccactattctgtagggtcccttgaggttgaatccaggggacccctgcgtggatatcccggcactgaattgtctgtcatcgactagtggaacatacaatattgagcgcgcgcccgagtcagtccaatcagtgattaccacaatcttctcccctccatttaggaaatgttaggagccctctctgccttcgactctgcgtcagatcttatcccgatcatgagtcataggacagtagcaggctgggattcaataccgaagaacgccagtctcatggcacaaatctttatgcattacgtcctccaatgtgacccacgatcaggcactgtaatcaatcagccaggttcttacccggtacaagactttaagataaccagttcttaatttaactagtttatacttatcgctagtctgagctaggcgccatttcgtactaactcaagggttaagattgccagcagcagcgatcctaaatactattttcgttgcctgtaaacaagggtaagcatggagttaagtagcctttaagtttcattccagaccttcgtactgcctaggagagcctggcccccgtttaccggtttttggccaaatgggccatttgttcggacaattcccgan

SEQ ID NO: 620862 - DNA, 1095 bp, Homo sapiens
gcctggagccgcggctgggcagcaggaacgctgcagcactagcctatgggaaagccccaggccctggccagcctatggctggatggcacaggaggcaatgcaaatcgtcgtgaacgtctccttgcatcctaacgtccgtccatgcttggccattattagcgcctagtagcaggtaggagactagcattagcacgtacgcggtagttcagtgggacacaagcattagtaccttagacagtacagaacacatcaatcccaccgggagagccttaacaccaccatagagccatcttcttagttaagccgacgatagaggtaccaatcaattcagacaagatagagagtcgttcctttccccatcctattcccattggcagactggcgaccctattctaccggcttggcagacgcccattgagccatcgaccggcagacagctgccccccttggccccaaacagggggaaagagcacaaccttaaacttatcggctccttaatacactagaaataccaactcgacttaatagggcacacaagtccctcgatataccacataggaatcacatacaaatcttacattcccagttggaacttcagaccgaatagacagcaaacaagcgtctggtcgaccaccgaggccacaatgcacgcaacagatagcatgaccccttggagccccacttaaccttcggcgctttgggttactcctccacaaagcacagggccactcttcacgcacaggaggatcatgcgccacatctaggtttcccgaaacgcatcactgcatttccttcggtacagccatacctagcacaccccattacacaccgcttcattaccccgccaggctggcaccccaaccgccccacacaggccacaattctgggggacatggacacgaactgttgataaaggcgccccagggcaaagagcgataacacatcagcaccaccaaatcgcctcaacagcgataccccatgggacctcatttactccgagctaacatttcccccctttttgtggtgacatcacccacaggtgggaacattttgggcccacaagaggtggcccaatcccgatccatattcactgat

SEQ ID NO: 620863 - DNA, 209 bp, Homo sapiens
  misc_feature (163)..(163): n is a, c, g, or t
gacgtcgaccaggttggtctggaactcctgacctcaggtgatccacccacttcagcctaccaaattgctgagattacaggcatgagccaccactcctggcccacaaatctttaaagtggtatttttcacaactgcaccttgtggtgccatatcctgattgacnactttggacaactgaaaaaacacaaacaaaaaccacaacaaaacac

SEQ ID NO: 620864 - DNA, 603 bp, Homo sapiens
  misc_feature (296)..(296): n is a, c, g, or t
  misc_feature (343)..(343): n is a, c, g, or t
  misc_feature (371)..(371): n is a, c, g, or t
  misc_feature (378)..(378): n is a, c, g, or t
  misc_feature (392)..(392): n is a, c, g, or t
  misc_feature (405)..(405): n is a, c, g, or t
  misc_feature (408)..(408): n is a, c, g, or t
  misc_feature (428)..(428): n is a, c, g, or t
  misc_feature (529)..(529): n is a, c, g, or t
gccaggaggagggtggatctccccagagcaaagcgtcggagtcctcctcctccttctcctcctgctcctcctgctcctgcagccgcccaggctcccccgccacccgtcagactcctgcttcgaccgctcccggcgcggggccttccaggcgacaaggaccgagtaccctacggccggagccacgcagccgcggcttccggagccctcggggcggcggactggctcgcggtgcagattcttcttaatcctttggtgctgagacacatcatggagggcagtggtggcgtgggcaagtnagctctgactctacagttcatgtacgatgagtttgtggaggactatnagcctaccgcagacagctatcggaaganggtagtnctagatgggaggangtccagatcgatntcntagatacagctgggcaggangactacgctgcacttagagacaactacttacggagtggggaagggttcctcaggggttgctgctatacagagatggaatcccttggagctacagctgaccncaggggagcatattttaagagttgaagaacgatgagaatggcccagtttcactgggtgggaaccaatcagtttg

SEQ ID NO: 620865 - DNA, 340 bp, Homo sapiens
  misc_feature (19)..(19): n is a, c, g, or t
cccatctgtgtctctgaantccagctattatagataccctcatgtaagtcccagtcctgtggcattccgtctttttgtgattggcttatttcactgagtgtaatgttacccaatgttcatcccatgtgatggcagaaattgtgtggattttttttttttaatggagtttcactctaggctggagtgcagtggcgtgatctctgcttactgcagcctctgcctccccagttcaagcttcaagagtctcctactcaggaggctgaggctaaagaatcacttgaacctgggaggcagaggttgcagtaagccaagatcacaccattgcacgccagccaaggcg

SEQ ID NO: 620866 - DNA, 148 bp, Homo sapiens
  misc_feature (1)..(1): n is a, c, g, or t
  misc_feature (6)..(6): n is a, c, g, or t
  misc_feature (53)..(53): n is a, c, g, or t
nggagnctcacattctttcttttcccaagtcccgcatcgtccgcagcttgatncccttctctccgtacgagcccctgaacttccacgacatgttccagcccttccttgagatgatacacgaggctcagcaggccatggacatccactt

SEQ ID NO: 620867 - DNA, 569 bp, Homo sapiens
gcctcccggcgcagtcacctggcgcggactatggctgcgactctctctaatgtctgcttcggtatgcccggcatgctgcagccaggacacagcttgttcccttcgccttcgccctttccacctcgcggacagttcgaaatgacagctgtagtcagttctcatggaaggacacacgtggcccagccagcatccaagccggtgaaggtgccggcctggcactcctccacacccagtgcgttggccttcagcgcacacacaacggctcacacaccctagacgtggagaatccctgggtctcgagccactgaacatcctggaacaggtacaattccttcatgtcctcccacaccagaacaaccaagggcaacgctacgcacatatgtgggcaaactcaaaccaggtgaggcacaacttaattgcaaccccccatgctcacaaaatacacaacgacggcaccgacatatggtgcgacttcccactccacataacacctgacctacatccgaccgctcactttgtcaccttcggcctccctttggccccacgttggcctccttcccagaagccag

SEQ ID NO: 620868 - DNA, 107 bp, Homo sapiens
  misc_feature (5)..(5): n is a, c, g, or t
tgtantgtcgttggctctgagcaaggaggcgttcgtccggtattagttattcagaatgaccattggaaagtcggttcagtcccgactggtcatttgttggcggcgga

SEQ ID NO: 620869 - DNA, 336 bp, Homo sapiens
ttgtgtgaacagagaaaactctgtctcaaaaaaacaccagtcaagcataattatgtgcttccgtctctgaacagggcaaacagtctctgtcacgcagacacataaaaggtacatctctcatttgctgctctcttcccctaagtgccagcaagaagcaaagcgtggtgatcaacaaggagggcacccatcatctaagagcgcgacaagccaagcagtggtcccctccgtgagggacacggtcccctcatgaagccgtagaacatacgagagactacaggacctgagcactacaagtttacctattagttggtcaagtcaatattcctttatgtcgat

SEQ ID NO: 620870 - DNA, 929 bp, Homo sapiens
  misc_feature (3)..(3): n is a, c, g, or t
  misc_feature (83)..(83): n is a, c, g, or t
  misc_feature (85)..(85): n is a, c, g, or t
  misc_feature (92)..(92): n is a, c, g, or t
  misc_feature (94)..(95): n is a, c, g, or t
  misc_feature (107)..(108): n is a, c, g, or t
  misc_feature (152)..(152): n is a, c, g, or t
  misc_feature (154)..(155): n is a, c, g, or t
  misc_feature (172)..(172): n is a, c, g, or t
  misc_feature (186)..(186): n is a, c, g, or t
  misc_feature (217)..(218): n is a, c, g, or t
  misc_feature (221)..(221): n is a, c, g, or t
  misc_feature (244)..(245): n is a, c, g, or t
  misc_feature (248)..(248): n is a, c, g, or t
  misc_feature (251)..(251): n is a, c, g, or t
  misc_feature (256)..(256): n is a, c, g, or t
  misc_feature (258)..(258): n is a, c, g, or t
  misc_feature (261)..(261): n is a, c, g, or t
  misc_feature (266)..(266): n is a, c, g, or t
  misc_feature (270)..(270): n is a, c, g, or t
  misc_feature (275)..(276): n is a, c, g, or t
  misc_feature (320)..(320): n is a, c, g, or t
  misc_feature (407)..(407): n is a, c, g, or t
  misc_feature (521)..(521): n is a, c, g, or t
  misc_feature (530)..(530): n is a, c, g, or t
  misc_feature (544)..(544): n is a, c, g, or t
  misc_feature (552)..(552): n is a, c, g, or t
  misc_feature (556)..(556): n is a, c, g, or t
  misc_feature (613)..(613): n is a, c, g, or t
  misc_feature (617)..(617): n is a, c, g, or t
  misc_feature (622)..(622): n is a, c, g, or t
  misc_feature (838)..(838): n is a, c, g, or t
  misc_feature (864)..(864): n is a, c, g, or t
  misc_feature (880)..(880): n is a, c, g, or t
  misc_feature (884)..(886): n is a, c, g, or t
  misc_feature (888)..(888): n is a, c, g, or t
cancaaatactttaaatccaattacattccaatccccaatcttcctcccttttattttccatctccataacttcctcttatgnanctctctnannatattctgaaannatttattaataattaaaatttaattccacataaaattttaaaanannaaataatacagtaatcnttaatccatcaaanataaattaaaatttaaaaccacatataaggnnaancccggaaatgcttcatctggtgnnctnttntattntnttnttttncatnacttnngacacagccactgtgaaatgcgctgcgtatctcattcactcacntcagctaatgattccgacttggcagacgctaaactcatggaggttcggtctctcctgatacaaaccaaatggctacctggaagaatntctttcaagcaacagttatttttcttatcctcagggttaaaatgtataaaagttatgtgtaattaatctataatgccataaatgataatgcaaaacctaaataatatggtggcnggaggggcngccttatatttganacatgctntctntcatgcatcgactgtatgcattttgttaatgcacattctgtttgtttaaggtgtgtnaganacacncccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaactcgtttattgtataatgcatcatttgaaaataccaaggagnaaataccctttgtttttaatgatgcnagagtggacgtaatgntgtnnncngtattttattgtaagcagtcaatcagaaaattgtgtttgta

SEQ ID NO: 620871 - DNA, 290 bp, Homo sapiens
gatcggcgcactgctgtctgctgtacgaacgcagccaggtaccatgtgttgcgcaggaggcccggctggacgccctttgagggacccagccttgacaagctgctgtgagggacagaactgaagactctgcagccctcggaaccccactcggagggtgccctcttctcaggcctcactagcacctctccctattcaaattctacctggaccccattctgagctccccatcacaatggaaggtggggcctcaatctaaggccttccctgtaagacgggggtagcggcaaaag

SEQ ID NO: 620872 - DNA, 278 bp, Homo sapiens
  misc_feature (267)..(267): n is a, c, g, or t
aatttgtacagttaacacagttatagtggtcctgaggtgatgtacatcctcagcttatgaagataacaggattaagagattgaagtaagacaggcataagaaatgataaaagtattaatttgggaactgataaatgtccatattaaaatgaaatcttcataatttatgttcctctgccatgactccagccggtccctccatttggggccctgacttcccacaacatgaattgttcaaagtctcagagaatgtcagcagcctgggtgncagaatgaggc

SEQ ID NO: 620873 - DNA, 156 bp, Homo sapiens
catccccgtcacgttcttgtgatagtgagtctcacaatattggttgtttaaaagagtgtagcacctcccctggctttctcttcctcctgctcctgccatataagacatgcctgcttccccttcaccttccgccatgattgtaagtttcctgaggcc

SEQ ID NO: 620874 - DNA, 228 bp, Homo sapiens
taaaatgccctagcccaccttcttacacaaggcgcacctagcaccccgtgtttccccatactagttatgatcgaaaccgatcagcctactcattcaaccaatagcccgggccgtacgcctaaccggtaacattactgcaggccagccttactcatgcaccgtaataggaagcgccaccctatgcagtatcaacgcattaacctgtactctgtacactatacgtcgtag

SEQ ID NO: 620875 - DNA, 114 bp, Homo sapiens
atcagctcggtaccagtgctactccacaaacagagagagagagagagagagtgagagagagagagagaggcagatctaatatcctctgttccaatccccagctctcatctaggg

SEQ ID NO: 620876 - DNA, 847 bp, Homo sapiens
ggatttcccgcgcaggtgcgcctcttgtggacacccctctttcccctcacgctgtaactcaccctcggagctttgccccaacgccccccaacatctccccctgggaggacacccaaggcgccgcccttctcggcggattaagcacgccgcctcggggcaccgcatcgcgcacatacttgcgcccccctcgcggtgtcatccccccactgagtggtgttgtgcgcgcatcttgtcatttcccctcgcaggggcacacagcactgcaggtgcctccacaacgactgcgtctctgtgttgcaggcgcgctcatcgggggatatatcttctcctggcgcccgcccccgtagatactctttcacacaggcgcttgattccccacaggggccgccacagagaatacattattccatgagcgagcaagtggttagagatggttgtgggagagagcagagatatgactctcctctttcctcccctcacagggcaggaacaagttgatatactgtatacaatgaacgcaccgttgattcataagagcacagggccgctcaaacaatgtatgtatagagtcaagcgattgcgagttcaaagggggacaaccctctcgtctgtgtgataaattctcgaaggtccgtcgtgggtctctccgctgtgtgccgacactgtcccacgcccgcggctatgttgtccgcctataggagaggactctccatcgcctccggcgctttcgctcgctaacgaggcaccactccaagctactgctatgccgtataacaccgccatccacgcctttgttcgtcatatagacactttcctgccccatcccccggccccccatagaacacaa

SEQ ID NO: 620877 - DNA, 150 bp, Homo sapiens
catggtggatcttggctcactgcagccattgatctcctgactcaagtgattcccccgcctcagcctcccaaaatgctgggactacaagcgtgagccaccaaacctggccttatcctctccttttcttataaagacaccagccattgcact

SEQ ID NO: 620878 - DNA, 383 bp, Homo sapiens
aaaatccctttccctattatattcagcggggtaaatttaacttttttcccccaaccctttttgggcctatccggaatgccccgacgttactggggcttccccgatggataccccccatggaacatcctatcattgggagggtcattcatttttttaaccgccggaatattaataattttcatggtttgagaagccttcgctttgaagggaaaagtcctaatagtagaaggaccccccctaaacctgggggggctttatgggggccccccccccttccccccctttgaaggacccggatacataaaattttggcaaaaaaggaagggatcggaccccccaaaggtgggttcaagcccaccccctggcccccatggctttttcca

SEQ ID NO: 620879 - DNA, 264 bp, Homo sapiens
aatgacctgtggacacactgtgaccgcggattatgtctccgcgatgtgacttcgctttcagcctgtacaagcagtagtcctgaaggccctgatacgaatgtcatcttctccccagtgagcatctccacttgccttggactacctgtctctagggggcccaataataccaccactgacagaagattctcacaaggcctacaagttcaactctcacaggagactcctagaggcaggaaattcacccagagcttccaggacctacct

SEQ ID NO: 620880 - DNA, 441 bp, Homo sapiens
  misc_feature (134)..(134): n is a, c, g, or t
  misc_feature (191)..(191): n is a, c, g, or t
  misc_feature (242)..(242): n is a, c, g, or t
  misc_feature (259)..(259): n is a, c, g, or t
  misc_feature (265)..(265): n is a, c, g, or t
  misc_feature (284)..(285): n is a, c, g, or t
  misc_feature (363)..(363): n is a, c, g, or t
gccggctacctatggtggacgagtattgtacacttcacatctatacctgacccttcttcctttctgcttaatttctcttactcaacttctgtattctctggtgcttttgttgtcttttattttttgtgttttanagcatatcagttttctaaagatagtcttttaagcgaaattatatagaagaataaagnaatgtacacctctttattttaacatggtattatttctgggtattctctccnttcctggaagatctgangtttcncggtctggttagtagttcnnccttcatccttggaagaacctcctttaaagatttcttggtagtatacatcttatcttgaggaaaatgtgttctaaatngaattctcgtaagcgtgtcatttattctgaaaatgtcttttactcttgattttgaagcatattttcactgtatgtgca

SEQ ID NO: 620881 - DNA, 295 bp, Homo sapiens
aggtgatgtgcttcttctgcacacatagacatgtttccctgacccccgtgtgtataggatggccccaggctacatactgtatgtctatatgtcaggtccaatctgcacttacgtagctttacactacatgaactcactctacggtgaactttaggacctataccttgcagaggcacatcgatatgtcaagtggtgctgcactagaaatatttcacgtgctacgatattatacttgtgcattataggcactgtccagtatccgagcctctatagatggcgaaagctagctgcgttc

SEQ ID NO: 620882 - DNA, 689 bp, Homo sapiens
aggacagctcggacccacacgtgtgtaccgcagatccgggggagttggtgggttcctggctatctgcttgagattagagatggactatatttctatctgtgaaaagctaacccagcagttgcttagtggcccttgtagtatgtgtatgggagtagcggttaagcatcttagcagcatgagtcaattgagcgtgtggggcgtgggacagactctggagaacaactgcagacgtgtaaatttagctgcctaacagtgtacactctggagacattaaatctgtccatgcccactgttgaagctggaggcaacggcctgagcacccaccacttccaagttgccttccttcatctgttcttgttgatggagtgacggtccgtggaacaaaatagcagatggaaatctagagaaatgttgaacaggcattgccgataggcttaaaactcaaggggtacaattgctgaaatcacttcctgcagcccgcaaaaaccaataaaaaaaaagctgacaacaagggggtgaatgacaatagtgacttaagagaactaattggccttaagtatactgtcatagaattagtagtgaatagacctcaaattacatacccaaataaacaacataacaatatccacgaccgtataacaccaccaacaaaagacacaaaccgcaattttacaacaatactatctgca

SEQ ID NO: 620883 - DNA, 363 bp, Homo sapiens
ggaccgatagctcatctcaattgatgcacagaaagcacatcagttcatgattttaaaaattcagaaaattggccgggcgcggtggctcacacctgtaatcccagcagtgtgggaggctgatgtgggcagatcaggaggtcaggagtttgagaccagcctggccaacatggtaaaacccattctctactgaaaaaatacagaaattagccaggcatggtggtgggcacctgtagtcccacttactcgggaggatgaggcaggaaaatcgcttgaacccgggaggtggaggttgcagtgagccaagatcatgccactgcactccagcctgggcaacagaccaagaccgtgtctcaaaaaaaaagg

SEQ ID NO: 620884 - DNA, 230 bp, Homo sapiens
  misc_feature (23)..(23): n is a, c, g, or t
  misc_feature (48)..(48): n is a, c, g, or t
  misc_feature (114)..(114): n is a, c, g, or t
  misc_feature (143)..(143): n is a, c, g, or t
  misc_feature (147)..(147): n is a, c, g, or t
  misc_feature (198)..(198): n is a, c, g, or t
  misc_feature (221)..(221): n is a, c, g, or t
ctcttagcctgaatgtggacgtngatacatatcacttcagggcttggnaaagtcagtcaacttgacgtacattagttagtcgacattttctgaaagcagtcagattctataaanggcaagtcaagcctgaagtgaggatactngcanttcacggagtaaaagaacagcagctctttaagctgatgtgcattttctctntggggggcagaggtaactgtcantcattgcag

SEQ ID NO: 620885 - DNA, 1331 bp, Homo sapiens
  misc_feature (78)..(78): n is a, c, g, or t
  misc_feature (192)..(192): n is a, c, g, or t
  misc_feature (268)..(268): n is a, c, g, or t
  misc_feature (833)..(833): n is a, c, g, or t
gagaagctttctactaccattcgtttggcggcgctgggcgcctagataggtaagtgaactatgtgtcactaggcatgntttccttagtgagaattcctgggtcagtgagctagatgctttgaggattcgtcaccagaatagagaacaacgccccgggtgtgtgaagcgcagagacgttcctggaacacacantcgcaggatgggagagttctagatcgcgtcagttatctttgtgagctctaatcacatcaagagatagtctctatangcaagatcgcttcagatctagtcacattagttgagcaagccactcagcttcccttgaatgtttcactgcactcgaatttgtagcctcgtttccgcgaccatcctttggacaaatctcccaacggcggaacttgcacaagccccagtgaagaccttccaactatatacacacgggagaaaattggccccgcacgcttcttccccgagttgtcacattactcgaatctcccattgaactggcaccatttcgacaagcaacaacttgctctccatactatgagcaacacgcacacggcgactcaaaacacgcgctcgattcgaacaccccttttgtacacccccaaggtaagaaaatagctttcgccaacacagggcctttccgacgttcgcggattggcagctcgacttcgcggcaacaacacagaagggcttggacttatccggacagccaggcaaacggaggcattggattgggccaaacgttgcagcagctctatcatccaccaccagaacgggccaaccgacatccggaagattacacccacagctagcaactaagtctatanctaccaacaaaaacagcggcaacattacaagagcttctcaatccgaacccacttcattaacggccaggcttccccattaccgtgtgacaagtatgtctgtggcacaacacacgttggccattagcctgcccattaacaccttggccaaaacaaccacagccgggggactatctctcccaaaggaggctacacgcgacccccgggtctctcatcaatttatgcggcttaaccatccgcgcgcaggcggccctattgggctctggcaacgcttgcgaacacaacaacgttttctctgggacgacagttttattacacctacccgacgcgagattaactcgggacaccatttacgtagcacggaactcggcgaaacacccacaagcagagctatttcaccaatgcctagtctatcacgccggattaacagtcttcccccccatagcaggataaggagcaaagcttccccatctcggggcaaaagcgcacacgacgcgcata

SEQ ID NO: 620886 - DNA, 160 bp, Homo sapiens
cacgaggacgttgtctatgaattcacgggcgtggttgcccagcagcatcgtaccggtgtcctcgcccatcatttcctccagcagctccagggtttccacgtccaggtcgttggtcggttcgtccatcaccaccaggttggtcggctgcgcgaacagcttg

SEQ ID NO: 620887 - DNA, 115 bp, Homo sapiens
ttaaaagccatacccccgacggcagagtttgcagttgagcttgagactcgttccactttgcactgcagcctgggcaacagagcgaaacctctgttctggggactccttctagaat

SEQ ID NO: 620888 - DNA, 112 bp, Homo sapiens
tgttttctctcttcttcttgtgtgcttgcgggggctggtgcgtccagtggtctaatcgttgagaggccatgtgggccatgatggtccaccaccctgaatgcatcccaaaggt

SEQ ID NO: 620889 - DNA, 123 bp, Homo sapiens
tagccaggactacaggtgaatgccaccatgcctggttaatttttttttgtagagggttttttcctgtcacccaggctggaatacagtggcaaaatcacagctcactgtagcctcgacctccca

SEQ ID NO: 620890 - DNA, 566 bp, Homo sapiens
cacacaaaaaaacattgaatgcatgtccctgttttgtagtagcttccaggactaacacccataagggatgttacctaaagtacagaagggctgtccgggggagaacaacccctccagcgttcgtttcctatatattaggaacaattgtctgccggtaagatgtgctgagctagctaaaaaatcggatgctttacgagctatggggaattcatggaaaaaggaggtttgaagtagcattctaagacaataatcttaaaagttaaaagcttgcagatgataaaataatcctgcgaactcgccccattatgttaacgcaattggacttctcgaagattccaagtggaaaaaagacaaccaaacactgcaccagctggccttgattaatttggcatatgaaagaactggtgcaaaaaggtggagatacacattgcaaacatagccataggtgagcagacctttgaaaaatacaaaactgggcttggggtatctcggggaaaagcccaggcaatactaactcacaattggactgcgctattcaacttttcggcatacctgctcggaggacc

SEQ ID NO: 620891 - DNA, 80 bp, Homo sapiens
ccaatattttaaaataaaacaaaaagcataatttgggtatttaaagtttttaaataaaataagtataagtcaaaaaaaaa

SEQ ID NO: 620892 - DNA, 169 bp, Homo sapiens
aagaaaaggattcaaaaagaaaggagccactctaaccctgcggaaaaagatggccacatagttgctttataaccagaagagacagtaacagcccgggacagcctttcccaaaataaaggcccctgggcatgtacatgatcccatcatggcttgctggcaggccagcata

SEQ ID NO: 620893 - DNA, 731 bp, Homo sapiens
tattataaagaaggggggggagccatatatatataaaaatgagtgagtaaaagaagagaggggggggggggggggcggcagccaggaggggggaggaggaggagacgatcatttaaaaaaaaaaaaacacataagagtagacaaaaaaaaaaaagagagaagagaagacagagaccgagagagggtcatattatatcagagaagagagaggacgaccacagagggggcggcggagggggggagggaggggcaggacagcaggagaaggagaggtgagcccgcagggagggcgcacaaacgctttgggaggggagccccggagggggaggaggacacaccacgccagcaaagaagaagaagagagagatacgagaacaacaaccaagccacgagcagacacaacacaaccaacgagagagggaggggacggagccacacaccacgactaatggagtgcgagaacagagagagagagagaggaatgtgaaaaaacaccacaacacgaacacacagggggggaaaaaagaagaggaggaaaaaagagggaggagaaagagaaaagcacgaagggggaggagagggaaaaacaacggtcggagggccgggaggagacgaaggaaaggagaagacgacaccgacaccaacgggaggcgccccacgcgccgcgcaggagcgccgccggagaggagaaggaaggaggaaggagaggggagggaggaggcggagcaggg

SEQ ID NO: 620894 - DNA, 352 bp, Homo sapiens
gccccccccatgccccccttttttttttttaagggaccccttaaaagatccttggggctgcccccgccgtggggtgttatttttatggccccccccccccttacctccttgatgaccaccaccagggggctttgggaagccccccccgtaattgcccttttcttttttccccgtaggggggaaaagggggcccccccctgtttttcccaaaattaactggggagtttttggaatggtttctggggggggggggtaatcccttttaacctttttctggttttttttttttttccccccaagtttagccccaagggaaacctttcccttaagggtccttttccccccgggggga

SEQ ID NO: 620895 - DNA, 211 bp, Homo sapiens
cgaattgtctgggcggagccatgagtgtgatttcgtctccttccctccagctgccatctgccttgggtctatttccgctgtctttagctctggcgcgcctttggaccagcagtgtgaagttctgggtgcggctgaggaccgggactgtgggcagggaggcctcacatccgtaggtgccattggaatcgaaggtgatagaactgagcgacag

SEQ ID NO: 620896 - DNA, 212 bp, Homo sapiens
ttggtgcacgcaccgtctgtacccacaggcgagttaggatcaggcctccaggttggagccccaggagcagaggaagaggtggtaagagtcctcaccactgcaagagccaccaagccaggctgcaggcaccacccctggtccagaccctacggcctatcagcttctatcagcccgctctgcctgcctgctgggcctgttggccgccatcaaca

SEQ ID NO: 620897 - DNA, 150 bp, Homo sapiens
agagcacaggactcctcgtgcttgtagaggcggcgaggcatggcacgtgtcttcttaggccgcaggtccaggagctgtacttctggcccttgtagaattgcctgaggttttctttctgagtctggttaataactgtgagaggagcggtgg

SEQ ID NO: 620898 - DNA, 580 bp, Homo sapiens
aaaaaagggccaggttggttcctgtttattttctcccccaaaatgagcaccaaggagttcagttggtttcacaagcctttgtgtttctgggccctggttttttacaattaatttgttatgaaaacagagcttaatcccccccctttactcccacaaagtgtgtgtgggtgtggatgtgggtgggtgtgcgtgtgttaactaacccgtgaaaaactgactttttcctaaagtcatcaacccttagggtgacttttaaaggtccccggtttatacccgaggtagtaaaattaaatggtttattatacaggctcggaaatgaaaccagcccggattccaatttccactcttatgtcttaaaaattaaaaatggacttaggtaccggaatttcatggattttaagcttctttataaaaaaagtaaaacttctaattcaaaaagatgttgtagggctaaaccagatattatgtttttaaaacccttttcagtgtttgccaaacaaaaagtaaactgtcttgttcggtcttgttaaaacccaaaatttttaagcaaatgattttaataaaaaaagaggggtatttg

SEQ ID NO: 620899 - DNA, 115 bp, Homo sapiens
gaactgttctcatgttcccgagctcttgatccacccgcctcagcctcctaaagtgctgcacttgcaggcatgagccaccgggcacggccttgagcacatctttatctgaaatcta

SEQ ID NO: 620900 - DNA, 192 bp, Homo sapiens
cacgctagcctcggatacgttctgcaccattctgagtttcagtgtgcttatctataagatgatgatatgcctacctagcagggaagttgtgatggtaagaccacgatggcatatgagtgtctagcatatacctctggtgtatagtagtggttcaacaaattattactgtattactgttatcttcaattttgt

SEQ ID NO: 620901 - DNA, 198 bp, Homo sapiens
  misc_feature (5)..(5): n is a, c, g, or t
ctatngttctcgagcgttatgtcattaggtgattttgtaggtgtgcaataggctatgccatctaggtttgtgtaagttcactctatgatattcccattggtataacctattgctcctaggctacaaacctgtacagcatgttgctgtactgaatactgtaggtaattgttgtaacacaatggtaagcatttgcgtctc

SEQ ID NO: 620902 - DNA, 482 bp, Homo sapiens
  misc_feature (24)..(24): n is a, c, g, or t
  misc_feature (71)..(71): n is a, c, g, or t
  misc_feature (75)..(75): n is a, c, g, or t
  misc_feature (101)..(101): n is a, c, g, or t
  misc_feature (129)..(129): n is a, c, g, or t
  misc_feature (179)..(179): n is a, c, g, or t
  misc_feature (184)..(184): n is a, c, g, or t
  misc_feature (189)..(189): n is a, c, g, or t
  misc_feature (203)..(203): n is a, c, g, or t
  misc_feature (205)..(205): n is a, c, g, or t
  misc_feature (213)..(213): n is a, c, g, or t
  misc_feature (215)..(215): n is a, c, g, or t
  misc_feature (234)..(234): n is a, c, g, or t
  misc_feature (256)..(256): n is a, c, g, or t
  misc_feature (277)..(277): n is a, c, g, or t
  misc_feature (390)..(390): n is a, c, g, or t
  misc_feature (478)..(478): n is a, c, g, or t
ccccgcgggctgcccacgcctgtnccccagctccccgtatccgctgggctttacccatcgccaggggtggntttntgaaccgcccgctccgtgcccctctntgaaacctctcctgcaactcggggcccncgttccccctaccggcggaggggaggactgcccccggggggatggaggantgagncacgngggggccccggggncngcggtgcngnggtcatcgggaatgatgcngaaacagtgtttgctggggctncgcacgttacgtagcctttgncgccaagttatggagcttcttcatttaccttctgcggaggcagatccgcacggtaattcagtaccaaactgttcgatatgatatcctccccttatctcctgtgtcccggaatnggctagcccaggtgaagaggaagatcctggtgctggatctggatgagacacttattcactcccaccatgatggggtcctgaggcccanagtc

SEQ ID NO: 620903 - DNA, 335 bp, Homo sapiens
tgagatgcaggcttgctctgtttcccaggctggagtgcagtggcatgatctcggctcactgcaacctccaccccccaggttcacgcaattctcatgccttagtgcctcaagtagctgggactacaggagtgcaccgccacactcggccaattttcgtattttcggtagagacagggttttaccatgttggccaggctggtctcaaactccagacctccaggtgatccgcctgccttggcctcccaaagcgctgggattacacgcatgagccaccgcactcagccagtatttgctatcttaattgtgataatgcttccaagggcaatgtacatatg

SEQ ID NO: 620904 - DNA, 196 bp, Homo sapiens
cccccccccccccccgaggttttagggaaaataagtgggcccccccccccttgggctggggggccctaggggggggttttttttggggggggggacccgggggtgggcccggggatttttttttttttttttttttttgggccccgtggttttgggggggccccttttttatgggaaaaaaaaactttttcgggga

SEQ ID NO: 620905 - DNA, 126 bp, Homo sapiens
gtgcgaattcctacctcctcctgaacggtaatatggtgaatgaagggtaaaattcttggggaggtctggaccaataagatggacatttaagggattgactggggttaactttgcgggaggcccaac

SEQ ID NO: 620906 - DNA, 295 bp, Homo sapiens
tatactggagacagcatttccacagtgaatatgctgtaaacatagttgaaatgacaacaaaggatttagaatattctataaacttagttcataaaggagcatcaggatttgagatgacagactctaaattttgaaagaagttctactgtgggtaaaatgctattaaatagtattacatgttacagagatctcatttgtgaaaggaagtcaattgatttggaaaacttcatcgctatcttattttaaggaactgccacagacaccccaaccttcttaacctctcttagtcacttgg

SEQ ID NO: 620907 - DNA, 373 bp, Homo sapiens
aacgatggtctcatgctcaacgatgtctcagctcaacgatggtcctcagctcaacgatggtcctcagctacttgggaggctgaggcaggagaatcgcttgaacttgggaggtggaggttgcagtgagccaagattgcgccactgcactccagcccaggagacagagggagactctgtctcaaaaaaaaaaaaaaaaaaaaattaactgacaagttattccccgtgaaaggggctccacttttagtgcagaggtgggccggggtgtgggcttcacactcgagtggggatgcccccactgggccttgtgacagggggagacagaagagaggcaccgggaagtgtctcagaggtgtgaccggaagacaagaacaca

SEQ ID NO: 620908 - DNA, 227 bp, Homo sapiens
gcgacactcttggctgatcttatctttgtaattgataagacagagccacaagtaaaaacatgggagtgcaggtaccccgttgtgacatactgttttcttattcctttggataaatatccagtagtgggaacgctgggctatatgttaattctattttgaattctttgagaaatctccatactaatttgcacagtggctatgctaatttagattccaagcaagagtgt

SEQ ID NO: 620909 - DNA, 846 bp, Homo sapiens
cagctgccgggcgatttagcgtgatgtgctggccagcgggcgatggagacagatgagacaccgctggacgagagtgatggcgggttgggggagtgcggggagagtgcgtggggcggaggctggtgcagggtggcgctggaagctggagcggtccgtgtcgctcccctgcgccctgagggtcacggatgtgctctgaagctggctgcttgcaccgctggggcccaggcggcgtgctcctccctgctccgaggcaactctgggctcgtgcgccgtctgggctgcgacggtgcggtgtggacgcactgcgaatgctgccgagagtggcggtgcgactggccgaatgcttcctggcgttgtgccttaaccgaggtacagcgggaaggccggacgggacaagtacgcctattccgggcctcaggccttgatttcgtcatctcgactcctccggacgctcgcgtgttcggctctttcagtcattcgggctttcttgcgtgtgctgaggtttccccgcggcgatgcgaggtggatccttgtcaaggccctagggggtataggccaattctgcagctgagctggcttgtcgggcttgccgagcagtacttcggtgtgagggttgcttcgagtttgtacccttttcactcttggttggcggccggaaactttggcaagtggggacagcgttcaacaaggtaaccgcctttgaacgttccaggggttctaacggttgaacaaaactcttgaggtccaaaagctaataaggggcggctacttacacaagcggaaaggaggcaccaggctacactgaactcaaaaacccgaaggtgatactaattattcccgtcccta

SEQ ID NO: 620910 - DNA, 144 bp, Homo sapiens
cagaagacagaattgcaatagttctatctctaatttaagtgagagcagggtctgggcacagcggctcacacctgtaatcccagtactttggaggtggagacagggttttgccatgttgcccaggctggtcttgaactctgtcga

SEQ ID NO: 620911 - DNA, 512 bp, Homo sapiens
  misc_feature (45)..(45): n is a, c, g, or t
  misc_feature (57)..(57): n is a, c, g, or t
gaagacatctatcttcccgctgctgtgtccctggtacgtacgaanagggcctggcanacaggagaaactccatgcttggtaagtggatgagtgaatcagcagggtctatatggatggaaagaagagaattttgagagttattctgacattcaatttgtaaacaagggcaattggtaaacaattgcaaatgatttgtaaacaattgcaaacaatttgtaaataagcccagagaggggaagtgaattgctggaggtcacagccgatccatggcagagccaggactctgcaacttttcactcttagttcccatgtgcactgatactgtgtttactctggtgctgtgtccgcatagacttcagggggcaagagcaggagtgggaggagaagttgggccagtgatgagaaacaccattagtgattcatctcttctctgagtgcccaccctgaggggttaagcagccggagcaatgcatcttcttttgaatgttccgagctccccatctcaaaggacc

SEQ ID NO: 620912 - DNA, 888 bp, Homo sapiens
gggcgagaccaagcgccttacgacaggcggccaaacagggacgccacgacagaaagtggttgatccatttgctaagaaagattggtatgatgtgaacagcacctgctatgttccaatattagacatcttggcaccgacgctacgctccacgcagcgacccaaggcatccaaagattcgcatctgatggtctcaagggtcgatgctcgtctgaagtgagtcttgctgatttgcagaatgatgaagttgcatttacgacaattcaagtctgattactgaaggatgttcagggtgaaaaactgcctgactaacttccatggccatggatcttacccgtgcaccacgatgtgttccttggtcaaatactctggcagacacatgtactctgacagctcctgtcgcatgtcagagactacctgatgcgttacgttgcttcgatctgttgctgatgattaggttttacttatacaaagcgcacacaatccacgatacggcacatggacctcttatgctccagacaacctagacaggtccgcccaaatcgcggatgcaagatgatggaaggtccatgacccgaagaggtcgcagacgcaattgacttgcaagagcaagttgcgctcaatggcgattgcattccgagacatgccatgtggcacaaagacgagtagaaaagtgcttgccaatcctagtttgtcctcgtccatgagtgctcttcgtccagaaagcgtaaaaagtgctgaaggaagcccaacgtttgacattgcgaaagcgtcatggcagtcttcatggtgactggcagtgagttcctggtaaaaggcactgtggggacgagacaaggtgcgtaaagttggaacgagcttgaatcggcttttgaaaccaacctagtccca

SEQ ID NO: 620913 - DNA, 950 bp, Homo sapiens
  misc_feature (679)..(679): n is a, c, g, or t
ccacgcgtcgcaaaaacaaaaaaagcagggttgcagtactattctgataaaacagactttaagccaatgaagatcaaaaaagacaaagaagggcattacataatagtaaaaggatcaatgcaacaagaggagctaactatcctaaatatatatgcacccaatacaagagcacccagattcataaagcaagttcttagagacctacaaagagatttagacttccacacaataatagtgtgagactttaacaccccacagtcaatattagattaacaagacagaaaattagcatcctttatttatttatttttttaatttattattatttttttgagacagagtctcactctgtcaacctggctggagtgcagtggtgcaatctcggctcactgcaagctctgccttctgggttcatgccattctcctgcctcagcctcctgagaagctgggactacaggtgcatgccaccatgcccagctaatttatttgtatttttagtagagaaggggtttcaccgtgttagccaggatggtgttgatctcctgacctcatgatctgcccaccttggcctcccaaagtgctaggattacaggtgtgatccaccacaccagcagcatcctttaaaattaaagatattcaggaacttgaattcttctcaatcttgtgcagtgcacatggnacttattctaaatcaacaccttatttgggagttagacactcctccggcaatgcaaagaacgaattctaaacgctccgtcaaacccagtggctcccattgatccggttaggaatcctcgaaccacaatatggatggaaggttaccgaagaccgggaaacgaaaaaagaaaagtgtgggccggaaaagaagttccatttgggaacatgtggaggagatacagaccaaagagaagaagccaaaaaaggataggaaaataaaagaaacaaaggga

SEQ ID NO: 620914 - DNA, 84 bp, Homo sapiens
tgattatagttggagatacttgaggaacagcagatgcaggaaggggtctctgacctcccctttgctacctaaaaatgggccatt

SEQ ID NO: 620915 - DNA, 852 bp, Homo sapiens
  misc_feature (233)..(233): n is a, c, g, or t
ggcgacggggagtgccggggtccggcgggatacgacgggagagccgcgaatccgtcccgataagtgcgtcaagttcctgttatgggggcctggccgggatggcgtagctagagtacgtgtccgagtgccctggcaccgtgggtgaagaagcgtgtatgcagtatgagtcgtgtgatcggggccgatgagtcgagagtgacagaaccaactaccatggcgcctcagcagctaangctgaaaggcagataggcctataaggggcatttacagtgggactggtcgtgacttgggctctggctgcagctacagatgttcgaaactatcactcagatagtccgtcctatggcctaagtctatcaccgagtactgtgtttgagcagtccgtgcagtgtgcgcgcctgaatggtacatcgccgcctggactttcgtgccactgaagagcttgtgattgggcgattgagcccagcaagtggtgcccgacatgcggtgccgttatgctcgggaagccagcgcaagccagaatgtgggtcttcatccggcatgattgccgcatgtgcctgggatttccaagctgaacctaggcgcctgtggcttacagaacaaatgtcgtttaacgccctgattcgaatcgaccgcgttgtgaagagggtgtccgtcacactgtggcggggctgccatccctaccatggactcgggccgtcgtacgtcactgctgccaggctcgcctcctactcccaatccaagcagttcttactggactcaggctacttctctgacaaaaatcttgtgcacttctgtgccagctgatcagcggctcttgtcaccactgctgcttcatgcctgttgacattc

SEQ ID NO: 620916 - DNA, 899 bp, Homo sapiens
tggcgcacccggtttgttggtagccaggtctgtgttgtgtcgtgttgtgtgtgttcgccaccgacatcgttgtgtgtagtgggcatgtgtgtgcccgggcccgtgcgttccattattagtttggtgtgtgtctctgccgcggttttgttttcggctcgctcgccccccgcgttgtttgtcggtggctggtagtagtggctcctgggtctccgttcctcgttgttcctcattagtgcctcagtagtgcgtggtctcactgcgctctgatccttggttctgcacagtcaccggttggtgcgtcgatccccgcttgggccgctggtgttgacgcgtcagagtccatcctggcttatgatggctacgcgcccgcctggtcgatctgccgcactcgggtgctgtctcccaccctgctcttcggttcgtggttggcgctcgcgcagcgatgattgtctctcttgcactggatgccgacggcggggtgttcgcgcgtgccttatggtctagagtcttcgcccgcttcgaatgctcatcctcgctggggcggcaccttccggcgagtgctccttcgttctcttgtgtgaaagagtggagtgttgttgacgttgctaacgacctgctgtgtttctcctcgctgggtgtggtgtctgtttctttttgtctctgctgttccacctcagagagtagagataacagaaagcgtgtctgtagtaatcatttcaacgactgcactgcttctttctttttattaaaggctggaggccactgacaacatcagagagatgctgtgtccttccatcagagtacatggcatgttctacctccctggccgatttaaaacagaggacaccccggacgaacagcgagaatacggaggagcacataataaacccactcgacaa

SEQ ID NO: 620917 - DNA, 898 bp, Homo sapiens
gagcggagaagggaggtggtcgccctccgtacgtggtctggcgtgtatgccgagccttgtgtgtctgtgcggtgtccgagcgttggtgtctggcgtgtttcctgagctgttggtgtctggcaggtttccgaccgtctggtgtctggcggtcttccgaccgttgcgtgtctggtcgacgctgctcagcctctcttgctttggttgcgccatgcctatgtaccagacaacgaagacagagaacaatgactcgtgaggacacgccttcagatctgcaggctgtgaacgaacgaaagcagctacaaacgaccactgaacaacaacgccggtggcacacaacgatatccacagacgcaacagggtcccacagccgcgtcacatacgctacataagccggaaagcagtgcagagccaccagccaactgcatacttattcaagtgctgcgaacggctgcgcgaacaagtgacactgcagcaccgcagaagtccgcgctgacgtgcgttgacccggctctgcacaacgggctgctccggctagcccgggacctgacccgccgcgcctggcagcctcttcccctggcccgcttcaccggcactggactgcgtttcccacttggaactccggtgcgaccaccgaagcagtaccacgtcgttgggccacgctggcacggccctgctccagcaatttcacctttgcactcacctattattcccttaccatggtggaacgttacacttagtgcgacaggaaagcgcgcgacgaggcccaggcatggttcctacaaggaacacctttgtgcgcccctttcccacgagggttacattacttcaccctacggatcacttagtcacaacagccttggaccctctttctcccattctggttggccaacggttagac

SEQ ID NO: 620918 - DNA, 522 bp, Homo sapiens
  misc_feature (212)..(212): n is a, c, g, or t
tacttattccctcaacaatcattatggttggtgtgcaaggcacctggtgttaggtcccaaaaccaaaaggaaaaaaatacaaatatgaattgggcataatctcttgcccctccgggaaacttacacactctctaaagaaagaaagtcgtgggaattataaatgtgtcgccctcttcatccacaaaatatagcaccttatttatattcagccnagggaaataacgcacacgtgcgtgcgtacaggtcgcccacgtggggacgaatacatccctaatagagaacgcttgttcttaagcatctaaatttcaaagaccaggctcaggtttggcccctactgtagctctgtggcacggcttcaaaaggcagctgaggggacctgcataggcttggaatagaactgagctgccatctggagattccgctcccctcttctttctcacgccgaggtaacggtgatatacgcaacggccagttgctaccactgaaacggattagacgcgaaaacgcgcgcgggaaactgac

SEQ ID NO: 620919 - DNA, 700 bp, Homo sapiens
tgggattgaacccaagtctgatatcagaaactaaacttttaactgtgatggtgttctctggatcattctgtaatactaaattatttttggtgctttattttagaaggcattaaattatgtactgttttgtaaacattaattctttactagtggttgacttcttatccagtcagcatatctttgcttactttctgtcacattctatactaggcagtggttgcataaagatggaaatatagtaatctcaaggagcttagcatatttgatgaattggaaaaaatcatagtgttttcacttaaaaattctggattcaatttctgatttgttgggctttaaaaaaaaaaaaacaactctgtgaccttaagtagcattgcttttctgtgtttcagtttccctatatgtagaatagaagtaaatacttaacaggtttgtctagaggatcaaatgaaatattgtatgtgaagaataaagtttaggtgggaggatcacttgagcccaggagttcaggactggcctgggcaacatagtgtgaccccgtcccaaaacagacataaaattatgcaggtatggcatgcacctgtagtgccagctacatgggaggctgaggcaagaagattgcttgtctgggaggtcaaggctgaagtgagccatgatcatgccactgcactccagcctgagtgacggagtgagactctatcag

SEQ ID NO: 620920 - DNA, 300 bp, Homo sapiens
cggttaactggacttctatcacatgctatttatattgacttactgtatcattagtagttttttttgttttttgagatggagtttcgctcttgtcgcccaggctggagtgcagtggtgcgatctcggctcactgcagcctttgcctcccgggttcaagtgattctcctgcctcagcttccctagtggctgggatttcagatgtgcgccaccatgcccacaattttgtatttttagtagagacagggtttcgccatgttgtccaggctggtctcgaactcctgacctcaggtgatccacccg

SEQ ID NO: 620921 - DNA, 433 bp, Homo sapiens
cctggaagacgattccagagacgggcaggaggacatggaagcaagtctggagaacctgcagaatatgggcatgaaggacatgagtgtgctagacgaaactgaagtggcgaatagcagtgctccagattttggggaggatggcacggacggccttctcgattccttttgtgatagtaaagaatacgtggctgcacagctgagacagcttccgggttagcccccaaagcatgctgtggatggggaaaggtttaagaacactttggcaacttgatcgctgaactttaaagttactccggacattggagaattcctttttgagccagggactcgatagcggaacacggcagctttggtttgaaagttttcacactattattctaaagctgtctatactgtaagctgtgatatgagcttgtgatctggtctaatggtg

SEQ ID NO: 620922 - DNA, 256 bp, Homo sapiens
gccctgtatatgggcacagaaattattctgtatgacaccattatagtgaatacatgtcattatacatttgtccaaacccacagcatgtacaacaccaagagagaaccctagtgtaaactatggactttaggtgatgatgtgtcaatgtcggctcatcaactgtaacaaacataccactctggtgggggatgctgatgatgagggaggctgtgcctgtgtgggggaaatacatgggaaatttctgtgcccatttcaa

SEQ ID NO: 620923 - DNA, 476 bp, Homo sapiens
ctgatctgttcactagagaggaatttatgcagggtgcttgaagactggtgctgtacaagccatgtgttgtgtctgatcagaacatgaacatgcatctcatacatgacctacggataggtgtccgaagttgtgacactgaaacaggggataccgttgaatccatgcgagaatcgggttatactgcgctacagtctaacatatcatctcaagccgcgtgtttggatggtgtcgttagataccccatatgcgaatcacgcatcatagttaccctgagagcatggtcaacaggcactgtctccacaatgatactgttagggtgtgatagcttgctgagatagctcctgacacatgttggcaaacctaatctatgtgaagaccaattaagataacaggatcaacattgaaccttctatacatactgctagatatcactactcactaggttgttacagaccgcgcctccaggtccggcctgt

SEQ ID NO: 620924 - DNA, 1080 bp, Homo sapiens
ccgtgttcatatgtatttgaaattttggggtcttcagcgtggacaaatatggtgttactccctgtcatcaagcgaaatttcgtattatcaggcgtcaaacctggtggtcctaacaaggagaaccaatagttgtcccgttcctttgtcattaccgtctcccaagtcggatctgaacctttggtaataggagtcagtcccactccagtatataggaaattctctggaaaagggaaagaaagagaggtatcacggaggaattccgatgcacctttcttacagacatgtggaatcttagcccaagtaggtaattaccagaagggccagccccgacctaccaagggcagcctgcgagaggaaatatgtatgagatgtgtaggagcatcgagagtctaagagcaaagtctttgataggacagacatccgtatctcatctatgaagatcaagcagcatgaaccgggcagtctagatatgattcttgatgaacagagaagatatgtctacttcgttaaacagaggaaatctctcaaagaggagcaaggaactgcctgggctatgcactgggcagataagctcagacaagaactggatactgttgtgacaactcagcatgtagattactgagacaagtataagtgaaaggatactgattccagtgagtgaaaccgtcagactggtcagtggaatgcagcaccctggctctgctggaggcgtctatgagacaaacacagcacttcattgacatcaaagagcacctgcaacatagtaaagagggacatagataacttagtgcagcgaaagtatgcgcatcaaatgaaaagccgaaagtgcccgagaactaccaccatttccatcatgttgtgtctacggtccgagcgttcattatatatgttgtggtgcaaactggattattcattggttatataatgtataggtctgagcaagaagcagctgtgcgatataaattcttttgagtaccattttcatgtgtacttaatcatatgtagtgtactaaaatgatgtcgttttgagggaatataagtatttaaagtgcttatagttatatcatcgatggtctaata

SEQ ID NO: 620925 - DNA, 216 bp, Homo sapiens
  misc_feature (6)..(6): n is a, c, g, or t
  misc_feature (42)..(42): n is a, c, g, or t
aaaagnctccgcacccccgtccctgtttccttcggcacctcncccgccgccggttccatcatcacctccccctcctccgttaccatcatcacctctccctcctccctgtttccatcatcccctctccctcctccctgtttccatcatcacctctccctcctccctgcttccttcatcacctctccttcgatcatttccatcatcacctctccctcc

SEQ ID NO: 620926 - DNA, 465 bp, Homo sapiens
  misc_feature (33)..(33): n is a, c, g, or t
  misc_feature (186)..(186): n is a, c, g, or t
  misc_feature (188)..(188): n is a, c, g, or t
aattaaacttggttaaataaacccctgatttanttaacactatcgaataggatgaaaaacccttgcccttgaaaaattggccaactgttgtttttacccattgaactgtacaaagcctcttcccagtcctattatacgcatttttttttttctaaagaaaacaagaaatgattggccgggcgtggntntcacgcctgtggtcacagcactttgggaggccgaggtggcggatcgcctgaggtcgggagtttgagaccggcctgaccaacgggaagaaaccccgtctctgctaaaaatacaaaaaaattcagccggacgtggtggtgcatgcctgtggtctcagctgcttgggagactgaggcgggcgaattgcttggacctgggaggcggaggttgtggtgagccgagatcgcaccactgcactccagcctgggcaacaagagtgaaactctgcttaaaaaaaaa

SEQ ID NO: 620927 - DNA, 200 bp, Homo sapiens
ggtgattagcggatcctaatatgctgttactctaatgccaggctgtagtgagtggtatgatcttggctcaccgcaactctgcccccctggtcaagagattctctgcctcagcctcccaagtagctaggattacaggcgtgcaccacacatgcctaagctaattttattgtttgttatgattgttcagtttgtttgttttt

SEQ ID NO: 620928 - DNA, 731 bp, Homo sapiens
  misc_feature (11)..(11): n is a, c, g, or t
  misc_feature (21)..(21): n is a, c, g, or t
  misc_feature (70)..(70): n is a, c, g, or t
  misc_feature (88)..(88): n is a, c, g, or t
  misc_feature (99)..(99): n is a, c, g, or t
  misc_feature (160)..(160): n is a, c, g, or t
  misc_feature (173)..(173): n is a, c, g, or t
cttcctggtgntcgcttattnggtttcccctcaaattggttaaatgtttcaagagtattttagaagtganccaggggaaaacctgganaaatatgattnctaagcctcttacttcataggggtacacagcagcctgtgggtttagctctatgcatgtgancacaaaaagaagncagctgctagataccataaaatagttaagttctccatctggtttgcaatatgggtgaagatttgctgcaaatctgggttgactgccatgccccagttagtttacaaatacactggtccttttagttatagaacatgaagagtggtcctaagtgcccaagtattaaactcttatacaagcattcagcaaaaatggggtaaagatgaaagcaataccactttatttaaaatgtgctctacttaatttctaaaagtctggcaaagaatagaaaaatcttaggtctagtttaagttggggatgccagtgaaatgaaaaggaacacatatatttgtgttacaattgaagctggcataatacataagatttagccctttgaatataatgttttttcattgagaacattatttttcttaacaaaacaaccaatatttttgtaatttataattaatatatgccaatccctgtaattctggtatcagaagatctggtaaaatctaatatgttccgtgtgttgtaagatttttactttctgaatataaataaagtcatagtatcttta

SEQ ID NO: 620929 - DNA, 249 bp, Homo sapiens
aatttcggccaagcgggaaataaatgcaaatatcttcttgtcagtcactactgcagtgcatgcatctgtgttcaatgcccttcggctcgtgagcaccttgctgacctccaactatcgttaagctttaagaataaagaggatttactatcctgcagtacccaaagacacctaagctagcaattgacatcaaagctgaaaatttgcgacgcatgccttcctggacaagttccggccacacgtgagcaccgt

SEQ ID NO: 620930 - DNA, 677 bp, Homo sapiens
actgatcgagggtgtgctagagtgcgagacagagtgacagtgagagagtgtgagtgaccgacaccgagactgtgcgcgctagagagatcatgatcaaccatgtactttagacgagacaaatggtcatagacgtgcttcaccatgctaaggcatcagggcccttgacagctgttaacatacaacttgccggaatgatccagaccacaccggatgtcatcgatagcattggatgtacagcttatatatgatagggcatgactgctggctgtggcatgacatatgactccctggattatgcaaagctatgtgaacccaaacacttgacttgtgagacatggcctgtatgacaagaacaagacctcaagagagagcgaacgtatcgcaagaacagaatgacgaacgtgcttaggactgcctaagccaatgaacttgctgcaaaaagtgagttcgagatcgctcacagactgatgagtaaactgctagctagatgtaggacagggccactgaggattattcgtacgaactttgattacctatatacttgtatacacacagacacacacttccggaggagcagcgtacactatacccctcatgtgagtacatgtactatcactgagaggggcttacaatgacagactgagctagaactgagggcatatcattgcctctcaaca

SEQ ID NO: 620931 - DNA, 181 bp, Homo sapiens
gcgatctggcagagatatagattggacaaggcaccttattgcatcagacagttgggcaggaagaatacaaggtgaaatttgacaaccaaggaaagagtctactgtcggggaaccatattgcctatgactacaccctcctgctgacaagctgtatgtggcgcagtcgcggtggtcgcccaaa

SEQ ID NO: 620932 - DNA, 152 bp, Homo sapiens
ccattatttccttctttatagagtccaccgatgatgtggtaaacatagtatggaaagaagcgcctgaatacaggatagtagacagcatagcagcaatgcccccgtagtcatggccttattatgggaatgcttatacatctttagtcttgctt

SEQ ID NO: 620933 - DNA, 572 bp, Homo sapiens
cacgcggggaatcccagcactttgggaggccgaggcgggcggatcatgtgagatcaagagttcaagaccagcctgaccaatatggtgaaaccctgtcttcactaaaaatacaaaaattagctgggtgtgctggcgtgcaccagtagtcacagctacttggtaggctgagacagaagaattgcttgtacccgggaggaagagcctgcagtgagccaagatcgcaccactgcactctagcctccatgacagagtgagaccctatctcaaaaaaaaaggccgggcggggtggctcacgcctgtaatcccagcaatgtgggaggccaaggcgggtggatcacaaggtcaggagattgaggccatcctggctaagacagtgaaaccccgtctctactaaaaataaaaaaaatcagcccagcgtggtggcaggcgcctgtaatcccagcactttgggaggccaagacgggtgggtcatttgaggtcaggagatcgagaccagcctggccaacatgggtgcctcgtctctactatacatgaggcaggagaatcacttgcccaggaggcagggtttccgg

SEQ ID NO: 620934 - DNA, 1828 bp, Homo sapiens
agcggggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagc

SEQ ID NO: 620935 - DNA, 2024 bp, Homo sapiens
agcggggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaagtttgtatattgtttccttcgattctttgatgtatccatggtggatgatgctaggttttcatacttatagataatacacacacacacacacacacaaacttgttcagggatgggcatacttcttctgcaagggccagatcataaagtttttaggctttgtagaccatgtaatgtcacacccactcacctgca

SEQ ID NO: 620936 - DNA, 1152 bp, Homo sapiens
tcctggtgacgagtacacgcgattactctccttgaatccactcgaccagcccgccgaaccatctgccgccagcacacctgcacacccgcccctctcctgtgaccaggaacttgctactaccagcaccatgacctaccaatatccagcactgaccccggagacagaagaaggagctgtctgacatcgctcaccgcatcagatggcaccatggccaagggcatccgtggcatgcagcatgagatccacatggcgcagccattgccaaagcaggctgcagatcacatatggacaccagagcaacaccgcaggacgaaccggacgactatctaccagacagacatgcatgcatgcacaagcctgcaagaaacagaccgatgacaccaccatgcaattaggaggcgcatgatacaatcctctatccactgacgaacacactcacataccacacagcacacgaggcagcgcacatgaatcggaacgcatccacctatcccacccacacgtacaacaaaaaaatccacaaggcgccgacgagctcgatcgcggaccctcacacaggaatacacccaaagagcgacagatagagtccacacacaccaagacacaacacgacacaccaacactgaacgcacaagcacaataaacaaacaccaaacacagagcccacaacaaacgcgaacatgatacaacaaaccgcactgaaagaccaccccacggcaccaccacacgaaacgcgcaaccaacgcacacccgaacaacaatactacgacccccacagaattggcccacgcaccagcatccgctacccactgacaacagaacataagcgggcaacacaccaccaacacacacacaacgtatcaaaacgcaccaacaccgccaaatcccactgacacacacaacacaagcacgcaacacaaacgctaccacaatcacgcaccacacaggacaaaacaatgaaaccacagataacacttccaagacacaaaaacacgacaaaagatgagcacaccatagccacgccccacaaaataaacagagatacaaacccaggtcaaccacaactacccatccacccacgaacaacgagtacacaaacccaacagcaaccctatatcgcaaagacgcgcacaagatagcccaacaaaaatg

SEQ ID NO: 620937 - DNA, 1408 bp, Homo sapiens
agcggggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagta

SEQ ID NO: 620938 - DNA, 1833 bp, Homo sapiens
tgatcaagcattggtaaattttgttccaaatgtttaattttttaaaatagacaactacctttataaatcatacacctaacttaaatgtttttttccaattaaaggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttattcttcaagttatcatctctgtagttttttatatgtctaaatactgtttgtcttatggtatcctttgagactgtgttcctattctggttagtctagtcgagagctcagcattgtaagacacagtattcatggtaaatttaacatttgggaccattcaagttgaatgtggctataaccttagtattgatgtactggttatatgttttaggaaactatgacaaaaataagcttgtttttcaaataaaccaactatgaatagtgacactagatctgggtattacaaaatgtctttggtctcttattactaaaatgaaacaagggaagcaattactgttctctaatgtagaggcagaaggcaaatcttgatgtacttgagttctctcagttgacatcctctaaaattacgtttcatttctgtgtttgtgtgattgctcagattttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaagtttgtatattgtttccttcgattctttgatgtatccatggtggatgatgctaggttttcatacttatagataatacacacacacacacacacacaaacttgttcagggatgggcatacttcttctgcaagggccagatcataaagtttttaggctttgtagaccatgtaatgtcacacccactcacctgca

SEQ ID NO: 620939 - DNA, 1573 bp, Homo sapiens
tgtggtcttgcttttttgttttgctttcgtgtcgcttctgttcacttgaatttgtttgttttgttggctgggcgtttcgtattgtggttttcctattttgttacctttatatttatgtttgttgcgtgttgtctatttagtagtttttccttgtcgcttttttacattggacggctcagtgcctagtgttatatgtgtatggcttctataggtgcatcttgcgtttcttcgtactctctgtatgattcgtcgttgtgtttgtgcgcgctcgttgtggtggattttctagtctgagtggcttgccctcttgttttgtgttgtgtttgttgtgctttgcagtcctctgttattcagagtaggatgtgtggtcttttacaagtttgagaagaggtgtcttgtacagcccattatcttgtttttattgcattatatgcacgattaacccatgttgttataaaacatgttgtactttgggcacgtggccatcgttgggctcgcacccatgttatatcccatgcacctttgtgtagtgctcgagtgtcgcggtatggatcagtatagggtcaggagtttcaagaccaaccgtgatcgttgtgtcaattagtgtgtgtataaccccatcttctgatgcttgttgaggtacgtgtagagttagttgtggcggtggtggcaccgtgccctgtgttcccagctaacagttgtggaagctttgaggtcatgagtagttgcgtgaacccgggaggtcatatagattgtcagtgatacctgagattgcttccaccgcattccagtcctgggttgacagagcaagactccagttcaagaacaaacaaaccacgttacttactgtatggtgacatctttattaatcatgaacccctatcagtactccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaagtttgtatattgtttccttcgattctttgatgtatccatggtggatgatgctaggttttcatacttatagataatacacacacacacacacacacaaacttgttcagggatgggcatacttcttctgcaagggccagatcataaagtttttaggctttgtagaccatgtaatgtcacacccactcacctgca

SEQ ID NO: 620940 - DNA, 1028 bp, Homo sapiens
  misc_feature (744)..(744): n is a, c, g, or t
  misc_feature (769)..(769): n is a, c, g, or t
  misc_feature (864)..(864): n is a, c, g, or t
  misc_feature (898)..(898): n is a, c, g, or t
  misc_feature (924)..(924): n is a, c, g, or t
  misc_feature (1009)..(1009): n is a, c, g, or t
agcggggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaaggtaaagtagagaaaatgcatgttattgctgataaaaagattgttatatatctggaatacttgttggattaagacaccaaaaaatgtttcaagtgtgcttagattctccatttcttgtaataggaatcacttttgtaaataatggttctttaatatggaaaagttttcattcagtaatgattaattcagcattatttcattgtgatccagtttttatatgcttcagttaagccagtgagtttttaaatgcgaccagcatctggcaaaattgtttccaggaaaaatgtttccattngtggaaggatggtaacttgtgcatncttatccttgaatttgaagagcaacaaaaccatcactaatatccaggatgtcaggggatttgcacactagcagatattagtaaatgtccaagctnctaaaggacttcagtggtgcctgtcccttcttgncttcgttgtcccaagatgtaattggngtatattgcatcattcaagttattagaatggacatgtaagtacaaaagtaaagtgatatttttggaaataaggaatatgagcaanggtattaggattaatttga

SEQ ID NO: 620941 - DNA, 133 bp, Homo sapiens
ctgcagtatatggccccagaaatcattgaccagtgcccacgcgggtatgggaaagcagctgacatctggtcactggagctgcactgtcatatgcgatggccacatggtctgcccccacctatccacgcagcta

SEQ ID NO: 620942 - DNA, 684 bp, Homo sapiens
  misc_feature (626)..(626): n is a, c, g, or t
  misc_feature (632)..(632): n is a, c, g, or t
  misc_feature (683)..(683): n is a, c, g, or t
cagtcctgattcttggaataatccagtgatgatgaccctcaccaaaagcagatcctttacttcatcctatgctatttctgcagctaaccatgtaaaggctaaaaagcaaagtcgaccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtagaacagatgacactgctcaagttacctctgactatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcagggataacctgnactcanttatggagcagctaaatacttgaaatttccaattttgatttagtggaaaana

SEQ ID NO: 620943 - DNA, 218 bp, Homo sapiens
tggaattcactagtgattagagactgcgagaaggagcgaagggcagggccccataccgtggtagggctgcagcgtagtaactgagtacgacctggagtggaagtgagccacgactgggagaacactaggcagtgtatggctagaggcatctagagtgcagcccattcctgggtcggtaaagtggatcaatgtcccacgcaagattagcattaccatgt

SEQ ID NO: 620944 - DNA, 315 bp, Homo sapiens
  misc_feature (122)..(122): n is a, c, g, or t
ccctcgtgctgcctcctgtgtgctgtccctcctctgtgctgtccggacagcaggaagtatgtaaatggctccacttaccagcgctggcagttcacactacctatgatgtcgactctctaccncctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctct

SEQ ID NO: 620945 - DNA, 165 bp, Homo sapiens
  misc_feature (4)..(4): n is a, c, g, or t
cggngccctttccatgttgagagctacaggtttgttttacaggaacaggctgtcctatatgttcttttcttgattcccccctcactcttcaaaatgaagctcaagttttactccctctggaaaccttctctgacctctccaggtaaatctgatcctctctttttt

SEQ ID NO: 620946 - DNA, 679 bp, Homo sapiens
ggggtacggggtgatgggcaagagctccttgttgttgtccaccccgcaccaggcttgcgcgaagacacactctcgggtcgcacgcgacacacacacaacacatacgagaccaggcgcggccccactcttggggggggaagttatatattatagaggagaatttgctgggtggtgttcacacagaagagagaaagagcgcccccacctcctggggtggtggaaaataccgcccgcgctttttttgtcaccacgccgcggggtcggagaaaaaaccccaggagagaagaagattatcaaaaaatctatttttgtcgtcgcgcgaccggaggacgagacacccacccatcgtcgtgtggtctgcatctcaccactatggaacagcgtcgtttgtgtgcggagatataactcgtcgtgggcggcggcgccccaccccggcggtcgagtcgtctcaccccggcgtgcgggggaaagttggggtgggcgcctcactcccaccactctccccccgggcagccgccggcctcttctctcctgctgtgattatttttgtgttatcgcgtcgcaacaatttttctccagcgggtgtttttttttttccccacctttcccccttttttttttttggggggtaaatgttctccccccccccccccccccaaaaaattttttttgggcccca

SEQ ID NO: 620947 - DNA, 400 bp, Homo sapiens
  misc_feature (391)..(391): n is a, c, g, or t
agccggactcgtcctcctcctgctgctctcctcctgtgctcctcctcctgctgctgtcctcctcctgctgctagcctcctcctgctgctccaaaacctgcagtcaagtcctcatcctcccaaccagtaactccagtttccccagtctggtctcgtcctcctcctgctgctgtcctctcctgctgcttgggtctggcttccagaccgagtctcagcctcttgggatccgagtccactgctggaggcatgagctgtggaattcagcctcagggcccagactggtacttctgctccctctgtggccttgagcacgtcgccacctctttatgacctttcgcacttctttgagaaacttgaagatgagtagcgcgcggatgtgcccattttctggngtggagcag

SEQ ID NO: 620948 - DNA, 599 bp, Homo sapiens
cgatcctgcatggatgcagtgagattaagaaatttcaagagcttaccaattagcccttactcatccctgagcagatgtgtagtggtattatgatggacctttactggacactctgccgagtaactgaagtggcacttgctttagtccagttggctatccctttcacgctggcatttcatcaaccagagaaaggaaaaataagatatcataaagcaaaagaagccccttatgggtctttcgactctcacatctatttagacataattacagtcccacagggaataccagatcaatttaaagcctgaaatcaaatagctgcaggattcgagtcaatatttgggtgggtgacaataaaatgtaaatgggataaactacatctattacaaccaacagccatccattaactaacactagagatgctgttaaaggaatagctgagcaattaggggctactagccagatggcttgggaaaaataggatagccttagacatgatattagcagaccaaggcagaattggcatcataattcaaaatcaatgttgaacttcatccaaaaaaaacggccctaatggagtctaacaaaggcttgaaggtctg

SEQ ID NO: 620949 - DNA, 193 bp, Homo sapiens
  misc_feature (46)..(46): n is a, c, g, or t
attgtaaaatctctaagtttatagaaaatcagatatcaggttcttngggggcaaaaatgatccaaattctggtagtctggactacacatctgcatggtggcggttaggccccccgagaaggatggacactcctgtttgctacagtgtcccccacccacatcattcatttaggttatttggtcctatagatatg

SEQ ID NO: 620950 - DNA, 191 bp, Homo sapiens
tacagtcagctcgtgtaccaagcatttgcaggagccggtgaaatcctgagagaaggcagagatatggcaatacaggattggtgcttttgggttcatggagtgttcagcaaagaccaaagatggagtgagatgaggtttttgaaatggtctactatgagctgctctgcaagtctagaacgtggcgaagaaaa

SEQ ID NO: 620951 - DNA, 410 bp, Homo sapiens
  misc_feature (162)..(162): n is a, c, g, or t
  misc_feature (197)..(197): n is a, c, g, or t
  misc_feature (241)..(241): n is a, c, g, or t
  misc_feature (269)..(269): n is a, c, g, or t
  misc_feature (305)..(305): n is a, c, g, or t
  misc_feature (315)..(315): n is a, c, g, or t
  misc_feature (328)..(328): n is a, c, g, or t
  misc_feature (361)..(361): n is a, c, g, or t
  misc_feature (381)..(381): n is a, c, g, or t
  misc_feature (401)..(401): n is a, c, g, or t
attcggcacagagtttacagatggttttatattcatgatctcccttattttctccatttccccaaagaagaagctgggcataaagagtgattttctcagggtctcataatcagtaacggagcagaattcaactacaggacctccctgggaacctgttctctntccttgtcctgatgtgttactcttataggccaatntttgcctttgtgttgtgcctaaatggtgtaattaccccgttttnggaaggtggtattatcccgttttatctngcggaaactgagggttaagaggaatgttatgatttngtgactattngtgacagcttttngaatattaggtcacttttgaaacctataagctnctctctttctagaccacatnggttggagaaaggagaaagngaaaatgat

SEQ ID NO: 620952 - DNA, 448 bp, Homo sapiens
acagtcaggaagggcaagtcggtgacataaatgtgacaggtgataaccccagtaactttgctatgtcaagtggtgtacttcagattgcaaatgtcaatgccccagtatgacattattgcagaatagggaaacttagtcaaatatcaaaggccgggcccatttttctgaatcaatatgcaccagttgaaacacggcctaacatttgacatgtgacccaatcagaacatatttcactgtgatttcaacagtaaccagaacatccctatttatttttcaagcggtattctattaacttatgctcctttactctcaggagattaaaccctaaactctgtcacagaagattctgtaactcctataatataacagatctcacagaacgcaaggggcaaagccctcccaaagatgttggttagccaatacctctgaatgacgttctacacttcca

SEQ ID NO: 620953 - DNA, 1696 bp, Homo sapiens
  misc_feature (839)..(839): n is a, c, g, or t
  misc_feature (911)..(911): n is a, c, g, or t
  misc_feature (970)..(970): n is a, c, g, or t
  misc_feature (974)..(974): n is a, c, g, or t
  misc_feature (981)..(981): n is a, c, g, or t
  misc_feature (1378)..(1378): n is a, c, g, or t
  misc_feature (1398)..(1398): n is a, c, g, or t
  misc_feature (1400)..(1400): n is a, c, g, or t
  misc_feature (1408)..(1408): n is a, c, g, or t
  misc_feature (1485)..(1485): n is a, c, g, or t
  misc_feature (1521)..(1523): n is a, c, g, or t
ggtatgcaaaggtcccctttcccctgtcctcgcttcctccatccttccttctcccctgttctctctactgatggcacctggtggccccgaaggttacacattgcactagatcactgcataattagcaagtcattcttaattatcccagagtggagaagataaagatgaaggcaagagcccaggttcagcgtctgcttccctggggtcatgacagaggcaggggaggagaagcagtgaatgtgaatctgggtcaggagtgggtgctccctgcttcttcctccccagcagcctctggggggactggtgtgctgaggttgatgggccatgatcagctccttctcaccttcacagtaatcccatgatgtagaagggaccattcctgtttttcagtggaagaagctgaggcagagaccagttagtgacctccccagggtcacactgctgctaaacagatgtgaaacccaggcctgtgggatgtcgtggttattgatattcatttcttacttccccaggagccctgagtccctttgaatgtggatgtgtgtcgtctgattcgtctttcactcccacggccccagcatgtgctctacaaatgggatgcactcaagttattgaacagtgaggggtggaggggggagaaggaaagcaagggatgcttggagatggtcccctccggggcagatagaggaagatggacccttagtgagaccacgcgcagaacaggctgggtgagccacttccgtccctgatgtccacagaggcagcttcctctctagtgctgggcgagcgtgccatagggtatgggttcagcactgagcttgtaaactgacctaccttgnaagtaggccaccaagccaagggcgtctggaccaggaatgacaaacaaatggcaccattccccgatcctcagngtggacattgttcatcaacggcctggccccagtgaggcctaagggccttcccgacactngccntccagancatcctgctagtccatggagatagcagatatgctgcaagctttctgatcctgagtctgcacttgtccttggcaccatagcctgtgaccgtaagagaatagactgtccggggtctttgtcaacaagcacgatgttccttagtctcatgggctcttggctaaggaaagagccccagggtcatgtcttctacctccaccttaggcaggattcacccttggggcacccccggaaggcgcttgtgagctggaacctaattgctatgcaaagtgatgcagttgtttatggaatttttttttttaacagaacagagatctgtttccttgcaactctgcccgctattcctgatacaagtttactcacttctccacctgacagccctttggatattttgatattcnaagggaatgatcatattctnanagtcttcngatctttagccagaacatccttcagttatcttcacatgtcgggagtttctcgctcatcaccatctcattacccttcntgagatgttgctcatctgtattctgtcagcaggctnnnacacatcaggccccatcccaggtgctagagacttagcagtgaatgaggctgacttcgcagtctgcaggggagttcagagtcctcttactgtgtggatcccagtctaaagggatgtgactgtggctgagactggtgcctggaatggattcgttcatgagtccagggctctgttt

SEQ ID NO: 620954 - DNA, 325 bp, Homo sapiens
agaggatcccccacctacagcagcattccaagggtcccttaaagattttctgctttttgtctcccttggaaatctgccatgagcacagaattattttaatttttcacgtgagaagattttaaaaccatttaaacgccaccaattgagcaagatgctgattcattatttatcagccctattctttctattcaggctgttgttgacttagggctggaagcacagagtgtcttgacctcaagagaatagctggtttccctaagtttacttctataaaaccctgtgttcacaaaggcagagagtcagacccttcaatgtaaggagagtg

SEQ ID NO: 620955 - DNA, 1357 bp, Homo sapiens
  misc_feature (839)..(839): n is a, c, g, or t
  misc_feature (911)..(911): n is a, c, g, or t
  misc_feature (970)..(970): n is a, c, g, or t
  misc_feature (974)..(974): n is a, c, g, or t
  misc_feature (981)..(981): n is a, c, g, or t
ggtatgcaaaggtcccctttcccctgtcctcgcttcctccatccttccttctcccctgttctctctactgatggcacctggtggccccgaaggttacacattgcactagatcactgcataattagcaagtcattcttaattatcccagagtggagaagataaagatgaaggcaagagcccaggttcagcgtctgcttccctggggtcatgacagaggcaggggaggagaagcagtgaatgtgaatctgggtcaggagtgggtgctccctgcttcttcctccccagcagcctctggggggactggtgtgctgaggttgatgggccatgatcagctccttctcaccttcacagtaatcccatgatgtagaagggaccattcctgtttttcagtggaagaagctgaggcagagaccagttagtgacctccccagggtcacactgctgctaaacagatgtgaaacccaggcctgtgggatgtcgtggttattgatattcatttcttacttccccaggagccctgagtccctttgaatgtggatgtgtgtcgtctgattcgtctttcactcccacggccccagcatgtgctctacaaatgggatgcactcaagttattgaacagtgaggggtggaggggggagaaggaaagcaagggatgcttggagatggtcccctccggggcagatagaggaagatggacccttagtgagaccacgcgcagaacaggctgggtgagccacttccgtccctgatgtccacagaggcagcttcctctctagtgctgggcgagcgtgccatagggtatgggttcagcactgagcttgtaaactgacctaccttgnaagtaggccaccaagccaagggcgtctggaccaggaatgacaaacaaatggcaccattccccgatcctcagngtggacattgttcatcaacggcctggccccagtgaggcctaagggccttcccgacactngccntccagancatcctgctagtccatggagatagcagatatgctgcaagctttctgatcctgagtctgcacttgtccttggcaccatagcctgtgaccgtaagagaatagactgtccggggtctttgtcaacaagcacgatgttccttagtctcatgggctcttggctaaggaaagagccccagggtcatgtcttctacctccaccttaggcaggattcacccttggggcacccccggaaggcgcttgtgagctggaacctaattgctatgcaaagtgatgcagttgtttatggaatttttttttttaacagaacagagatctgtttccttgcaactctgcccgctattcctgatacaagtgtactgctaaatccaccttacgggg

SEQ ID NO: 620956 - DNA, 1563 bp, Homo sapiens
  misc_feature (706)..(706): n is a, c, g, or t
  misc_feature (778)..(778): n is a, c, g, or t
  misc_feature (837)..(837): n is a, c, g, or t
  misc_feature (841)..(841): n is a, c, g, or t
  misc_feature (848)..(848): n is a, c, g, or t
  misc_feature (1245)..(1245): n is a, c, g, or t
  misc_feature (1265)..(1265): n is a, c, g, or t
  misc_feature (1267)..(1267): n is a, c, g, or t
  misc_feature (1275)..(1275): n is a, c, g, or t
  misc_feature (1352)..(1352): n is a, c, g, or t
  misc_feature (1388)..(1390): n is a, c, g, or t
caatgcttgcgcacagtgcgtcgtataacaatgacggtgactgggcaaagtcctggggctgcttccctggggtcatgacagaggcaggggaggagaagcagtgaatgtgaatctgggtcaggagtgggtgctccctgcttcttcctccccagcagcctctggggggactggtgtgctgaggttgatgggccatgatcagctccttctcaccttcacagtaatcccatgatgtagaagggaccattcctgtttttcagtggaagaagctgaggcagagaccagttagtgacctccccagggtcacactgctgctaaacagatgtgaaacccaggcctgtgggatgtcgtggttattgatattcatttcttacttccccaggagccctgagtccctttgaatgtggatgtgtgtcgtctgattcgtctttcactcccacggccccagcatgtgctctacaaatgggatgcactcaagttattgaacagtgaggggtggaggggggagaaggaaagcaagggatgcttggagatggtcccctccggggcagatagaggaagatggacccttagtgagaccacgcgcagaacaggctgggtgagccacttccgtccctgatgtccacagaggcagcttcctctctagtgctgggcgagcgtgccatagggtatgggttcagcactgagcttgtaaactgacctaccttgnaagtaggccaccaagccaagggcgtctggaccaggaatgacaaacaaatggcaccattccccgatcctcagngtggacattgttcatcaacggcctggccccagtgaggcctaagggccttcccgacactngccntccagancatcctgctagtccatggagatagcagatatgctgcaagctttctgatcctgagtctgcacttgtccttggcaccatagcctgtgaccgtaagagaatagactgtccggggtctttgtcaacaagcacgatgttccttagtctcatgggctcttggctaaggaaagagccccagggtcatgtcttctacctccaccttaggcaggattcacccttggggcacccccggaaggcgcttgtgagctggaacctaattgctatgcaaagtgatgcagttgtttatggaatttttttttttaacagaacagagatctgtttccttgcaactctgcccgctattcctgatacaagtttactcacttctccacctgacagccctttggatattttgatattcnaagggaatgatcatattctnanagtcttcngatctttagccagaacatccttcagttatcttcacatgtcgggagtttctcgctcatcaccatctcattacccttcntgagatgttgctcatctgtattctgtcagcaggctnnnacacatcaggccccatcccaggtgctagagacttagcagtgaatgaggctgacttcgcagtctgcaggggagttcagagtcctcttactgtgtggatcccagtctaaagggatgtgactgtggctgagactggtgcctggaatggattcgttcatgagtccagggctctgttt

SEQ ID NO: 620957 - DNA, 201 bp, Homo sapiens
agcggggaacaatcacttaatcaggaggtggaggttgcagtgagccgagatcacgccattgcactccagcctgggtgacagagcaagactctgtctcaaaaacaaaacaaaacaaacaaaaaaaggccgggcacagtggctcaagcctgtaatcccaccactttgggaggactacctgtgagcgaccgcgcctggcctgtt

SEQ ID NO: 620958 - DNA, 370 bp, Homo sapiens
gatatggcaagttcggtttcaaaccacctcaatggactaacatcacaataaagcaaatcacacaaattatttggtttctcagtgcatataaaagttacatgatttttggctcacgcttgttttctcagtacatataaaagttacgtgatttgtggtggctcacgcctgtaatcccagcactttggtaggccaaggcaggtggatggcctgaggtcaggagttcaagaccatcctggccaacacagtgaaaccccatttctattaaaaatacaaaaattggctgggcatggtggcgggtgcacctgtgatcccagctacctgggaggctgaagcagggaatcgcctagttctagcatcgcgagcggccgct

SEQ ID NO: 620959 - DNA, 724 bp, Homo sapiens
agcgatgagggggcgtcaggccgcgggagaggaggccatgggcgcgcgcggggctgctgctgctggcgctgctgctggctcgggctggactcagtgaagccggtagtcgcaagaggcggcagcccttatcaagaccatgctggcctgacaggtgtcatcactgtcgcagacatcgtggtgtggagagggacagccgaaactcggtgcgtatggccagtgggcagtggtgagcctgcgacctgtggggattcccacgatatgctgtgagtgagcctgctcagaccaccgcatgggacacatcacagggcggcgcactgcatttgacaactgaacagttagtagatcccatcacgtgggtggattggtacccaagtattgagacacaagactgacattaccagtgccagtccattcgttggatagccaagcaaggcccgtacatagaacccgatataactatcagtatcggaatatcgttatctagagacccatcagacgttacacttgggggatagttacacacactagtgaacattatgcacatagagattgaagggcgtgtcatgacacccgtgtcgacgcatacaacgttagaagcacgatcacaagaccccaatacgttgatcttccagggacctcgcaacaatttgggaggaaatgagaacacgagacaagaataggagtgggatgactggactggggggtaagatcaaaagaggatgaa

SEQ ID NO: 620960 - DNA, 357 bp, Homo sapiens
  misc_feature (242)..(242): n is a, c, g, or t
  misc_feature (244)..(244): n is a, c, g, or t
aactgatgaatgggaaataaaatgtggtctgtccacgcaatggaacattattagactctaaaaagaaatgaagtactcacacatgccacaacatggatgagccttgaaaacttgctaagtgaaagaagccaggtgcaaaagcccacatattgtctgactgcattgaaatgcaatgtctaaaatggacgaatctatatagagtgaatatagattagcgtttgccagggcctggaggctgtgananatgaggcatgactactaagggtttggggtttctttttcgggtgatgaaaatgttctgaaattagtggtgattgtgcccgattttgagaatgtactaaaaaccaatgaacttta

SEQ ID NO: 620961 - DNA, 220 bp, Homo sapiens
ccccgccttttttgttttttggggaattctttttatggggaccccccccttttaaagcccctggggccccttgccccccggtatgggcctgtcaagggaacccctcccctttttgtagcccgggggccccaaaatccccctttttaaggggttgcccggtgttccctttgagggggggggttttaaaaatccgggaataaattggtttttgaaccctcta

SEQ ID NO: 620962 - DNA, 384 bp, Homo sapiens
aaaattatacaactttctgggccatagggtgtcttttatatgagaaaataggtcactttcagtcccccaatgctgtgattctatgaaacggacttctctgaaacactagtagcagttgatgtactagaaacatcccccttttgtactttatcttattcttttgtcatttttagtgattggggggtgccttgggtcagtgttcctaaaatttgatacttggccctctgtttttctgtgtatatactctacctgtctgtgatctcaagaggtagtataatataggtgttaaaagcactgactgtcaaaaccaacccagtcagcttctcctctccgtggcagggaggagaatggggaggaatggggagcagacagggataggcatga

SEQ ID NO: 620963 - DNA, 790 bp, Homo sapiens
acgacggcgggcgatggcggcctcggggcccgggtgtcgcagctggtgcttgtgtcccgaggggccatccgccaccttcttcactgtgcgctgctctcggtgctgggtgtccgggcctcgccggttcctgctgtcagcagccccgtggcgcccgtcgggcctcacgctgaagtccgaggccctgtcgcgaactggcaagtttactaggctggtaacctagatcatttgtgtacgagaatcccatctccctgttctgcaggcgctatcatcatctggcgctgtagctggcaattctcgagagaaccgtggagcaccgtgccgaccaggtgcttcttcaccgtgatcgttcgccatcttctccgctatcatcgttcctgtcattcgaggctgtgtcatcactgtcaaagctgggggaagtggaggatgccagaggttgcaccccagtggacctttgccatgcttgggagatcaacaaccgtccgttctcggatgaggcgggacctggtgttgggcatggtgagtgccctacagtgcgctggttaccggtgggctcctgctgggtgccatcgtggctcattccccagacctctttcctcagtaatggtctgcgggctgtccatcgggcatgggctatgggctcacctagtgctattccatcgacctctcagagcgagtggcgctgaagctcgatcagaccttccccttcagcctgatgaggaggatatccgggtacaagtacgtctcagggtcttcagccgagaaggaggggaagaccagagccggaaactga

SEQ ID NO: 620964 - DNA, 404 bp, Homo sapiens
cgcgaacgctgtgatctcaacactttgctcattgagttctccctctcacatatcctatttcaccacttacaattgccaccttccacagagcagtaggacaccaacacaacatctgtaaaaaagttaacgccttctctacagatctctctccttctggggcttcaccagaatcacccttcatagcagatacccccaaaagtctgtcatcatctacctgagacccagttccaaagctgcttccacatatttaaaaatttagtacagcagcacctcattcccagtaccaatttctttctcagtccttacagggtgagataacaaaacgctatagactaggcaatttataaacaactgaaatttactgcttatagctccagaggcagggaattccaagatcaaggaag

SEQ ID NO: 620965 - DNA, 1038 bp, Homo sapiens
atatcagccttctctggcgtctgtcgttgtggagagcttcctatcttaccaaggggtaggggctaaaagaacaacaggccttcctggtagtcacatagcagaatgatcagagtaacattgcttatgccaaaatatggtactccctcaaaagatttttttatcacccaaagaaatgaataatagaaaattacttaatcaactaaatataaacacttcaaggagttgtacgactataaggattcatgctatccagcagttatacttgtctctacatctctaactcctcagctttctggcgaagttgcacgggacctcacagtggtcctctgctggatttcatgcagacttagctagtagactctggctgtattgtcggatcttgttctgcgtttttcataaggtaaactgagctcactcgttgtacccacacagatccatgcttgcaggtgtactacgcgtaggaaacatgtatttggatcttggaattgggacagtattaaggtcactgttccatagaaaagttaagttcataagtttgttgaccttatgtaagcatcaatagtcaacgcttacaagtgatttcaaagagaaactgtgtgattttgcactcttacttgtttgactaattcctgtaggttggagaatccttgatgggtagttatgactaagggatacgtagacctctacttggacaacttctcggaccttatatttacatgtagtgcccactctgtgacaactagcttatattaccgtgggttgacctaaatgttccttcctatccattgtgtattgtgactggtattttctcaacaaaacccggcatagggggctccatgctagaatggtgcaaacctatcctctggaatggctcgcacctgttttacccgaaatgttaaactattcccagcctaaggatcgtggggggccagcaggatgtaaccggcctggtaacacactgcggaatccgcacccgtggcccaaaagggaacactcgcccccgaccttaacctgggcaacacctgggcccgtgccacc

SEQ ID NO: 620966 - DNA, 165 bp, Homo sapiens
atacaggctaaggcagggttcagaaagagggcagggtatcagaaagtagatagcgcaataccagtaacactaggtataaaacaaatatttacaaactactatatactactacacacggtaagaatagaacctgtagtactaggaccgacataatagagaacgcat

SEQ ID NO: 620967 - DNA, 326 bp, Homo sapiens
tatcacagctctggaaaagggggaggacagcagagggagtcaggcgagggagactggagagtggattctggatcgaggaggcgatggagtccggcagaggttgctgaggttcccgggtatctgatggacatggagccatgtgctctcttgccacagtgacaatgatgacgagtggctcagaagtgggaccgtggagtaggatgagaactatgccagcttgttgggcacgatgatggatggtgtctctcaaaggatgaatgcaaggcagctcaagaactagttcacttgacattaaagtgtctccaagagaccagccgtgagccgct

SEQ ID NO: 620968 - DNA, 897 bp, Homo sapiens
ggatcccgttgacataagtacaatgctgatagtgactagaacgtatgtccgagcactcgtaatactgcaattgcgtctgtctgtatgcatgcgtcgggacccctggcacgatggagaacttaaaagcctgcgaggtggtagttggggtcagcgtgcctcgagtataagcaagatataatccatctcatggtcatgcatgatctgaaagttgtccacttagagttttacatcgtcatcgactctgtacctttgtaagagttatggtcgttgttactaagttggcgcctggcgcccccggaataatcagggagcggttattgtggaatcggggtatgctcggaatgctcagcctctataagaaattcctatgctggtaagtatccttgtagacctccgctttcgccctccctggggtcacgtcgctgcgtccagacgatgggtatcgatggcccgtgaccgctcagaggggcttgcgtcgccccctggagatggcgtgtccggttcgcgggtctgggcggcttccttgggctttttggcgttggtttggaccgttggggggacttaggcaatttttggtatttttccttttcgtgggttgctgccttggatgccctgactttgccgggcccaaagtgcttcctcccgattgagggaaggaagggctttatgttgtcgccttgggggccagatcgtgttgccctttgcttcactttagcctttgttcctgggtcggctctcttgtttagcgcctgccttgtattggcccgtttagtttagggccggtggtttcacctccctgaagggggcactgcgtggatgtggctaccctggccgcgggtctagcttctccacggtgcggtgtcttttccccggacgcttggtaggcggaaggtgggg

SEQ ID NO: 620969 - DNA, 394 bp, Homo sapiens
ggtggacattgacacacatggacactctgaacctgagggtcttctggggtgcccacctcatctgattaactctttccaagttttgttaggatgaaagctgtgggctagcctctttcccaacgttacagctgggaaagaggggaagaagagtggtgcctgagagcagacatggaatgctaagcctggtcctgggatggccatctcagtgatggcctaaggagggcagtagtgagccccaggcttctgggtggtagaggctggaagtccccctgatgcccagcttccccccattgcctcttcgcaatggtgccctccttctcaataggtggctgctgtagggaggtgttcaaagaggcctgtggaaggtgttctgccccaagccatcttcacctct

SEQ ID NO: 620970 - DNA, 174 bp, Homo sapiens
ttacgctccttccttctgattagatttctcagtgttcaactgcgtctctgttttggcttgcatatctttccaaataaatcaattggcctttcaaatgttagccagatattataagacacatcagatctgttctataccatgacaattttatcgtgttaaagaataattaagaca

SEQ ID NO: 620971 - DNA, 616 bp, Homo sapiens
  misc_feature (98)..(98): n is a, c, g, or t
cgttttttctgcaggcggttccgcctttgcaacccaggtaaaacctgccgcagaaataataccgcccgcgatcatgctgccgataataagcgcgattnttttcatctcattaaacctgggttactggctgactttaatatcctgtaataaagaaaggttgccctgcgtggacaaaattaaacgccactttgtcgccggttttaatttcactcattttcgtctgcggggtgatggtaaagcgcatggtcatctccggccagttcacggcagcaatcggatcgtgatggatggtgatttattctgctttccagatcgataccctttaccacgccagatggcgctaataacctgtggttgtgcttcgctcatggtttcatgatgatgtacggttagcctgggcattaaagccaataacggtaaacagactgaacattgcgacttgcagtggctttatacatttattctctcctggagttaaaaggtcatactctaaataattcgagttgcaggaaggcgacaagcgagtgaatccccaggagcttacataagtaagtgactggggtgagcgaacgcagacgcagcacatgcaacttgaagtatgacgagtatattgctg

SEQ ID NO: 620972 - DNA, 141 bp, Homo sapiens
gaggtgttgtagggtgattaagagatcgatggactgggtgggtggtatgggcagaagaaatcctgccgtcccccgaagggagaagaggttcagaaagtgtgtgactttatgacaaggtcgaacactacccataagcacctt

SEQ ID NO: 620973 - DNA, 100 bp, Homo sapiens
cagctgcctatgccaggtagcctgttagtacagaacatcatctgtggagctggcgattgcagggtttgccttcagcagtggggggatcctcttaaagtcg

SEQ ID NO: 620974 - DNA, 1113 bp, Homo sapiens
ggggtggctgcggagagggtgcttaactgagggtgcatatgtggggaggcgtgccgtggccgcggggccttgtcctgttgcgcgaggacagcttcacgctgcttctctgtctgcagagcaatgtgtactgtggctgtgcagtgctgtgcgcctggctgtgactgcaggtggacgcttgcttggcacagacacccgttaaatggcaatggtgctacggcattcctgatacgcaaagaagctccagaacaagaaaattccaggaccatgtggaccaaaggagctgcaagtttcaactacattcccgtggatgcggagcattgtcatcccatcgaacacttttcaacaagtcgaccaccccaaagcggaggatctgagtatgatggggaatcacggtacgaatcaaagggattcagtggaccaagaggcagtcgcccatttccgtgaagacaatattaccttgactaaccttacgagaagcccccggggcgtcgtggagggataacggaacgtatgaaattcctagttttggccgcagagaggcttggcctagaagaccttaggaggcctcacaggttacagaatcacaggtagcacgagagttgatgtaccagattgcagggcaggggatccaagggaccgcgggggactccaagctttggcagcaacctggtgaatttgagcacgcatctgacagattgggcgaacacggcacccccgggtgccagtatgcgaatcttcgtaagcaagtggcaggaacctgacgtggggccttggcgagtcgcggcttatgcacgggacgacgaggcacagttgtgaaaaaaagccttctgtaccacatgaatgcgtggaacggaaaccttgaacccgaagaagcgggtccgtccttggaccgttgtaatagtaacagagaaacgttttgccccggagagcaaagttcagcggggcagcgacatctccaagcgtacgtggaggctgggaccaagaggtgaggagacaggtccggaggatgacggccacgatagaaacacgatgaagttagacgaaggatcgaggagacatatgagcaggacgatcaggggaacgggcgcgcgtctcgccggaagatgagtggcg

SEQ ID NO: 620975 - DNA, 421 bp, Homo sapiens
ccctaaatggaatcttgtgtacgttgctgatgggaactaattagtacaaccactatgtcatgctaccatatgatccagcaatcccactgttgagtatagacccaaaagaaaggaaatcagtggtccaggcacggtggctcatgcctgtaaatcctagcactctgggaggctgaggtgggtggattgcctgggcttaggagttcaagcccagcctgggcaacaggagcttgagaccagccagggcaacaaggcgaaaccccgtctctaccaaaaatacaaaaagttagccgggcatggtggtgtgtgcctgcagtcccagctactcgggaggctgagacaggagaattgcttgaacctgggaggtggaggttgcagtgagccgagattgtgccattgcactccagcctgggtgacagagcgg

SEQ ID NO: 620976 - DNA, 335 bp, Homo sapiens
  misc_feature (40)..(40): n is a, c, g, or t
  misc_feature (69)..(69): n is a, c, g, or t
tggagactgtggaggtgtagactaatattcctttgaattntaatttaaaagagagcaacctaggcgtgngtgcacgcctataatcctagcactttgggaggccaatgtaggcagattgcttgaacccaggagttcgagaccagcttgagcaacatggcaagacctcatctctacagaaaatacaaacattagccgggtatggtgcatgcctgaagtcccagctacttgggtagctgaggtgggaggatcatttgagctcagggaggtcgagactgcagtgagccatgttcgtgccacctcactccagcctggtgaaacagcaagaccccgtctca

SEQ ID NO: 620977 - DNA, 936 bp, Homo sapiens
  misc_feature (4)..(4): n is a, c, g, or t
aacntcgctttgttgttttttctgttcattattttttaaaaaaaaaaaaagtaaattataatctcatattacagacagtaggatagagacagatagacaagggagagtgaatcgcacttgctcgctcgtcttagttagaactactgacatgtcttctgctctcacttgtttttctgttgctcagaaatcccttgtggcgatgataagccgcgccctttgtgttaatttccgccaacttggggaatacaacagaccccgagaatcacccttttccctttgtttaacgcccctgttgcttcgctcccacaccataacgacgttaataattgtggggggttaaaaaaaacccagagaagagtgtgtttgctcctgggttggtgtccacgcagtcgtgcggtgctttcccggggtgttacgccccccgtaggtgtggggtgcggtgtccccaagcaggcaggtggtcatgtctttctcaaagcaagagggggccttttgcgagttctacaggagaagccgagctgtgtcgccaccaacacatcgcggcccacatgttatgcgggccccagtagagaagaaagatttttactttggcgggttaaacgcagtttgtgtacaccacaggattgggcctacaagtgtgccccaagacctgctccaatgccccaccgcgtgggacggggcgccccacttctcacccggctgttttgcacgaaggagaggcattgaaggaggtactcgccacccacctatgccgagacaggggcccgcacgcgagagtgtagaggtccacccgcagacgaacaagcggttcttcccggacaagaataccctcatatcaatttgttaaaaaatgtgggcgaaaaaaaagcgataccattttagaggggcaaccccccaaaccttttttaaagaaaccaaatggcggcccacataaca

SEQ ID NO: 620978 - DNA, 1109 bp, Homo sapiens
gcgtgcaactttcccggctctccgcgcgggcggggaaggtcagcgccgtaatggcgttcttgcgtcgtcgggaccctacctgacccatcagtctaaaggtgtcgctggctttataagcgggcgctactgccacctcgagtcgtggtgcgtccacgaccagacgacataccgatacttcgcttgttacgatgagagcccggtttgagaggaacataatgaagtgaagaaggatatggctgaagggcacccatgctgctgaaggaggccgacgaacgaattctgggtaacgtcagccagtccacacgcgcatacatctttcctcgtgactctccctgggggcacgctccttagtgaggagatacgactcgcgtacaaggctcccagaactggtgcgttaggatgacgtggcatccattcgtgagaaggcaaactgtaagtcgctggattggatcgtgtatgcgcaaatgcacgaggaaccacgttcgggagagaaaacttgcggggagggggaacacggctgggggcacacgcatgatgcgcttgcaatgccaggcttcgcacaaggagggaaacaccgccgacccgtggttggctccgttctatagttgcaatgccgttcagtgccaccttgtcccacggatacaagggcaatgcgtagaatgtctgtcccgcccccagcttagatgcggatgtgaacagtagtcctgctcgaacgccaggacccccggggcacgaaggcggggaccgccaagtagtccagcacagatggaagaacgcaggcagcacgtgctatgtcctcttgcggatggacctttggcaacatgcctggaacatcaatatacttggctcaactacggaacctctaactgcgtgaggaatctgaacgcccgtcaatattaaagccagagtggctcaaggaagcaagaaactgagttccacacgccgcatattttcacaattgacaagcccacaacaacgaacccggcgggaccggccctatagaggctggagacagcacgggacccaccagcaaagaccgcacggacgcaacctgggcgacatatacacaatcgcgcatggggaacgattacacactggcgtacccagag

SEQ ID NO: 620979 - DNA, 124 bp, Homo sapiens
  misc_feature (76)..(76): n is a, c, g, or t
gccgcaggagaagatggttaggtctacggaggctccagggccgggagtagtgtcgcctgctcacatggggtaaacncttacctccctctctcctactccggcctccactatagtagatgcgagc

SEQ ID NO: 620980 - DNA, 482 bp, Homo sapiens
  misc_feature (15)..(15): n is a, c, g, or t
  misc_feature (24)..(24): n is a, c, g, or t
  misc_feature (62)..(62): n is a, c, g, or t
atgcccagctttaantgcttggcntctcctcgtctctcttaatcaggacaccttagaacaantaagcccgtaatcttgtttaattcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 620981 - DNA, 902 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 620982 - DNA, 132 bp, Homo sapiens
ttgacccaccacaggactcactggactggacttctatttatatgtattaagtaactgatatatatatatatatatattttgattgacaccaaaaaatttgaccttggcacaaattgaccagacctgtgaagg

SEQ ID NO: 620983 - DNA, 1064 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 620984 - DNA, 140 bp, Homo sapiens
gaggaggaatatatagatactaccaggccgcatacaaactttattcattatgcagaaggtataggggctatgttttgttatattatgctggtggataccccttcaaacttcccttgcggtactatatctgttgcgccagg

SEQ ID NO: 620985 - DNA, 747 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgcctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 620986 - DNA, 568 bp, Homo sapiens
  misc_feature (24)..(24): n is a, c, g, or t
cctcgcacttggttgcccgtgcanctgcaggctgagggcagggcctgggatctggggctgaagagaccctctgattccaggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcaaccaagtggagccgggatccttagagtga

SEQ ID NO: 620987 - DNA, 174 bp, Homo sapiens
tgtccggcattaagcagactgctgggttcagttccaagccacactgggtggtgagaagcattcgacttctttatgccttgatatccctacctgtaaggatggggctaactaggattgttgtggaaattttattgagttcttatatgtcacagcacttggcacaaaaataagtgt

SEQ ID NO: 620988 - DNA, 914 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 620989 - DNA, 1511 bp, Homo sapiens
  misc_feature (286)..(286): n is a, c, g, or t
  misc_feature (697)..(697): n is a, c, g, or t
  misc_feature (936)..(936): n is a, c, g, or t
tcggcgttttggatacaccgcattgtagggcgccctatgttctttagggggggtgcacacgctagctattgagggggaccacgacgggtgtgtgtgccaccataataaaagtgcagcccaggtgcttgttggtagtacaccgcgtcttctccgggggagttgttcgccccgcggagcgagttaatgttcgtgctcgtaatgccgccacaatcggctgtgttctgcggggcgcctttttcccgggggtgcctgggtggtgtctcacgcggggcggcgcctttctttntgggcacacggagagtatttgtgggggggaaatttttgtacttgcgctgggtggagaacacaacgttttgtcttggaaaaagggcggcccgcaaattagccgtagccgcccgacgtagaaagattggtgtggcggcttttgcggcgttttgctctggggggaaccgcgaatgcgtgcgttgggagtggggagccccccgaggaggcgcatgtagtgtgtagaaatttaagagccgccgccctctcttgcggcgttttttttcggggtgggaataaaaggggtgctcgaacccaggatagtaagagaggccgtcggtgtatagttgggggcaccacagatggtgtattaggaagatagaatatgttgtgcgtctgtgtggcttctggggctcggcgttataaaaagggaccncttttggggtatattctctctgctatgttgtagagagaggttatcacaatggtaagcgcctccccacacaggggagaaaatatggaggcgcgagatttgtagcgctctgttccgctcgcacaaatcccagggtggcgaaatatatgtgtgactcaccaaagagacgccccaacagaggtgtctcacagtgattggagaaattgaggagacacacactctgtagcacacagagtggtgtntatagagagtgtagagagaaacactgtctcataagctcgggagaagccacacacgcgcacagagagtgtgtctcaactcttgggagaaatattattttttcacagcgagagaactctacaccctcgagaagggggtttgcgccacatcggaaaagtaatacacacaaagagcaccacaattatgagaccaccgttataccacgagaacaccactcccaaggagagcccacacttctcgggagaaacacactatatcacagagaagagaaaaagaaagagaagcacaagtcactaaaggcctcacgggagggccactttttgcctcaaaatttgaaaatgagagggtgggccacagagatgaggtaatgtttaaagtggagagagagtgcttccacgctgagatgatttgagtctgtcctatactgctccacttgaggtttttcgtgccctcactcacgctgagggcacagggagaatggaactttaaatggagagaaccaccttttaatctattctttttaattcacttgtttcagttttgatttcagccaacatgagccaacccctttgactga

SEQ ID NO: 620990 - DNA, 2875 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 620991 - DNA, 453 bp, Homo sapiens
  misc_feature (6)..(6): n is a, c, g, or t
  misc_feature (11)..(11): n is a, c, g, or t
  misc_feature (18)..(18): n is a, c, g, or t
  misc_feature (22)..(22): n is a, c, g, or t
  misc_feature (153)..(153): n is a, c, g, or t
  misc_feature (214)..(214): n is a, c, g, or t
  misc_feature (283)..(283): n is a, c, g, or t
  misc_feature (317)..(317): n is a, c, g, or t
  misc_feature (323)..(323): n is a, c, g, or t
cgtgangtganataaganggcntgtggcagaggcttttaggatacaggagttaactcaggatgagctgcattgcccactgcttcctgggttgcaagacagcctcttctccaacaccagtcacaggttttggcccaaatgtagaaatgaggagntgaagaaaaccaaaggtggcctggcgtcaaggacaggcgatttaaagaaaacaaacctganagtgttttctggccgagttagttcaaaggagacaagtctcttaccaccactaagagtttctcaggatcnggggtggaagagtataccaaggaaacctggaccngtttcngtgtccccttgttgtgcctatctgggaaaggaggagttgtgtgtctgttccccatatatcttcctgcagctgcaggcatacccctgagactgctctcctgtatcatctctctacatcaaaacgcggggat

SEQ ID NO: 620992 - DNA, 99 bp, Homo sapiens
gcctttccaagcggagatgctgatactattgtgaggccgcaattgcgaggcctgtccgtgcgctgtcttgtctgcgatgctgaagacctggtctagccc

SEQ ID NO: 620993 - DNA, 297 bp, Homo sapiens
acggcaaataatgggtactgggcatcagctccttcccgccaaccaggctcagagctctcctctatcagacttcttgcctgaggtccaggatgtagcaaactcatggcctgggcacagttaaccttcagtgaacgtcaagattggttggcgacgactacatgggtctgaggtcggatgtgaaaagtctagtagaccaatgtgggttctccgatatgccctcccatgtgaacggtggacgcgtctgatattacagcggtgcgctgaggccgtacatacatcctaggcctcagcgtcaga

SEQ ID NO: 620994 - DNA, 1369 bp, Homo sapiens
gccagtacttgcctcatgcctaagaccgctaattgagctgtccgcctatccgcgctactctatttgcctctcggttaacagctactccacaggaatccttagtagaatccactctaccagccctggctcagcttatcctctacatccacacgagaccacacaagtgcacctattccacatccaaccttggaccccaactcactccgtactagagcagtagcaactcatcccgcaaccacttcgcactcgctcgctaacacttagcctcaaccgcaatacccttgctgaacaacagtgaactcaccacccttgcctcagcgcacgcattcacgcgccccctagcgaaccagaacaaaccagtgacacaaattcggacctcgaggcactcaaagaattacgaatacacgttactgcccccgcacatggcatagacacattcggcaagacccaaaaccttattacacacacacgcccacatcgatcggtccaaatctacccaagcacgcgggcccgcagcccacccccacaaaagtcccaccaacacgtgcgacatagcatccccccatttcccctaccaccattccccattgccacttaagacctgcaatatagcaccctactctctccacttactcatctaacacagcataatcaaacccccatccattttgaaactcactctccaccactatcgccttaaagttccacaacacccttaccccaactctactccgcactcgtaacccgcccaccaacaaagccccaaccaccacccttaacccaccccattcctccgcccaaaacgtactgcatcccattcaccccatcgccccaccacgcacccacacccaccataccccaatgcctcagcaaaccccctcacccacaacactacgactatccacagccccatacgcccacacatctcctcctccccaatctgccccaacacagccaccccccgcgaccattcagacaaccaacaccactcacactttcaccaccctccaacaagacactcgaacgtagcactacacacctataacacccttcctcacaccctgaccaacgtgtcgcacgcacgaccatcactcaccgtggagcacacactgataaacacacgcagtagttccacaaccagccaagactttccacaacaccccgaacaactagggcacaacgcgccaccctaccaaacgtgaggcaaccaaagcacaccccccgaaccagccgcacatctaccccacaccagcaaagtctggcaacatcactcgtcaacacaacgcgagcagtaacaccgtccaccacacctccaacagcatcagacgccagatcggacgccactacaatcgaccacccctcaaaccgg

SEQ ID NO: 620995 - DNA, 3437 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 620996 - DNA, 2713 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 620997 - DNA, 3599 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 620998 - DNA, 678 bp, Homo sapiens
  misc_feature (329)..(329): n is a, c, g, or t
tccaatattttaaaagggaaaatttaaatacggggcttactgtgaaatatttcagtgggtgacccgggcgtggtgggtcacgcctgtaatcccagcattttgggaaggccaagggcggggttgatccacccgaaggttcgaggaatttcaagaaccagccgtggccaactgtggtgaaaagcctgttattcttttaaaagacaaaatttagctgggcgtggtggtacatgccgtgtaatcccagtctacactggaaggctgatgtcagggaaaaatcatttgaactgtggagagcgcaagagtgttcgcatgtagatgtgggaagatcngcaccatgtgccctccaggcctagtgcgacaagaatagaagactctattctcaaaaaacaaaaaaaaaaaatctgaagggatcttctattggcgaggggtgcgcggaggaaacaaagagaggtgtaaatagagaaatgtggggcaacatgtggggtcatataggatgtggtttttccgtgagaccccacaagttttttcttttgtgataacaaaacgtgtgggggaaaaaacttcagcgccgggggttccccccataattaagaagagaggtccagatataaaaatttccagaataagcgccggcgtggttaccccgtggcaattataaagaaagagggacgaaaaggg

SEQ ID NO: 620999 - DNA, 290 bp, Homo sapiens
  misc_feature (115)..(115): n is a, c, g, or t
  misc_feature (165)..(165): n is a, c, g, or t
tggccggctgtaatgcctcatgcctgtaatcccagtaatttgggaggctgaggcaggaggatcatttgaacccaggggttcaaaaccagcctgagcaacatagtgggaccctgtntctacaaaaaataaattaaaaaaaaaaattagccaggcatggggtatgtncctatggtctcaggaactcaggaagctgaagtgggaggttcacttgagcctgggagttagaggctacagtgagctgtgattgcaccactgcactggggtaatagttgagactctttcccctaccc

SEQ ID NO: 621000 - DNA, 172 bp, Homo sapiens
  misc_feature (12)..(12): n is a, c, g, or t
atcatctgtgtngtgtgtatcagttcactctttttacttctgggtagtattccactgtgtaggtattatccatttatctgtcaatggccatttgggctggtttctagcttttccacttattgtgaatactggctgttgtgcacaaggctttgtagggacaagttctcgattc

SEQ ID NO: 621001 - DNA, 330 bp, Homo sapiens
ctcgatcgctgatccagcaatgtctggttttgtttttggttgttgttgttgttattgttgttgagacagagtcttgctctgtcgcccaggctggagtgcagtggcacaatcctggctcactgcaaggctccgcttcccgggttcacgccattctcctgcctgcctcctgagtagctgggactacaggtgcctgccaccacgcctggctaatttggtttggtatttttagtagagacggtgtttcaccatgttagccaggatggtctcgatctcctgacctcatgatccacccgcctcggcctcccaaagtgctggatcagcggatcgagt

SEQ ID NO: 621002 - DNA, 244 bp, Homo sapiens
cttccagaagcggcattgattaaaaggggctgagccagcaggcgcagtggctcatagctgttatcccagcactttgggaggttgaggtaagtggatcatgaggtcaggagatcgagaccctccttgcagtgagctgagatcgcgccactggactccagcctgagtgacagaaccagactctgtcttcaacacacaacaaaaaaaaaagaaggggaccctccggccccgatttaacttggggacc

SEQ ID NO: 621003 - DNA, 491 bp, Homo sapiens
  misc_feature (1)..(1): n is a, c, g, or t
  misc_feature (41)..(41): n is a, c, g, or t
  misc_feature (43)..(43): n is a, c, g, or t
  misc_feature (47)..(47): n is a, c, g, or t
  misc_feature (352)..(352): n is a, c, g, or t
  misc_feature (382)..(382): n is a, c, g, or t
  misc_feature (428)..(428): n is a, c, g, or t
  misc_feature (453)..(453): n is a, c, g, or t
  misc_feature (464)..(464): n is a, c, g, or t
  misc_feature (485)..(485): n is a, c, g, or t
nttcggcacaggaagtctatatatatatatatatgacggantncacntgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaagctcctgacctcaagtgatccacccaccttggtctcccagagtgctgggatttacatgcgtgagcagccacacttgggcctacattttttctttatataccagaacatctatnaacagggcaccttatctgacttcattagtngaaggaggataattgggatttacacagggcagggctttgtttttantaacatcccggaatgttagggaaantgcttttcttncaacatcttggggttttaggntactta

SEQ ID NO: 621004 - DNA, 685 bp, Homo sapiens
tatcaatcagccgtacctgtctgaagttgccaaatcactgaccagttagagaaatgcaaatcaaaaccacagtgagatagcatctcacaccagtcagaataactgttattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaaggggacaaccgacagtagggcctacttgagggtggaaggtgggaagagggagaggatcagaaaaaataaccttgggttcaagctt

SEQ ID NO: 621005 - DNA, 1076 bp, Homo sapiens
aaaccagagacctttgttcacttgtttatctgctgaccttccctccactattgtcctatgaccctgccaaatccccctctgcgagaaacacccaagaatgatcaattaaaaaaaaaaaaaaaaaaacattaaaaaaaaaaaaaaaatggacaggggatttttaaacgggtaaaagggaacctaaattttaccgggttgacatttttaaaagattcaacgggaggcccctacactttcgtgggctacaaggggaattaccgggggcccagaattttactccgtgccacgtggtcctttaaaaaactaaaaaaaaaaaacacaaacacacaaaaaccaaaaccaacaccacccaatattaaaacgcacactagtgggaaaaatcctagtgtaaaacaatggttttgtgggaactcttgggaccacattgcgccggcccgggaaccagttgtaatctcaccccaattggatagtggagccctctttgaattggcccccatttttttgtgtctcggcggagacattttcccccagggtgggcgggggcgcacccccaacctgaagctctgggaaggtttccccctgaatttgggggcacccctcgtttggcgacatttcgggggcaccccccggggcgcaacgactttcccccctcccgggttctcgggcaagagggcaaaatttcctaacgcgagaggagaggggtcgggccccaagaacaggaacagcacggtttacatacggcagaagccacattcgggtcgtgaaagagcgtgtgaacccactctcctgtgaattttctagaaagtattgatacgccacttttgttgagcacatatgcaggccgggtaaactcccggagcaaacgggcacggcccaatttacatgtgccctacatacacacaaaattagggattagtcagaaccgcaactttaagagataaatatttgcccagggatatatttacatacggctccataaggtcggtaggcacatactgtggacaacaagcgggcgaatccgggcacacagccatgaggccagaataacgggcacagaacattagactgtgtcacat

SEQ ID NO: 621006 - DNA, 153 bp, Homo sapiens
tctagaggatcccgtcggttagctgtgactaatcaaagaactcctgactgtagagaatcaaaaaatggaagaatttagtgaagagaaatagataaccctaaatgcaggcaggcagctcagtaagtcccagccacgctttcagcgtttgcatag

SEQ ID NO: 621007 - DNA, 366 bp, Homo sapiens
catttctataattgtgattatatttatttatttatttatttatttatttatttattgagacagggtttcgcccagtctggagtgcaatggcacaatctcagcttattacaacctctgcctctgggctcaaatcattctactgcctcagcctcctgactagctgggattataggcacatgccaccacgctcagctaatttttgtatgtttagtagagacagggtttcactctgttgcccagattgatctcaaactcctgaactcaagccatctgccctcctcagcctcccaaagtactggaattactggtgtttctcactgtgcctggccgtgattatatttaaattgtggttggaagaggagtcag

SEQ ID NO: 621008 - DNA, 143 bp, Homo sapiens
ctgattcggtgggcacttagaggtggggagcagagaattctctatatccaacatcaacatcttgtcagatttgaactcttcaatctcttgcactcaaatgcttgttaagatagttaagcgtgcataagttgcccgcaatcgaa

SEQ ID NO: 621009 - DNA, 687 bp, Homo sapiens
  misc_feature (15)..(15): n is a, c, g, or t
  misc_feature (608)..(608): n is a, c, g, or t
  misc_feature (652)..(652): n is a, c, g, or t
  misc_feature (654)..(654): n is a, c, g, or t
gccgctctagaggancccccgtctctccattgcttcggtcaagcacgatgagtgtgcagagtaatcatatccagaatgaggtgaaacagctatgtgattaaaatatcgtaattcgacagcaattacccggttttctaaattgaatcatgcatctatttataagttctaagtattatgtaaaagaagacaaagttatgaatcttaagaatttgctccatcgttttctctgtaatggtggagaggctgcccataattcatctccacatggagccaagtttaatgtttctagttcacattttgtacttctgtcatgcttatttcaaactccctgagtgatgtgtaagaaatcaaacattgcctcagtggtattaagagaactttggtggtggtttcttcagaatcatgaagttcttttgccagataaatattttgatattattttcctttttaatataaaggatcggtttgaattgtacttaaaatgcatagcattattaaaaacaatcctttaaaatataatttataacatagactgaagcctccccttaagaaaccttaaagaaataagtatcctactcaaaaaaaggaagtctgtttcagaactttangggctttgaaatatttctcaagcctatttcatgagatctacttngnttacccaagtcatgtttttaatagactgctaat

SEQ ID NO: 621010 - DNA, 220 bp, Homo sapiens
acaggtcaaaggatttaaagtaaacactgttccaagtgttgcttaaagaaaatgtttataattgaacttatgtggcaattccatcgcaatgttctcacaatgaaatattcatacttcattacaattaacttgtatggttggacaagtagcttatctctgctgtcttcttcctgcctcggacggctcacagtttaacaagcataatccagtggtaacccta

SEQ ID NO: 621011 - DNA, 112 bp, Homo sapiens
ctagaggatcccctagaactcagagcacatacaaaaccagttgtttcggaaagagggaaaagagtccccgagcccggatcttgtgctgcttttctcactgtggagggaaggg

SEQ ID NO: 621012 - DNA, 120 bp, Homo sapiens
attgagacatcatctcactacaaagttgagatgactgacagatatacctttttttttttatttggaaagggattttcactcttgttggcccaggcgggagtgcacgggcagccccccggg

SEQ ID NO: 621013 - DNA, 314 bp, Homo sapiens
  misc_feature (135)..(135): n is a, c, g, or t
  misc_feature (152)..(152): n is a, c, g, or t
  misc_feature (154)..(154): n is a, c, g, or t
  misc_feature (240)..(240): n is a, c, g, or t
  misc_feature (279)..(279): n is a, c, g, or t
  misc_feature (310)..(310): n is a, c, g, or t
caagctgcttcccctggaaggagaggctcagagaaccagggggttcacaattttaagcttcatctgagcccaaccagacatccccatgccaagcttcagcatccagttccttcccactcagtgcccacgtttcantagtgaggctgtgagtntnagccacacagcagtcacacaactcagagttaaactgtgcatccgagttgtagcagcagcagccccgaggctctcaggaacaagggnctcttccatggccatggcagtcctgattctttgtctatnacttaaacttgagtttagagacctgaacgtntggt

SEQ ID NO: 621014 - DNA, 1562 bp, Homo sapiens
ccgtctgtctgtctctctgctctccggctccttggtcttgcttgtgtcctgtcgttggcgcggtgctccgtcggctctgcgtctcttctctgtccggtggatctcggctgcggtgtgcgcggtttgtgtgctcggtctgtgcgtgcttccttgtccttctctctcagctctcgttttggccgtgtttctgcgtattcaggcttctcctatgatgcctcggtgtttcatctcaaggctatatggtatctgttgcgtcaatggttcgccgtgtggccgctgttctcccgggttcacgcggtcttgtcatatcactgagtcgtccttttgttgttggtcgtttgtgcctacttggtcatttgttctgtcatctgttctctggtttctctcgtggcttgtgtgtgtgtgctgtgtcggccgtgtgtccgcgcgttcgtgatttcgcgtcttgttgcggctggcgggttggcgccatggtgtcatttgtggtgcgtgtttttggctggtccgttgtagcttgggttggcgggccgttgtggttctggatgcttgttctgtggggcgagtggctcggaggtgagtgggtgtgggttgggagtgcgcggtgtcggcgccgtgttgttgtgccctgccgtggggcgtgggtggcctgtgctagtgttccgtgggtctccttggggttggggagatgttggttgcttctgtgtttgcctcgtgcggccagtgtaatgtgttagtgcagaggatattcacgtttgatttttccttgcctcttgggtggggccctgcctttctggcatacgttttttgatgttgttgtgctgataggagcttgtattgtccgagtcggctagtgagtggtgcagtgagtccgctctgtttgcttgtggccgtctggcgtccgtgcctagggggtttgtgaagggtcgagtgtgtgggttgtgtgttagtgctgcgtggtacctatacatagttggtcgctagcgtcgcgtggtgctggtcgtagtttgataagttggtgtccgcagaggttatgtgtggttcctgtctctgtctctatgtccccgttgttggttgtctctagtgcatgaccgtgggctcaaggcgtgttgcctatctgtgcctcctgtgtcgtcagtaggctttatttgtgggtgatacatagatcgtctatagccatctacacatggtcgcctttgcattaggtagacatggtccgtcttgcggcttctgtgcttgtgtacgcgctctatccctgtcacgccagggtgcatctggcatcgtctctgtcacctgtgctctataggaatgctgctcatgtatggctggtatcgatgatctgctatcagcctcagtcctcggggtctgcactgccatccctgggctaacttctgctcaatggcctacctttgatgccatttctaagtacctacagtctacctgacccccgtaccttctggaaggagactggtattcactctaagtctccctatgcaggagttcactgaccacctcgtcaagacccacactcagagtctccgtgattacgactcggggctccagcc

SEQ ID NO: 621015 - DNA, 435 bp, Homo sapiens
  misc_feature (255)..(255): n is a, c, g, or t
  misc_feature (274)..(274): n is a, c, g, or t
tgactcctgtctccttaatccagtaaattttcttttattttgcataattatatttttcatttctagaatttatatatggtccttttcattagtttctgtttctctgcagagattttatatccattcattaattgcagatgtattttcctttacatgctcaaatatagttagcataggtgcattaaacaccgtttttatccccataatttcaacatcagagatgtattgagtttggtgtctattgattgcctttcnttttgagtataaatcaccnttttcgtgtttatcctatggcaagtaatgttggattgcatcctaacatttgtgaataatacattatagagactttggatcctgtttacagtcctctgaatagttttgcgttttatttcctgaggcacttaatctggctggactcaaatccaaacttctttc

SEQ ID NO: 621016 - DNA, 133 bp, Homo sapiens
  misc_feature (102)..(102): n is a, c, g, or t
cttgtagtgggctgaaatcgtgccactgcgcgccagcctgggagacagagcgagaccgtctcaaaaaaaaaaaataccatctcccaccggtcagaatagctnttatcatacaacacatgctatcggctgcagt

SEQ ID NO: 621017 - DNA, 1203 bp, Homo sapiens
ggagagctgggtgttgggaacattgcctgggcctccgaggctcctgctgctgcccctgcttctggctgctgtgctcgctgtgctgcctggggccctggctgccaagggaggacattctctgtccttctggccagactgatggtgacagcccagtgtcctccccagaggtgcatgcagtctccccactgcacgacatgtcccctgtgggagcctcctgtcaacatcacctgctccaccagcagggtgccatgcgtgtggatctacctgaggcagactcgtggccacatgcccaagacatcatattactacgaggacggggtggtgcccactacggacagacgggttcctggggccgcaatctgacttctcagtgatacccaagacaaacctgactatcaccatgcaccgactgcaagctgtacggacacatggaacacaacaacatgacaggccatcaccggagtgtcaaactgtctacgaagactccagtgcaacaccttgataacactggatgaacaagcagggaacacaggatcaccaaagtgacatggtgcaacagaaatgcatcgggaaagtacacccaaaccaatgtggccaacatgacacatcacatgaccacaagcatgaacatagaatccagcacaataccacatgatacccgtcaaaaaacaagaaccatacattgacagaagtagaacattgagcgaggaacaaatggagagagagcaaatcaaacaaatatacgaacagaacagaggaacaaagaaacaataagagagaagtagagaagatagatgaatacaaagacagcaaaagcaaagagaagatgatgaagaatgatagaagcagacacaagatcaagccaaaaacaataggcacaaagacgatacaaaaaatttaagagataaccaaaattcaagttcgcagttagagataatcactcaagaatgctagtaggagcgacagacgcacaagaaacagaaacctcaaaggtagagtaaacacaaaaacaccagaagagcgacataaacatacatcacagaaagaataaccaatatgttaacataaatcacattaaaattacacagcatagtcacgctacgcaatacaacattgcaaccagcgaaaaggacaactaaaccgctatcgaacaacagtaataatcgcaagacaaacgatatcctactataaaaatcaatacaa

SEQ ID NO: 621018 - DNA, 206 bp, Homo sapiens
agacaagcagcaggggagtgcagggaatgcacccaggatgtgagacagcaacacaaagagcagggcaactccagaaggcaaccaggggagggcaggaaagcccacagagttgtctgttcacgcacaaaagcctgctggtgcttcctccagtgccgggagcctgtcccaacggccggcacgggacttgagaaagagcctcctcaggt

SEQ ID NO: 621019 - DNA, 274 bp, Homo sapiens
atgccccaagcatttaaaaaggagtttgaaaggggggccccagccccacgtggtgtgccctggagggttaggttggtttgaggttggcccctcaatttacaccagagcccagggagtcccaaaggcaagtttcacagaattgtcaaatgatcccatttccttgagtcgggttttttttttgtttttttttgttttttttttggcagagaaaattgggttttaaaagttgtttttaaatgacaataaaacaagccagaatgttttttggggtgga

SEQ ID NO: 621020 - DNA, 182 bp, Homo sapiens
taacatacatgatggcttctgatatgctgtgatcttcctagtgtggtgactgtatgttacagaaacgtagtatggatgtgatgtcatcatctgtagtacgtaagaagatgtactgcggcgcgggtggtctgggaagcggtcgccccacgctcgtgcagtgcttaatctgaggacccctcctg

SEQ ID NO: 621021 - DNA, 303 bp, Homo sapiens
  misc_feature (12)..(12): n is a, c, g, or t
gtagtacccgcnatgtgcccatgttatgggaatgtagatggggagtgaccaccgccaacagaagtgtggccatcttgcccgagatgcctgaggacctcctatttttagatgctgctgcccaaggcctgtatttcaggctagggcttgttctatgaaaaaaacaagaagggggggagaaaaaattccggtgccccgggccatgaaaaatattgtcttaaacagtccactgggttttggatatgcagtctgtgcctttcattgccttcctggaaaataataactaaactcttcctcaccaaaaaa

SEQ ID NO: 621022 - DNA, 486 bp, Homo sapiens
  misc_feature (217)..(217): n is a, c, g, or t
ctgcaggaattcggcacgagtattggttcaggatctcatttatccctcatggttgatctttccttcttgactctgcaatcacttttttatacttccaagcaagacatgtttgtgcatttgttggtgtatgcatgcccaggcacgtagagcgtgctcacaagatactaacataatccattttattccaaaaagagcgcaagataggccgggcggtggntgtcgcgcctgtaatcccagtactttgggaggccgaggcgggcagatcactcaaggtcaggaatttgagaccagcctggccaacatggtgaagcatcgtctctactaaaaatacgaaaaaaattagccggacgtggtggtggatgcctgtggtcccagctctcgggaggctggagaaggagaatcacttgaacctgagaggcggaggttgcagtgagctgagaacgtgccactgctctcctgcctgggtgactgcatctcaaaaaaaga

SEQ ID NO: 621023 - DNA, 417 bp, Homo sapiens
gcggcggggcggcatgacgggtatcgattctgggttccgacccgttcgacggaggaaaactgggggtacggaggttttaatctaccgtattggagatcggctccgggtctgcgcggatatacggggtggctgaagtgaaacggagcatgtgaggttttggagacggggggctcgtggacgagtttgggagctcggggttaggggcgtgctaggggtttcttcgggttacgctgacttacctgtctgatggcggggggtcgctacgtttgggttagtaagttgttcttccagggctgcgtttcgcgggcgctgtaggttggcgggcgggcgagtgttctttgttctcaacgtacgtggtgacacggtggtcagtggggtcattgctttgcctaggcgttagaggtaagctgtagggtg

SEQ ID NO: 621024 - DNA, 1271 bp, Homo sapiens
gaagcgctgtgggatgcgcaggatcggtctactgagcaggaatactcccaccatattacctaatgagttcagttgctagaccccaggacgcagtcggattgcgcgcatgcagtatagtcactcgtgcgcatgtgatgcgtgactatgccgtgaagacacgttgcctgcctcgttgtccatgaactcttgaagagtaggacttaatcttctgaggctgtcagatgatagggcatataggtccacggtactgagcagatgcgcagagccgtcgagacacgttgcttacctttcgtgcattcggcccgtacgtcagtgcacgtgactaacacctcctattaaaattaagaccagtaacgtatggggcagaccaggattcactcttgccgcatgtgactcgagtccaaaactccgaaaattcgggccaacccgggaatagcgctatctagaggtcgtaattggaggtaacgaggcagtgaatttaaccgtggcggcggcactttaaattcctatacgggaccatcctaaactatgtacctttgcccatccgcgatgtgatgtcccatgaagggagatctcttagagtaggaaaccgtttgcctgcatttgcgcaatcccggcatcgtgtgggtaggccatatgtccgaaagttagggtgcaggtcccacaggaattctggagcgggcccatccaatttccgagaggaattagaggttacgatatagaccagttgcattaacacgcacagggtcacgtacgggctaccacttccagtccactggcggtggtttgcacccctaccaattcaccgtggcgatttagagacagaggccacgaagtcgcccaaattagctcccggtggattcaggttcgtaagacaaccaaaaagacccaagcttatgccaccccaggcatcaacacagctgaaaaaccgggtgggggtctaataagcctaatctgcggttcaaacttagccattctctgtgggaccttcgtggtctgaggggggcttaacacaccccaaaccagtattttacaagtggaccccacttgggatggccttacgccaattatgaatctgtcggccttaccattcatttcttgctcccaggatgtaggtgtagaccaccggtcattgtaaatcccctaattagcgcaacagaccgcctttgttacccccccgcgttcctaaggacggccgcaggacaatttcgtcgaccctctgaatgaacagagacccatgcagtgctcatccatgtggtctcggcactcgt

SEQ ID NO: 621025 - DNA, 283 bp, Homo sapiens
taacgacatagatacagtggactttggggactcagagagaaatggtgggaagggagtgagaaataaaagactacacattgacgtacagtgtacactgctcgggtgagggatgcaccaaaatctcaaaaatcaccactaaagaacttatttatataaccaaacaccacctgttccttaaaaacctattgaaataaaaagtcaatttaaaaaaaacctcctggattcattgattttattgaaggtcaatacgtgtctctatttcagttcagctctgatcttggtt

SEQ ID NO: 621026 - DNA, 129 bp, Homo sapiens
tacttgtctctgcgctgtcccgaggacgcgcgctcgcgcgggattttcaagcgaaggcccccgttaacatgtagctgccatgagcctctgcgtggacgaaggatcggccctgctccttgggacggctgg

SEQ ID NO: 621027 - DNA, 672 bp, Homo sapiens
gaggaacatctgaagatgcggtctggcctgagtaccgactccgcacggttctgcagagctgtctgaggcatactgccatgggatgtactcaagaatcatgactatgcgatatccgtgctcgatactgcctggctagccaagcaaaacgccctttctacatgctacgagaggaagatatcagtcccaacagaagcttaggcatcggagatgttagtaaacatataactagacgatctccggcaccgtatgctgctggtgtcacgcccttcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagctaaacaataaagctggaactttgtgtcaaaaaacaaaacaaaaaaaccaaaaggggcgcggcgcgctccgagaagttacccctggagggggccccaggcttaagcgggttccccgagtttttgtgtgtacacaagggggcccca

SEQ ID NO: 621028 - DNA, 1335 bp, Homo sapiens
ggtcgccgtgggccgtgtgatccgtggagcacgaggaatgggctccggggtctcgtgttcgacgcggcacgctgatgacaccgtatcaggcgttgcgagcttgggctgcggggatttcggaatgcagccgtccaagcgttaccagtccaatgggcaatcagctcccagggagatcatccgatgagccgcggatcgcgcgtgctgcgcgcgtcgcgcgagggctgtgctcattctctgaggaatcgcagttatcggaagcatcgaagcgggcactggagtcctgttcaataagccgacctgtacggttcgcatgcatatcgagggcacgatctttgatgttccttgacggcgagagaaaggtctcaggttcagatcaattggccaaattgtgcctccgctgatgtgtgaactcactgaacatggaggagttcctaactctgtgatgcatgtgcctgataggcagaacagacctggaagaatccgttggtatatactgtgcgcggggagcactcgggggaaccctactgccattcgcgttcaatgcgtcaccatcgagacaccctgtaggaccagagcaaagtagtcacgatggtggaaaggattcgtcccattctcggagtacgcatcgaaacggtatattcgtacctgtcgattccgcaaagcaggattccgtggtgagatctgtggtgttggagatgggctttagcgacgaggttgttgcaagtacatttccgttaacagagagttggtagacgtggggtaaacgggcgtgggtccagggaaggcagctcacacgaattgaacttgtagtaacacggggctacccaagtagggaaaacctagttgtgagggcactacttcagtgttaccagagtgggattggtcgctctacaagtagaaaaaatcggcatggttggggcatggctgtgcacgttatactgagggaaggagatggggcagaaactcgagcgcaagggcgactattcggtggcaaagtgccccctttccaagacacaatatcccgcgttaggaaagaaatttgtctcccccttggctttgcgctcgtgggagcaaggctgggcgtcttccaattttgccgtgggcccgcccggtgacgtgggaccgttcattcccggggggatagccaaagaactttgtggccagtcgagacacatgaacgaaccttaaggtgcgtggagggtgcctcaaaattaaaaggttatgggggttaaattcgcccgaaagataaaacatcttgacaatgaaagcacgatactaggggcactccatgtattgcgaaggggtggcgcaagcaccaaagacacgggttgaata

SEQ ID NO: 621029 - DNA, 148 bp, Homo sapiens
tttacagctctagaggcggacacgaccctgagacttactgagattcgtaaagaagcaaaaaggcaaaatcagcggggaccacctacctcaggttaggccctaagcaaggcctaaggtttggcccaggagagaggccaaaaaaggcaag

SEQ ID NO: 621030 - DNA, 335 bp, Homo sapiens
tggccagtgggatgagttttatattgtgaggcaaaatcagctccacaatacaaaatctaaaaatcacccccattttccccccctgtgcttcccggggaaggggggaagctgtgggggtttcttttggccgtgcaggggtgtgtggggaggaccaaaggagggccaaaaaagggacaaaggaacccgaggccacagaggccgtggctgtggaggatattccgtgcgtgccccctgtgccctgtgttccgtggagctgtgcccttgtggcctctccgtgtgtgccctctctatacgcggggtcgcaccgcctgtgtgttgtgcggccccagaccccc

SEQ ID NO: 621031 - DNA, 663 bp, Homo sapiens
  misc_feature (240)..(240): n is a, c, g, or t
  misc_feature (244)..(244): n is a, c, g, or t
  misc_feature (314)..(314): n is a, c, g, or t
  misc_feature (352)..(353): n is a, c, g, or t
  misc_feature (358)..(358): n is a, c, g, or t
  misc_feature (444)..(444): n is a, c, g, or t
  misc_feature (450)..(451): n is a, c, g, or t
  misc_feature (456)..(457): n is a, c, g, or t
  misc_feature (461)..(461): n is a, c, g, or t
acttgttaagtcacattccagattaggagaaaatgggcaataatcatctctgtttggcccccattctactacccagcacatgcgcacccaacggccaatacagaactgctatcgatgtcctgtgccgactagcctcctggttccgctcctcgtccgtagaaatcattcactggttcagtcacttctggctttttgtggccaaggcgaatataggattaatatctgtgttccagcttcagncgancgatatgtctgtccatctttctcctttcttccagcacacacagctaagagataagaaggctgcaaggatnggggataaggagtatattttcaagccaagaaccagtanngaaancagaaataatggtgctcccaaatattcagtacttgggcaatccaggaagggtttaaagagacctgttgctgcatagaactctcccngccctnnccctnnactnaccttagtgccaggccgagggctggtctgcatgctggaagaggttgagagtatggaattgattccatgctaaatgtcagttaccagttggattgatgaaagtgatttctctgtatacttttactgtcagaacgtttcctctgtctaccttaattaggatgacagatataactacgaaggggaagttcccgatcttcaaccta

SEQ ID NO: 621032 - DNA, 240 bp, Homo sapiens
cggcgagtgatggtggcacacaagaaatctaaaatgtactcagtaggctgtctttgaggtaaatgtcggtattattattttgaagctattttattttacatactgtatatatacatgcctacacatattcacactgaacagggtaaacgttgataagaactttccttaactgttacggtacacagacttttcaaccatacaaacggagactatgacatacaacaacttacaagaacgcta

SEQ ID NO: 621033 - DNA, 366 bp, Homo sapiens
  misc_feature (195)..(195): n is a, c, g, or t
  misc_feature (212)..(212): n is a, c, g, or t
  misc_feature (234)..(234): n is a, c, g, or t
  misc_feature (244)..(244): n is a, c, g, or t
  misc_feature (325)..(325): n is a, c, g, or t
  misc_feature (332)..(332): n is a, c, g, or t
cttactgcggtcactattgttgcgcttgtcaatccggctggcgaacctgagtgatctatgatgctgcaaagtcctgcgtttgatgtaagatcttccccatgatcctcaggagtgctcgccccacttcttctgagtctgcttcacacttgagaggatatcttgcccctgcgacaagagggcctggcgatcctccanaccagaggccctgatgnactccccggccagggcgtcgtntacaggcagncaaccaggcatacctaggtagaccccttgccccttcagccagcgctggatggctccaaccttaactgccccagtgtatggnactgggntctcaaagtccccatcccggaagaagaaaatgat

SEQ ID NO: 621034 - DNA, 115 bp, Homo sapiens
  misc_feature (32)..(32): n is a, c, g, or t
accaggacccacttcaaagaaggccacaaagncaaagatggccacgatgctcagataggacatccagggtagctgctccagcagtgctagcgcgatggtcatgagtatggcacaa

SEQ ID NO: 621035 - DNA, 255 bp, Homo sapiens
catccacatcagctgatcaactagtaaacacacatgagttcattttaaaagtgtagttcatcagttaggtcatctaaaaaccttaagtcttcgtccgatttggaatgcagccagagtaacaaatggaaactttttcaaggtagagaagatgaaaactcagaacgccctcttgtggcatctctacccaccctaggaacactatggctcttcccctacacatagtgattgctaaccttgctacaagacgttcagaag

SEQ ID NO: 621036 - DNA, 292 bp, Homo sapiens
  misc_feature (16)..(16): n is a, c, g, or t
  misc_feature (183)..(184): n is a, c, g, or t
  misc_feature (240)..(240): n is a, c, g, or t
  misc_feature (273)..(273): n is a, c, g, or t
  misc_feature (290)..(290): n is a, c, g, or t
gtgggcagcggtacanggccaagaatattgccaggttgggatttcaaggtcagtgacgacgcatttccgtcccaggtacagaccctcccaagctcccccgcttgtgcctgggaaccgaattgggggggatgggccaatgaagaagttcactttgagccattccgagaaattaccatgacgtanncaagtcctttcatgacttgtttggcccagttttattgttaaatgggcttcactttnacgctaactttactgggggaacttccatataancgttatataaggatttntc

SEQ ID NO: 621037 - DNA, 191 bp, Homo sapiens
  misc_feature (95)..(96): n is a, c, g, or t
agaaaccctacaagtgtgaaggaatgtgggcaaagccttcagctggtcctcaagccttactgaacacaagagaattcatgctgaagagaaacccnncaaatgtgaagaatagcgggaaagcttgttaatacaacctccaatccttactacacataagatatattcatactggagagagaccctacaaatgt

SEQ ID NO: 621038 - DNA, 654 bp, Homo sapiens
tgaaactttaaaacccctcaaaacctgtttattatccaagtgattttggattcacaatgggcttatcggtagaattccgggtagcaaccgcgggccccaggggctctcccaaatctttttgggatctccgcaggcaaccaaaggtgtacagtctaaccagcatggtgcccgtgtccataacttgggatagagagattgtcctatgagatatctcctctattcttggagacacctctacataccagctaaaattccgtggtataatatagggcacacccaggggacattgtgaacaatgtggaccgtgaccgagatatacgcatataaatctcgtggagccagcgtgttaacccaacacaccctcttaaacaccgtgaaccgcggaagtgttctatacccacagacaaaaatctggctctactgtttggccgagaagaacagggggtctcccggggaaacagttgtatgtctctcccccccctctgtgtgctccccaacaggcgacgacaaaactgttggcaccccccttttctcccaaatttcacactcctttctcaaatatacatacccgaaaaacaattgcggaaagtcgccccaattctgacacaaccacacacagagaaaaatatctccaaatttttctcctcaaaacaa

SEQ ID NO: 621039 - DNA, 159 bp, Homo sapiens
atggcacaatctcagttcacgaaatctccacctcccaggtcacagtgatttttgtgtttcagccatcccgaatagctggaattacaggctcccgcaaccacacccgtgctaatttttgtatttttagtagaggcggggtttggccattgggccagcggg

SEQ ID NO: 621040 - DNA, 130 bp, Homo sapiens
  misc_feature (6)..(6): n is a, c, g, or t
ccgtgncggctgtagggtgttatttagcaccattcattgacctcttccctcttgatgccattggcacccaacaaaaatgtcacaattgaaaatatctctatgaacttggctgcagtgtccctcgtgggat

SEQ ID NO: 621041 - DNA, 421 bp, Homo sapiens
  misc_feature (92)..(92): n is a, c, g, or t
  misc_feature (104)..(104): n is a, c, g, or t
  misc_feature (123)..(123): n is a, c, g, or t
  misc_feature (182)..(183): n is a, c, g, or t
  misc_feature (210)..(210): n is a, c, g, or t
  misc_feature (260)..(260): n is a, c, g, or t
  misc_feature (328)..(328): n is a, c, g, or t
  misc_feature (403)..(403): n is a, c, g, or t
  misc_feature (407)..(407): n is a, c, g, or t
atggtgaggtcatctgataagatcagattcttatacaagaatccaggtccgatactaccagtttcagatgacatactttttgtccgaatcgncatctaggtcantcttaggctttaggctgangcttgccagtgtaaaagctacatctgctgtgaccaagccattttgaggcctccatcatnnatcacatgtaagtgagataactgctgnatcagtggagtctatcactggcattaattcttagaaataaactctgtgtntgtactgctggaaggagctcaactatagcttcgagcatatccgtcatgggcttacaaatattcctganataggacgaaggaacaggagccttcacttcatacttacgatccagcttgatagataagctatccattatcgctgnaagngaagctatatttca

SEQ ID NO: 621042 - DNA, 815 bp, Homo sapiens
  misc_feature (244)..(244): n is a, c, g, or t
cctcctttttgcgcgtgtttgtcccgcgcggattttctgagtccgggatcattcgcccccaagcgctttgtgcgcgagattggtgtgggcccggaatttgttcgaggtccaaggttcttgtaacactgtgtggtctccgcgggtttctcgtttgctcctctgccttccttgtgccgcggcccaattgtcgttgaaccccggttgagacacgctggctaagacacttgggcattcttttttttanaaacgtattgtgtcttcctcaaggggtccgcacgagtacaatacaacgggtactccggctgtttagaaggccgctatcgcctcccgcccggtctcgagggggacgccccctgctttgatcccctttgattctcatggcaatcgcacctttaaagatatattgtctcgctagagaagatatttatccaagactgtcttaactccgtcccggagtattggtgaattggaatttctaaaacgagtgaacttccttaccgttgtattgaggcgagtaaaaatggaccaccttgtggttgagagtgcccaaaacggctctatgttcaaaacccacgcagtaaaagttgacccacaagcaaacaaacaatgtctgtgttggcgagatataattccatagaaaatcaggtgaagtgtaacggagagactgtcccagggatccatacaatgggcaccagggtggcccccgggattatgggttctcggaggattagtcatattgcacgagtgaggattctttctatctctgtagcctcccttcttcttttcccaagtaacacccccccccccggccacag

SEQ ID NO: 621043 - DNA, 398 bp, Homo sapiens
  misc_feature (166)..(166): n is a, c, g, or t
  misc_feature (279)..(279): n is a, c, g, or t
  misc_feature (342)..(342): n is a, c, g, or t
  misc_feature (384)..(384): n is a, c, g, or t
aaaataaagccagtgcctgaaaaaggtctatacacaaccttactaaataaccaaggaaatgcaaattgaaaatcatacctaccagataggaaaaagaaaaaatttaagatacttaactccatgacattttttattttctagatagcaaaaattttaaagtcagctnagtgtcagtgaggatgtggaactcatactctgctaacaggagtgtaagctggtgtatctttggaggacaatacagcagaatagaggtgaagatgtgcaaactctataacccancaatactactcctagggtaggtaaaaacgttaaaataatgcttctcaaactttaatatggganatgaatcacctatcttgttaagatgcagattctgatcagtangtctgggtggagca

SEQ ID NO: 621044 - DNA, 703 bp, Homo sapiens
cggcattatggccggggattatggatgatgcctgattttagaggaattcgcaagggttaagaagtaacctgggctgagatacggtactaaggcgagccctaaatgacagcagtaatatcgatatatctgaacggaagaatactataggtcacagtttagaacgaaacggacatgacagttgtttgtatgcctgtagaagagatagttatgtaatcaggaaaggctggtatacgtcaccttatattgcacaagatataaaccgtcattgtgagaagagtctgactaagtgttcgaaatatgcgcgtgcacagacttaaagacgatagggtagacgtataaccatgatggggccatgattagggcgcattttgtatcacacgaaacgacgatcgcggttaagaagcttaaggttccagagtttagtcattaaaagctgacggcagagagttttatgaaacaggcgcattaagagatgacttaacgccggaaaaatcttagggatagttgaagaaaattgactaaactgttaggaagtatttgagggcaaatggggataaaggaacggcctggaattttacttggcccgctctatttagaagcctccttagaactaaatgtggagaccgccagctattcccgtttcttctggctcaagtttatatatctactagtgtacgactcatttggctcggctagtattctc

SEQ ID NO: 621045 - DNA, 362 bp, Homo sapiens
ggggacctctccctaggtatctactgagcacgtgccagttggatggcaggggtttttaggattgcaaagtattggcatatacataatgagatatctgggggatgggactcaagtctaaacacaaaattggtgtttcatatatgcctttacacatagcctgaaggtgatttatacaatattttaaataattttgtgcacgcatcatgtgaggtcaggtgtgaaattttccacctgtggtgtcatgttggtgctcaaaaattctcagaattttccagttagggatgctgaatctgtacccttctcctttaaaaaggaccagggttccttggagaaatggcttaatctaggatacagtagggaga

SEQ ID NO: 621046 - DNA, 221 bp, Homo sapiens
tttgtagttttagtagagatggggtttcaccatgttggtcaggctggtctcaaactcccgacctgaggtgatccgcccaccttagcctaccaaagtgctgggattacaggcatgagccactgcgcctggcctattggttggaattatgttgtaaagaagtgcttttgtttctcccccatttgcttattatcactgtggatatttgggtttgcattttattc

SEQ ID NO: 621047 - DNA, 269 bp, Homo sapiens
gataggaaatcacagaagaactacaagtaatgggtgtgtgatttaggttgcttgctgagtcactctgaggctcggtcacttaagaaatgagataaaaatcgcaaccttaggagactgcagtgcagactaggagaagaccaggtcggaaagctctgggataggacctggacttagcagatacttcacaaaaactgccctggaccccgattgctcacactctaactgtccgaccttgacggaaaggacggcccagctgaggcctgcacgct

SEQ ID NO: 621048 - DNA, 427 bp, Homo sapiens
gaatggctcacacatatccgcctgcactacgcacaccccgagtaactcctgtttggtaccacctgtttcagttacatatgtacgcgtccgcgcacgtcatgattaaatctccttcttaccacagtcaccctaaagaaccaaagcctaggactcgggccccaaccacgaagcaagagcagggagaccagacactctgggctgagccgatgaccttaatgccccagccgacacccacattcacactttggctcctccagccaacttgatctttgcgactagaatttgtacagactcaaacaccacacagcagcacgtggccgccacacaccacactcctttctagtgagcgggccaagatacctctgtctcatgatcaaagtactccttcactcttacataaaaatctctcatctgctttgacctccca

SEQ ID NO: 621049 - DNA, 361 bp, Homo sapiens
aaggaccccctatggagaatccaaaagtattttccatggccgtgctctggaatgcagacttctatttccagaagtgacagacacaagtctgagttgctgtttggtctggctcccataaccatgcacacagattaaaccactgggaagttccaagaatgtacgtaatgtttgttcgagtctgcagagtatagatctgctcagaaaagcaccatgccgccagtctaatgctgtccatgggctgttgggcctgagagggaaaccaccctactggtcccctgtcatagatgttaacagatctgtgctgtaattgtgctgtcccagtaacatcgtgctctgcatctgccctgctgtaggaaggcca

SEQ ID NO: 621050 - DNA, 214 bp, Homo sapiens
tgctaatgggcatcttcaaatgcagtctgggcatgaacatccacatctggggcatcaatgttcacttttgggcctttgagttctccttccaacaattggtacagttacatcatacgtctcccttcaccctttgtacccttcacagttcaacatctacattcatgcattgtagatcttatggtgtcttgacgactcatatttaagacagcgttaa

SEQ ID NO: 621051 - DNA, 479 bp, Homo sapiens
  misc_feature (23)..(23): n is a, c, g, or t
ccgaaaagcttttgaggggctgncttcaatccctgtaggaaagtaaaatggaaggaaattgggggcctttctaggccctttccaaccaatgtccataaaaaagggtttaggttcttttttttttccggaaaccctttggaaattccaacccattggccccctttgtattaatgtgttaagcgccggagcccttggttttttgggcccccccctaaaatgctttcccatctgccccttaactgccttaaggggccttaaccctttgagagccacctatttttttttaaggcccccatcccaccccccgggtttttgatttaagggccttaaagcttctatgggtgcccctggaaaaataattttttaaaaaggttttccaaatgggggttttctttttatggggggaaaattgttccttttgtatatattgagataattttttttatatcctttaaataaaggggcctggggattgttta

SEQ ID NO: 621052 - DNA, 85 bp, Homo sapiens
  misc_feature (52)..(52): n is a, c, g, or t
gttgccttacattcattatccctccctgggtaataaacatttatttttcccnttgtaaccactcctccccttctgtcgtcttctc

SEQ ID NO: 621053 - DNA, 243 bp, Homo sapiens
  misc_feature (53)..(53): n is a, c, g, or t
  misc_feature (62)..(62): n is a, c, g, or t
cccgagggggaaaaagggtccttgttaagtaacagcccccccccttaatcggngaacatccnaacacaaagtatttgttttgtggagggacaagatggaatcaaggcagggccaggctgaccacaaggacagccaacaagcacctgcctcaggactgcgacgaaaccggtggggctggttttgtaattgtgtgtgatgtgaagccaattcagacaggcaaataaaagtgaccttttaccctga

SEQ ID NO: 621054 - DNA, 727 bp, Homo sapiens
  misc_feature (315)..(315): n is a, c, g, or t
gcccatctcagcctcctgagcctgtgggtcccgcgacttcagcaccctttatgctggtgaggaatgcgtctggtgcacagaagacagatgggaagcccgtgacctttggcatgaactggggcgtggggtgcagcagaggcaagagaacctagcattcctctcttccatgtcaccatgatggcctctattggagaaggccagttgagccaggcacacccatataggtataagactctcactttcactgagcgtctcttaggaggcagcgcacataaaatggggacaggcatgcacccattggactggcatcagggnacatccagcgtcccatagaactggcatttcccgtacacttcttccacatgaactgcagcccaggcttccggggggcccattggcgacaaggccagaagcgtggcgtggaggacaggtgactacggcccaaagggtcccactccacattcccaggcagcccagagcttaattagccactcccccgtcaagctcacgcattgtgaagcacctactaatgtgctgggtgcctcccagacttgctggggctcacggggcctccaagccatttaatcaccatgggaaactgttgtgggcgctgcttccaggataaggagactgaggcttagagagaggaggcagtcccctccacagcagtggcctcgagggtattagcaaggctgggtaatgtgaaggcccaagagcagagtctgcg

SEQ ID NO: 621055 - DNA, 1333 bp, Homo sapiens
gctgatcagtaccatggcggttggcaaggaactaggcgccttactgaaatggcgtgcaaaaaatgggacgccaagaagaaagtggttgatccgattgttctaaagaaagatcggtatgatgtgaaagcaacctgcgtatgttcgaaattataagaaatattggaaagacggcatcgttctacctaaggacgccaaggaaccgaagacagttgccactctcgagtggtctctaacggtgtcgtcgtcgctcttcgacatggtgcaggtcttgcctgcatctttgcagcaatgcatcgagagttgcatttacgaacaattcaacgcttgatttactgaacgatgttcacgggatacaatgactggtccttgtacctataactttgccactgtgccattgggactcttagctccggtgaatacataaattggtcgtgtgccagtgggtcccaatacaacatcgcgcccagaacgaagtgaattcgacacgcgtcagcagtcttgaatggtcaatgacataccgggagtgggtgtaatctatgctttcccgtgcgttgttacttagtaggtgtgggtgttttacttagagaaacaaccaggcaaagcgagatactacgtacttatcgggaataggacccgtcctttagttgcatcacgtcactccaagcagggttctcgtccgaagagtcgcgtggaaagcacacgactgcatggggaacatccaagtgacccgcagctagggtgacagctatcaaactgcagcttgtgaatggaaagctgggtccaaataaaattcggagttccccagagccagatcgattgcgcagaacaggaaccactgaggaaataaagggtctttgcccgcaaatacctaagttgggtatgcctttcttcccactggagtggtccttacgttgtaagcgaaaaagcttgagaaattctggcctagaaacgaagatgcccccacaccgatttgcgcacagttgtgcggagaagaagcgtgcatgtgcaaggcctttcgatgggtgggaaagtggcacagattaaggcttctgggggaacacaccagccccacctggcggcggcgactctatggaacagggtggcttaaaaggttttggaaacggaggtcgctggatggggatatttgatagcgcaccccaggtgccgagaaagccgttgcttctaaacaggttttccactggccttgcaaacactccgtggccaaagttagaacgaggtggctagctcggtaaatacccatccaaaggacaggacaaataaccttggcggggacacataaaaggcggggcgggcacacacaggcggacgagaa

SEQ ID NO: 621056 - DNA, 284 bp, Homo sapiens
  misc_feature (255)..(255): n is a, c, g, or t
attcatttaaatgtccccagggaaaaacaagattgggttaccataggcttgctaaacctcttaatttttcaaatgaaaaaattatgaaggatatgcttacattaacaaatctagaagcagtaaaaaaggaaaagtgggaatctgaagagtttttgctttttgttatttttggtaactgctccatgctgagtggatcatttaattttgattatttctaaaagattaatccatttctttaaagttaatatgcaaagnaatatgttcaacatcactttatttttaga

SEQ ID NO: 621057 - DNA, 940 bp, Homo sapiens
  misc_feature (2)..(2): n is a, c, g, or t
anacgtcgctcggctcgctgtggctggcactataccaggtctcgaggcactagcatggtgtgcgcctgtctgtcaggagacacgctgtgacactgccctttggtatggccgtagtattgtgcccctccgctagccccgggggtccgccgggagttgtaggcgggcccaattttgggggtgcacacaccaaggggtccgcacatggcgcccaggtggccccgccccagaggggcatgtttggacacgcaatgttaggcccgtttttttggtgaacccatcccgaaaaggttttgcccccctgtgtccacatattggcgcgtgtgcagttcggcgtctcctcccccgtcgttgcgccgccttctttagcccctcgtccccaaccccctctgttaacaaactgtccccagagaacaaccatcgcaacgtcggcatacttcttcagcatattattacacccccttgtcccaaccactttaatcacaatcaccgcgggatggcctctccaattaagggtaacacctttctgcgtgatactccctttttttcaaaaataatcttttctcattcaggagaaccacgctaccaccacttgttatgtcaaaaagtgcgcaagtatcgcaaacatctctcgtggagatctattgcactccatcgtccccataacttctgctttaaatgccgactcattgcccaagagagcgtcatttaccaccgcggcaactgccacaccgattttatagttccatcgcgtcattcgttgacacccaaaacacatgtttttttttctgtacaattccttctataaacttctgctaaaccaccctctctcaattctgctttttcgccgcacatatccgcctcctccaaaacgcaccactcgcccaagtcgtataatttcgttcttcccaaaaaacaaattcccatttcccccaccaaaaca

SEQ ID NO: 621058 - DNA, 810 bp, Homo sapiens
  misc_feature (162)..(162): n is a, c, g, or t
  misc_feature (239)..(239): n is a, c, g, or t
  misc_feature (305)..(305): n is a, c, g, or t
  misc_feature (309)..(309): n is a, c, g, or t
  misc_feature (348)..(348): n is a, c, g, or t
  misc_feature (354)..(354): n is a, c, g, or t
  misc_feature (374)..(374): n is a, c, g, or t
  misc_feature (405)..(405): n is a, c, g, or t
  misc_feature (787)..(787): n is a, c, g, or t
ggtacgccgtccagaaaaagatcctgtgcccgtgttatttcatccagaagcagcctgctgtcgtcatacggtttcggaaagaacctggcgatggctttccgatatgagtctttcttttctaaagaggcatggtaacacaccccgatggccagcatcaacgancagaggacgggatctctctcggtgtgatttttgctgacgctggacttggagagaaaggcattcagctgcgctaagancatcgcgctgtgctcgtggaaccacctgaaaactttcacacagcgctccacgtccctgaggctganaaanctgcactcatcttctgttttcctcatgaaaccctgagangcgcanaggacttctgtgatcacgcnagtcccgttttcatctaggctgatggactcnaccagtctctggacaatctgctggatgtagagcttttcagcaacgtcactcagttgtccaaagtcccacaccagaggaatcaggctcgggggcagagcatggacccggtataccagctgcctcagaggaatggagcccagcctgtcggccgtctcctccatactaaccctgtagccaaaccagctgactccaaacggcagatcatctcctcagagtgcttccggtatggattgcaggcagctataatatgcaggccagagtcctcagccagaggctggccatccaccatatgatcacacaggacttctttgatacagcttatagcttccgttgtgttggcttcatcaaaaaacagatggtgtccaactgatgttggtccttnttggcgaaggccattcttcagcc

SEQ ID NO: 621059 - DNA, 534 bp, Homo sapiens
  misc_feature (23)..(23): n is a, c, g, or t
ggcacgagggagagaaagagagngagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccaaagcgcgctgcacgagcag

SEQ ID NO: 621060 - DNA, 84 bp, Homo sapiens
ttcttgtattttgtattgtatgttttcttcaacatgtaaccaatcattatcttgtcaatatagtcatcctatcgatcgacctca

SEQ ID NO: 621061 - DNA, 322 bp, Homo sapiens
  misc_feature (39)..(39): n is a, c, g, or t
  misc_feature (56)..(56): n is a, c, g, or t
  misc_feature (170)..(170): n is a, c, g, or t
  misc_feature (175)..(175): n is a, c, g, or t
  misc_feature (255)..(255): n is a, c, g, or t
  misc_feature (272)..(272): n is a, c, g, or t
  misc_feature (297)..(297): n is a, c, g, or t
acacagtggactgaaaggactggttgaaagtggccaatnctctgtcagcttaattnggcagatgaaaatttgtaacaactctgagcacatgctgggtgaagtcacacctcaagggaaaaataaacctgggcggaaggatgtgtgcgtggcttctggggtgggacccacangggangctctgggacaggggctggggttcaatgccacggccctgaaagaaataaattgggactgatctcaaaattccaaaattcnctgtacatctgttcacntgcttgtgtccaggtgtgacttgtnaactgtctactgtttgcattaaata

SEQ ID NO: 621062 - DNA, 1224 bp, Homo sapiens
gtccgaatgcaaaatgaattgtcacatattccatcacctttctaatcaacaaggaaaaataaacataacatatatgtatatgctatattttatcctatgttgacttagaaaggtgatggaatatgtgacaatgcaaaatgaattgataatcttcactgtatttctgcagtgcaaagtctgtctgtaatatgtccaagcaagaatgtatatcaatctctaccagtcaatgtgtgacttcatgaccagagctacattctgagcaaattctgtccattcaggctgactttcatacattgatgtgaaccactccatgcaacgtgtactatacacacaaccatacggctggtacgagccatacctgcacacccttggcgctagcatgcgcacaagtctgatcgccttctgcggacttacgagaaccatgataacacgacactggtcaactggtactctgaactacctgtacaggcacactacataaacaccaaattgagtaatcatggtgctaaatcttcaaacatacgcaacacgactaactaccatttcgtggcctaccaacatggtaaagcaccttgcgcattgtggcgcactacacataacggtgaaatacgggaaagtattattcaagcatacaccaataataacttcctaaaaatatgagaatactacatgatacacataactgcaggtccacaaccatgatacgactccggaaaaccactggaccctggccacaggtccggctaatacaaccaagacacaacctggcaacacaacggagaaagcacaaccacactagcacccgcaaccatcacaagcacacaaccacacccacaccgaccaaagagaaccaacaggagaaacacgaccaaaacaggcctgcaagcacaccacgcacccaccacaggtcacaaccaacatccagcactcagcgccacatggacaacaggaagaacagcccagaccaacaaaagcaaaccagcggaggggcaaaaaaaggagacagcgatggacaacagcccacaaaagacagagaaccacacgcagaatccccggacaaacaaggagccagagccacaaatagtgaggcgacagccaacgagcaaaacaacgacgagaaaaccaaaaggctacaaacaaaccacgggagcgcacaaacccccacagaccgaagaggaccgattgaagacgcccacaaagcacaaaaagaaaagccgagcagac

SEQ ID NO: 621063 - DNA, 899 bp, Homo sapiens
tgatgtaccagctagctcaggatgacatgatggcatccaagccatatatggacgtcccaaaatcctgtccagcccatcggccacaaaccccaaaagcgtgtgacagtaagctaaccttgatgctataactacgattcggggagaagtgatgtctttaaagacagattctacatgcgcacaaatcccttctcacccggcaagttgagctccaatcttcattattctgtattatctggccacaacttgccaaatgggcttgcaagctgcttacgacatttgccgcaccagcagcatgcaagttccggttatttcaaccagggaatacgtactgggctgtccagggcaccaggaatgtgcctcacacggatcacccgaaggcaatcttacagctcctttggctaaccctaagaacccgtgagagcatatcgaatgctgcacttggctgaggaacaaacacaggcacaaccatactttctctagtagctcaaccaatcacgaggaggtcatgaggaatatcaacgaactatggatcccaggtaatccccaacagctgcgcaggcatgaatacagccaggcactaggcacacccagatatgatgcagaaaggaccatgacacacatgagctgaaagcacatacccacacaaatgggaaagcacagaccaataccaacattaggaatcacataccaaccgacccagagcaactagggaccacacccagacaaggcaactacgacggaaccacactgaacggcaaaaacatgacccaatacatacaaagacggggaccaaacccatgagacagagaaccacagcaaagaaggcaccagacaaaaggaacaacaaccagggaaaaagacacccacgcagaaagaacaccaacacaaagaccacaaaa

SEQ ID NO: 621064 - DNA, 1362 bp, Homo sapiens
gctactgctgatgaacggcggtgtggctcacgcagggtccgtgcagaccaaggaactatgacatcggaacggctctggacagcatccagtattcagaaggcatcctcccggcgcggtgatgacccacgtgttgaccgcagcgcgtcttcgtgcgtgaccaccatccttcatgtctcatagcttgctgatggaagcttctgtgctagaagttgcagagtcgtcgtgatcccgaggccgcagtgtcctctggaccttctatcctagggagtcagtggagattcgggctgcaagtaagcacacttgtagggacactgacaaagagcaatagatgagcagtagagatgggacgggtcccgtgctaggtgttgtggattgtgcgagactggtgttccatggagtggcgccatggacgtcacgttgacagccaagggacctgtgggccgtgcggatgagcccaaagggctgcacatggcaggcggtcgccttcgcttggaacgcgctcggtacccctggcacggggggctatcggctttgagcgaaggcgcacaagtcgaccaactcaaggcgtatgacctcctcaagggggccatttgtcctaccatatttcctgcgtatgtctgctaggtctcacataatcgaacttcaatcacgggtttccgcgtggacccatttctgaggcgtcatgaacttggttttttaacttcgtcgtagtcgaagaaacaactgcgttagcagacttcctaggtactattgctgaacgaagttaacatacgctgacagggccctaagggggtcgtattggtgcgacagacaaaggggcaaagtggccttcgggagtgcacgagtggctcgacagcgtggtatagggttgggcaggctttcacctgggctgggcggcaacatggaaaggacaggggggccattcgaccggcacacggggggggccactttccccggacgaggagtcggtatagggggcacccatccgagccttggaaagggaagacgtttggtcccgatccccctggggatccttccattgttcaatcgccagcagtggcaaagatttactttcggttccacatttgttgcgcaaaaccccgaatatccgatggcatgccattttggcacacagaacgtaaaaggaatgtccttcattttgtgggtaacgaccccaacttccccttgggatatacacacatgtatagggttcatagaccacggatgaccgttaaagggcccacagacctgtgggccagtttccacaggccaccccgttggtagaggcgcaccgacaattggcgcgagaaggaaacaagcatatagtgcaaaggcgtgtagttaacactagcaggaacgccg

SEQ ID NO: 621065 - DNA, 120 bp, Homo sapiens
ctagtgaggcacgggtagataccagtgtggtcgggggactgcagtgtgtgcagggactccccaacagtagagggtctctctacgtcctctatgtgctactatgctaggggctaggtggtc

SEQ ID NO: 621066 - DNA, 373 bp, Homo sapiens
gaccttcgatgagacgctggcctcctgagagattcccgccatcgtttgagcactctcggccatgtcaaaaagagagcacaaaccatccagatcacggttagcagtcgaatctcctgccacggctcgactacgcaatgacgccgcccacgaactaccctgccataaagcccacaacgcttcatgacacgtagcaccagagcgcaagagatccgcagcacgttgcacccgctgagtcatcacggctagcggcgagacatgagcccgtaagcctggaggcactgagtacacttcgcatacggtgtcgagttctgccgtactggcatcctcagatcgactagcgtcgtcagttcgctcggacttcccagctgcgtga

SEQ ID NO: 621067 - DNA, 821 bp, Homo sapiens
agcggagtggctcaggtccccttctatggtggaaactatgttctctgtctgcgttcggcacagtaaatcctgctgctgtctcacgtcgtgtagggtccacactgcctgatatgagccgtaacaggtctgcagtgtcactcctgagccgagcgagagacacgagaaccccaggcgcaggaaggaaaagaacgccgaagcacgagtccgaatcactcgaggaaggaacaaaggctccagacgcgccacttacaaagagactgtaacactgcaccgagagggtaccggtggcttcagttcgttgaagtcagtgagaccaagaagcccagcaagtccggacacatcgggaacttagagcagtgcttgggacatggttatcagcgtcagatatttccttaaactagtcgtgaagtcgacttttaacaacttccagtcagtgtgagtgagggccctgaccgctagaatcaacgcccaaagagctgtggcgctacatgcggtgcggggacatggtggtgcgcatgcgatgcggggggtacgctgtgcgtgcaggtgcgcagtagcgcgacgcatggacactgctgaggctggtgagccccgaatgctggtatctcgacttgctagtcgtggcggtaaaggaccgcaggtgtcgtaatagagggccgctagtggcagagccctgtggcgactggctagtagcccattttggataccgttcctcgctgcggacagttggggcaagctgttgctagtctggtcgtgggtgacagcgaggcttccgggctcgcttggtggtgagcaggcccggtgtgccaacgggtggaaag

SEQ ID NO: 621068 - DNA, 270 bp, Homo sapiens
agaaccggatcatcatatgtggagacaagccgcggactagcccgttcagtagccaatttaagccatgatcctcgattgaagtaggtgtccgctattatgaccgtgaaaaaatcaaggatgattagcgctatttaatgaaacacggcgcgcggacaatcaagtaacgacgaccggacgtacaacatcagccgcagatatgcaatggacatgttacgatacataattgacgaacatgtaccgggctcaacgcctctgcaggggatcctctag

SEQ ID NO: 621069 - DNA, 894 bp, Homo sapiens
ggactcagagtgggagagttgggaggaaaaaaaaaggcagaaaaggtgaaagaaagagtgaagagatgagaagagaagtgagagtgagcctgctgagcccacccctgatgtgcctgctggactgaatgttgcctggaggggctgcgcaaatgccacgaaaatgcaaactttttgatgtttcttggtccagtggtgtgtgctgcccctggtgatgcctgtctgtgatgccctgtgatgccccaccatgtggtgtgctgcccatgtgtgcccccctgtggctcccctgtacatggtgcatgcccccgcctgtgcgaccctggctcttggtgcccccctgcggggccattgatgccctggctccctggcaatggctgatgcagctgcccacctgatccggggtggcatagaggcacatgtgccagcatggatgctctatgtgtgggcccaatgcgcttgaggattgccacaaaaactgacccctctggctgcatgtgatgccctggcaagctcgcccaaatgacggagggtgagagagagttcgagctatgagcaaaatagtcccataccgcgttcgaaagatcgggacttcacgagagggaaagcattggtgtaccccctgatggtcccccatgtgagcatatacctatattgtgcaacctctttctattggggcacagtttcaagacagtgagggcggaaacaacgatgtgattcaaaagaccaagatcaaaatgtcgtgttaaaggcggtggagttgagaccaacttcccagagggaggggcacttcatagaaaacgaaagtgccccaagtggatagcgcaagacatgctgggacagtgcattgcggaacgtctataataattctcgcaaaaccatcattataaacccccattg

SEQ ID NO: 621070 - DNA, 1418 bp, Homo sapiens
agcagccccaccgccgccgtcggcctagtataccatacacaccccgggaggagccgcagctagccgcagccggccccagatacaccatacaccggcaaccatagagcagcgaggccgagacccagcagcgcgcccgcccagtacgcccaccggacagcagtacgaaaccaacagcatgacggaccgcacgcacacaagagcgcggagacaccaataagagggagcacacgacacaaagacagagcacagaacaccacagagacgaaactacaaaaaacaaacacacaggaaacaaccgcccccccaaccgacagaccccacgacaacagaacacaaaggagacaaggaaaaccgtaccagaaggacactacgcacacaacgagcccaccccaccagcaagaacaacacaggaacaaaacaaacgacaacacaaccacagaaaccaaacacccaaagagccccaaggaacagacaagccaacaccacgagcaaagaacgaggaccagacaagaaccgaaccggaaaaacgacagccgacagagacagcgcgcaaaccacaaccggaggggaagcgatcaacataagccaacacacggacagacgaaacaagcaacggaacaagaccaaaaaaggagccaacaggcggacagaccgcacaaaagagagacaagacacaccgaacccaccccgcccccagcagacaaacccagagcgcgcaaaagaagcacacgacaaacgaaaagaccgcgacactgagcgaccccagaacaagcgcagcgaacaacacaaaacgagccaaggaacacaaaaacagaaaacgatgacaaaacacccagttcacaataaaacaccaaaggagaaaacaaagacaaaccaccaccaaaacaaaaagacggaagaagcacaaacacacacagggaccagaacaacagggagaaaacaagggagaagacaaacaacgaaagaacacaacaaacaaagaggaccaaacactaaaaacacaggagcaaaacgaaaacagccacgaaacacacaccgagacagcaaaagcgaccagcggaacaagaagacaacaccaagcccgaccacaaccagccagaccagggaaccaaaccaagagacgaaacagaggacgaagcaccccttaaaacaacgagccaaaacaacagaaaagagacaacgagcgagaagagaacaagcgacaaacagacaacaacaactcaaaacacgacacgaagcgccagaaaacagaaagcaacagtcaaaaaagaggccacgggcaagaggtacagccaaccagcaagaaccaaagagcaacatatcgaccacacaacgaacagcgaaacgaagagcacactaacaacccagcagcaggcgaaagacagaaacagagagagcgacaagaaacgagagcaacc

SEQ ID NO: 621071 - DNA, 1291 bp, Homo sapiens
atgcctgagtgtacggcaaactggcggactcgccaactacgaagaacgggcaaacagcagactacggcggcggcagagggtcccgcggacagatgctggatggccatggataccacgtagaccagaaggagtgaccacagagcccccctacacatgcatactgtagtgaaatctacctttcaatactgtgttcagtggctgacatagatgctatctttaatggatctcagcatacaggagtgtacgtgctagtcatgagacaaagacacagataaatttaaaggattctgctatgtagaattctgatgaatgtgtgattcccttaaggaagccttgacatactgatggtgcacttgttgggctgatctggtcacatctcgttgtgtgacatttgcagcacagtgcagaaaacaatgcataacagtgtggcttttggcattcatgaacaatggttggaccatgcactgacagatggcttacaggggcatgactatcattaagagagggtgcatgaggggacggtcaagtctgccacaaagagctgaaccctgggcggacaccaagtgccaccacaccacatagagagctatgcacatgcgtaaccagacaggcattgggcacacatgcccacatcactggtgggaatccccaaaccattgtggatatatccaaggaagcaaaccaccagacaaggcaacaggcagggcacacacgaaagccaacaaggaaggacacaacagagagcagtacacaaggacacatataaaaaaccgcccattcgtacaaaacaaaggatccggagcggacaccgaccccgcaccgtatcaaaacttaccaacagttatcaggcacccaaaagtacacctcaaaatccataacatgggccatcaaatacgtaatacggcagaggagagcaatagacaccagaggggaaccccattaatagaacaggcacacggcggggcaccacaaggataccgggcatcgcccaacacgcaccagtagagacaagccccaacacacggccacacgctggacacgcaccccactatgagtacgtagcgaacaatacgagcgcgcaacgcggggagtgtacaacaacttgcgggcactgcggcacggagtatgacgagagagagagagagtaatagacaatgaaaaggaccccagatgagtgcaaactcccgaaacgcaagagagccccaatgtctgatgtgtgactaacgtcagtactcaccccccgtgcgagacccaacaggacacgccggatagctaccgctaggtacgagat

SEQ ID NO: 621072 - DNA, 394 bp, Homo sapiens
tagagaaaattcacagcattttattcaagttaatcaatttcattcaataatctgccataatgggtcccagggcgcaggaaagggggtgaaggcccccgggggagggcagggaagaaggaaacggggttgaatttccacgatgcctaactctatggttaaaaatccttttccttaccaaaaaggaacttcttaatcaccagagaaacagagggaagactgagatatgtttgcagaaatttatctctactagagacaattcatagttcataatctttcagggttgtgctttacttgggggctccgttttcgggagcgggttgtttcccataaatgtttgcttaatacaaataatttgccccactgtacccacgaagggaaatgagggctagtgtcc

SEQ ID NO: 621073 - DNA, 834 bp, Homo sapiens
tgcggacggcgtctcccatcaactccccatgccatgaggtactccatctcccaccgagtggatgccctcaggtctgtggtgggacgggaccgcttcaccgctgcatatccttacacagttctgggggacacgctgatcagacggtcggggtagtcataactgggaaggtgcgtctacgaagccggaacagcaaggcgttcggcgtgggcgtgacctaccgcagcctgcggccgcattcagagcaacttgggcaagatcgagcgcgcatcctggtagccgtgcacagtaataacaatttgagttagcatgagtacatgacttcagacaggccaatgcaacgccaacagaggtcaaaggatgctagagactgcccaccgatgctcctgacttagccgtgtgattgtcgcgacatgatagagctttcacaacgcgaaatggtctcatcgcatgttcacattcttactagaattgacccggaaacccaaaatcgaagtgctagggactacatcttcgaagatcagtgttccacgacaagtccgcatgcatgcacattgcgtttcacgggttattggttggttgagacgaaggtgtagcgcaatggggattgaatcaggcatcaagaggcacataggcaatgtgattcgccctcaatggattgccattgattgcaggcctatgtcaccgttgcacaaacaacaagcacggacgtggcaagatgtttgcttacaccctcaagacaatgaccttcccaagaacaccaacaccgacaggaccctttgcaaactccgtaaagcggacgcgccctccaagggacaaaaccgacgaaaccctcaa

SEQ ID NO: 621074 - DNA, 383 bp, Homo sapiens
  misc_feature (296)..(296): n is a, c, g, or t
tcaaaggatgtgagttcaagtcttggctcttcaaattctatcaggctcgctctcaagttcttttgtgcggtgaagtcaagaatccgtacctgctcaccagcaacaaaaccacagtgaaggagcagaatgcctgtctgactcaccctgacagatcagctatggcaggtctgctgttgtagaaaattcttcaccccagaggctttatctctcctgcagggaaggctcatgagcaaatgctgtcattagcattccttgctttgtagaacccttttgattgtttttttttcttcttctcncttcctcctttgtaccaatgttagtagaaaatcctgaagaattttcgagatattaactgtagattataacaacctttaacctaaata

SEQ ID NO: 621075 - DNA, 322 bp, Homo sapiens
cacagggatggtgcccaggcaggcactcggccaatcccgcatctcagccctctcagtgagcagtcttccatcatgctgaattaagtctggccaggagctgcccctcatggggcggggccgcaggggccatgcctctgttactctaacagacagactagacaaacaggcttgtgtcgctagtcacatcaggtgtgtacgaggaagccaggaatacaggttttcttgatgatttgggttttaattttgtttttattgcacctgacaaaatacagttatctgatggtccctcaattatgttattttaataaaataaattaaattt

SEQ ID NO: 621076 - DNA, 451 bp, Homo sapiens
  misc_feature (435)..(435): n is a, c, g, or t
tcatcccaaaggcacatgaggtggtggctgagggaggaatctcaggggagcaaaattagctgaaggccacagagaatagagacgtgggccaggggaaaaacaggaaaaggacagcgagtatggacatggccctctgggagcgtcctccgtgggctcccgcgtctccttcagagattgggattgggacacagcaatgtccagatagattccgggccagtccctgccaaacccagggcaatgcctcccatagatgggccatgcccacagagtccatctttctacagggccttgtaaatagagccgtcaagtcccttgggctgggttgcctgggggctctgtcttgagcacccggcggaacgtacttaaagggccttctcgaattcctggagcggaattcccccaggggccaggtgtaaaaaaggtaatcccgttgtncctctttgcccccttg

SEQ ID NO: 621077 - DNA, 140 bp, Homo sapiens
ctgatactacagagtgatactttgaaaagtatagccattaggcactcactgcaatgagatgacatctttctaggccaccaaattggagcggtaggtaaagctaagaaaatatcctttgacgaacatatagcattacctac

SEQ ID NO: 621078 - DNA, 133 bp, Homo sapiens
atgtctgaagacaatgccactgaggaggagatcctgatttacttggagaagacctgtgactggctttccgaaaccgaacatgtctgcgttcatgcaaggtagatagtggactctctacctcccttgatcatcc

SEQ ID NO: 621079 - DNA, 214 bp, Homo sapiens
  misc_feature (9)..(9): n is a, c, g, or t
  misc_feature (11)..(11): n is a, c, g, or t
  misc_feature (14)..(15): n is a, c, g, or t
  misc_feature (32)..(33): n is a, c, g, or t
  misc_feature (40)..(40): n is a, c, g, or t
  misc_feature (48)..(48): n is a, c, g, or t
  misc_feature (70)..(70): n is a, c, g, or t
  misc_feature (79)..(80): n is a, c, g, or t
  misc_feature (87)..(87): n is a, c, g, or t
  misc_feature (109)..(109): n is a, c, g, or t
  misc_feature (126)..(127): n is a, c, g, or t
  misc_feature (129)..(129): n is a, c, g, or t
  misc_feature (134)..(135): n is a, c, g, or t
  misc_feature (152)..(152): n is a, c, g, or t
  misc_feature (171)..(172): n is a, c, g, or t
  misc_feature (203)..(203): n is a, c, g, or t
  misc_feature (207)..(207): n is a, c, g, or t
ctgggttgngnttnnaagctcttctgagcccnnttttccnattttctnaatttttctcaaggggttttgnctgcagatnntgttcanatgaaccggtgacatcactctntaggattctttggcagnncnctgannttggctcaacgtttgtngaggtggttatttccctgnngtactgagctttgttttataataattaaaancccnatttggt

SEQ ID NO: 621080 - DNA, 917 bp, Homo sapiens
gccgccgccgccgcttggagctgaatgtgcctgccgcctgcgggcagccactggggaatcctgcccgcatcgccgccctcgccggccgggcggccgtggggcccagatgcgccggagtgccacgggctggggctggcaccgtcgcaagcggtccacagggatgatccctgttagatgcatgctgccctggctggctatgccgagagcccaggatctgtgcctggaggacgcagatgtggtgcctggctgggatggtgagcgaaggtagacctttctgcgagtacgagccaatccgggccaagaccacgtagcctagaacttgacgtgcgcacagggacatccttgacaatgggcttgaaggagaattgaattggccctggttggaaccagttctgcaagcccagtgacgcaaaccaaaaacaaagcccagcctttaagcaggagacccttatttgaaccgtcgcgtagtatgcgagcacatgaaaacgaccgcgactaactcggggccccacaacaaccggtccattcacaatgggcaaaagtgcctgagacttatcccgagcaggcccattcttggcgagcttaaccagttcaaatgaattgccaaaaccggccgacaaaaaagagatgaaaacctccctgaatacacaagctagaattaggacatcaagcctttgggaaaaatgctttgagaacaagagggaggcaattggacccaaccctcccgtgggtgacgccctcacttgcgggcaccacggaccctgaccgtaactctaccgacctcgtgaaagggtgcctatttctttggctccaatcccccacctggcgccaccaagggtcccgatcggggcacggccccatgtggctttacctggcgcccaaacgcggaaggacggcacgttagctcccaccctctc

SEQ ID NO: 621081 - DNA, 1176 bp, Homo sapiens
tctcatttaactttttaaagggggtctcaaaatcctgtgacaaatttgtgggctcaagttgtggttcccattaaaaaagttccgtgatttaaaaaactaataacttaaaacgtgccaacacgcaaaaaagaaaaaccaagaggggctccacaaaacattctcctttccttcgtaaggggtttaacgagtgccattgtgttactcattacccagttctttaaccctacataaacttaaagtggccaattggaaaccaaacagtctcgtgaaacgcgttcttccaccacgtgatttaaagagggggcgggggcagggtattaaggggattaaatattccatttaacgcctttcttgaggcttctcgggggcaaacttggggggaccttttgccaagcctcacagcacgcctttcttgggcccaggtgctttggaaggaacacccccacgcggaaagcgtggtcggggtcctcatatatccacgaaaaccgagcaaaaggcgaaccccaagagggcgcgaaatagctcgggagaaaagttccacaaaaacacacaggggagtcctgtgccgagggaaaccctattatacgacaccaaggggggcgagatattacacgccagaaaactctccaaggaatatttagagggcccatctcttacacagccttttttacccccaagacagcgggggatacaatattctgttgccccttacagcctacgagaaaaaacctggccagtgccaggtgtggaccgccggtgggtgggcaaatcccacaataacaaggcgggcataaagcccggggcgcataatataggggccccgaaaaaggggtcccacgggaaaaaacccccccgtgagccagctgcaacccccacgccgccacacaagggggggggggagccacaaatagtggggcggtggctaccccacagcaaaacgctctgtccacgcgacagaaacacttcctttgtacacaacaaccatttctcgtacagttgaagagcccccacagtgtgtcccccgagagaggaggcttcctacaaagacacccgggggggcgacatcagagcgaatatacatccccgggagaacacatccggcggccacagaggcggcccccaaccggggcgggcaaaaccgacaccgacgcggcaggaaaagaacaaaccacctcg

SEQ ID NO: 621082 - DNA, 286 bp, Homo sapiens
  misc_feature (63)..(63): n is a, c, g, or t
cggccgcatccctatttattgtgctcatagattctgtggatcaggaatgcgggtgggacacantggggatggctggggcgggctccacagtgtctggggcctgagacaaaagactctaggctgaggctggattcatctgaagactcactctccgtgtctggcagtcgatgctggctatcggcttggagcctccgttcctttccacatgcgcctctccatggggggggggtggacaagatgggggggctttctcacagcaagggggctacgttctgaggctggacat

SEQ ID NO: 621083 - DNA, 319 bp, Homo sapiens
caaaggaaactgtggcctgttttgtttatgttttttttttttattcaaaaaaaaagaccaaggaatacccttttgtggttcctaaaaaaactgccttttttcccccctatacataaagggaaagttttatttttttatggaacccttcaccgggactcatgtattaaaataggaatgggaatgctaaaaactctttttatatcaaaagttccaagccctttttttttttttatgcattgtttgttttttacataaataaaatgttttttagattgaataaagcaaaaaactcaggtgagcatcctccctcctgttccca

SEQ ID NO: 621084 - DNA, 736 bp, Homo sapiens
  misc_feature (1)..(1): n is a, c, g, or t
  misc_feature (64)..(64): n is a, c, g, or t
  misc_feature (75)..(75): n is a, c, g, or t
  misc_feature (85)..(85): n is a, c, g, or t
  misc_feature (104)..(104): n is a, c, g, or t
  misc_feature (126)..(126): n is a, c, g, or t
  misc_feature (154)..(154): n is a, c, g, or t
  misc_feature (211)..(211): n is a, c, g, or t
  misc_feature (250)..(250): n is a, c, g, or t
  misc_feature (273)..(273): n is a, c, g, or t
  misc_feature (305)..(305): n is a, c, g, or t
  misc_feature (365)..(365): n is a, c, g, or t
  misc_feature (391)..(391): n is a, c, g, or t
  misc_feature (476)..(476): n is a, c, g, or t
  misc_feature (512)..(512): n is a, c, g, or t
  misc_feature (515)..(515): n is a, c, g, or t
  misc_feature (536)..(536): n is a, c, g, or t
  misc_feature (539)..(539): n is a, c, g, or t
  misc_feature (557)..(557): n is a, c, g, or t
  misc_feature (565)..(565): n is a, c, g, or t
  misc_feature (710)..(710): n is a, c, g, or t
ntaggaatactaggataaataagtaatattttctcttacagaaaattgtaatgataccattgantacaattaaanactctgagantttcacagaaacatcaganttttaatagacagtagccagcntccttgtggccagtgtgagtgacttctnacagctgaaaacaccctgggccagatttcttaaaacagctacatgacaaaaacaatnctattgacatccaataatgctaaagcctgggtaccacanaggctcaaatgactgtggtttanaaacatctctccactgactgtggttttcaacnacaagagaaagagaaaatagagaatattatttggctcttccagcctagacaaaaataatnacctaagacattgagtgagagagtcntaaccctttggaagttgaactttctgctttcttcctgtgactttggaactgagtttagcaacagaggacctgccatcatactgcncatggattttgtgttaaagctgggagaattctgtcntcntcttgataacaagctcttctnganacctgaatatcttgaaanactgaacntggtgaaagcaccgccacacaaaactcttagaaaccagatctgagaaaaagcatataaaagtcacatcagtgttgtgtgacaaaaaaatcggaagagtacaattgcatagattttcttgcacacacaatttctggacataacagnatatttgctagaaagcacaaccctgg

SEQ ID NO: 621085 - DNA, 415 bp, Homo sapiens
caaatgcttcattaaatagacaaaaaaattaaatcgtgtacactaactttttgggatttggtggtattagttggaaaagaccactagtctaagtcagttgtattgtggaaacttgttaaataaagctgtgtatcctgtgccataatgtagatctgatctgttgctactgtgagatgggttttaatcgctgccgtggtaaggagtcaaaccttcagtggcttctctgaggttataaagtcatactccagggcttttggaaaatgtacagattaaagaaacattaattcatgtctggttttctcagtttttaaatttgcccaactgatattcagctccatttgcgtggaatgagaaataatgtcatggttaaacccccttgtttacagacagatcaaataaacttattccaatcaga

SEQ ID NO: 621086 - DNA, 223 bp, Homo sapiens
  misc_feature (135)..(135): n is a, c, g, or t
  misc_feature (181)..(181): n is a, c, g, or t
  misc_feature (186)..(186): n is a, c, g, or t
caagttacccgtaatactttcaccattggacgtcatggtcgttggcggcagcacgccgccatttaccgaagtatgtacgccgactcattattgctatgactatgaccccggatgatactattatacctaggtgcnggatacggtatccagaatcaggattacccagaagaacttgagcaanagccngcaaagcacggaccgtaaagggccgttcttgcttttt

SEQ ID NO: 621087 - DNA, 299 bp, Homo sapiens
gtcaggctggggagaggcccacgttgataactgtaagtgaacaattgttgtatgaagcacttgtttcgatactgctgatcataaacaaccctgtgtgtaatatgttttcccaaaaatcgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 621088 - DNA, 524 bp, Homo sapiens
  misc_feature (184)..(184): n is a, c, g, or t
cccacgcgtccgcgtaaccacaggcacatcggaggagcatttttgaaacgctttccagcttcctcaataggaatggaagccaaactccgaattgatgactgctttgtggaagtcaagagctgtacagaaagccaggaacaggggcaagggagagatgcgccccgaatgatcctgtgccaattcnttctggaatcctcgatgtgatctcagctgtcctttccatacttgacacagtgattgtggcacccactggtctagctgtgttctacaaggaaccccgaaagggaagggcatagtgagcaggggcatccgcctgagtgacgaggatttgagagggcaggttggttgcagggagaggactggccaaatgccatgtgtctggacttagactgactggttcaaattggacttcaccctttttgacctcatgatctagtacgagttctatgaaaaggcgttgctccttttctagtctgtaaaatcatcctgaaatgtgcactaataaagtggagactacgcagaac

SEQ ID NO: 621089 - DNA, 4257 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaa

SEQ ID NO: 621090 - DNA, 199 bp, Homo sapiens
cactggcaggtgcctgtagtactctgtatgctgtctgctgaggccaactgccatcatctacaccattgaaagctgcagaaccgttgaggtgctgacgcaggaggcttaaagaagggactggtggtagcactgcttgcctcgtacgtgagaggaatgtcttgctgcctagaccaaggctggggtgacttgatgggagatg

SEQ ID NO: 621091 - DNA, 174 bp, Homo sapiens
aacccctggctctattgcacggatacatcacctgtgtgttatcactgccttcatagccccgtggcatgcatgatagaaaacacattgctttcccgggtatcaaatgacttctggaggcatgcacctccctgctgcctctcttcggaatcagtagctctgggggcgggcagaggg

SEQ ID NO: 621092 - DNA, 9356 bp, Homo sapiens
  misc_feature (75)..(75): n is a, c, g, or t
atgtaacactgtgagagtagtggagactgagctgtgtagctccgtctcttctgttgaaactcttcaggatggatntagtgcgtgttagggctcagggaggacaggttgagggttaagcatcccaagcatatgtttatttctggctgagtatttacagggcttaaagcctatgcattttgtctttccgcctaggacaacaaaagtaaaaccagcatgggttttggctctcactgttgtttttgccctctgtaaggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621093 - DNA, 9616 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatctgcaacaaacggctgcactcagcgtccccaggggcctggaccagcccgggcaggacccccaggccgggcattgccaccccaatcatccttgagggggcgctgtcctctgcatggaggcgcatccacagcagctctggcctccactcgcgagatgccaagagcatccctcctggcagcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctccctcagggcctcgtcctgcccagggtggcttgtggctcctactactccgggccacggcctcagctgcctcttctcccagg

SEQ ID NO: 621094 - DNA, 428 bp, Homo sapiens
tcaccatcgagggagtgatgaaccacccatagctcaattccaacgaggccctggataatgtgctgccttctgctcagatgaatgatggacaaaggcagtggttgcaagaatccagcaggtcacacagaacaattggccaacatgagaatacaggatctgaaagtaagcctcaaacccctgcactcagtgaacaacaccattactacggaagaggaaattacattgggtcgtggattcacagataaagtagatcgactaaaactggcagaaattgtgaaacaggtgatagaagagcaaaacacgtcccacgaatacacaataatgacagcttcaaactatgtttttttaacaatttgaaaaattattctataatgtataaagtaaatttatattaatttattaatccttaattcaattccaaaaaaaaa

SEQ ID NO: 621095 - DNA, 9763 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggtgagcttcattctctcccctgcgctcacatctgctcttaaaactgatgtatgcggcagcaacctagagtgtgtgttttccttctctcttcccctgctgacttgtggaccaacacaggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621096 - DNA, 180 bp, Homo sapiens
cgcaaggagcccctggagagaggttaacgccaagtctgccccacggaagtgtctctggctggttgtgttttcaggtagtgagctggtgcctgggactccatctttgtctggggtaccgcacttgtatgtccgtcacatgccttaagatcactggggagcactgaaagaggctggtggctt

SEQ ID NO: 621097 - DNA, 9679 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgaacgaagtcacaaggcttcccgggcccccttccaaggcctaaccagggggcccaaaccaagggcatgggccaaggcctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621098 - DNA, 9028 bp, Homo sapiens
ggcttaatgctgatcttcacccagggtgcaggtgggcttaatgctgatcttcaccaaaacatcttctgtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621099 - DNA, 858 bp, Homo sapiens
  misc_feature (40)..(40): n is a, c, g, or t
  misc_feature (104)..(104): n is a, c, g, or t
  misc_feature (172)..(172): n is a, c, g, or t
  misc_feature (202)..(202): n is a, c, g, or t
  misc_feature (251)..(252): n is a, c, g, or t
  misc_feature (286)..(287): n is a, c, g, or t
  misc_feature (323)..(323): n is a, c, g, or t
  misc_feature (331)..(331): n is a, c, g, or t
  misc_feature (339)..(339): n is a, c, g, or t
  misc_feature (412)..(412): n is a, c, g, or t
  misc_feature (416)..(416): n is a, c, g, or t
  misc_feature (419)..(419): n is a, c, g, or t
  misc_feature (441)..(441): n is a, c, g, or t
  misc_feature (549)..(550): n is a, c, g, or t
  misc_feature (561)..(561): n is a, c, g, or t
  misc_feature (564)..(565): n is a, c, g, or t
  misc_feature (567)..(567): n is a, c, g, or t
  misc_feature (571)..(571): n is a, c, g, or t
  misc_feature (579)..(579): n is a, c, g, or t
  misc_feature (587)..(590): n is a, c, g, or t
  misc_feature (600)..(600): n is a, c, g, or t
  misc_feature (604)..(605): n is a, c, g, or t
  misc_feature (627)..(627): n is a, c, g, or t
  misc_feature (632)..(632): n is a, c, g, or t
  misc_feature (636)..(636): n is a, c, g, or t
  misc_feature (640)..(640): n is a, c, g, or t
  misc_feature (643)..(643): n is a, c, g, or t
  misc_feature (657)..(657): n is a, c, g, or t
  misc_feature (661)..(661): n is a, c, g, or t
  misc_feature (678)..(678): n is a, c, g, or t
  misc_feature (690)..(690): n is a, c, g, or t
  misc_feature (692)..(692): n is a, c, g, or t
  misc_feature (703)..(703): n is a, c, g, or t
  misc_feature (706)..(706): n is a, c, g, or t
  misc_feature (710)..(710): n is a, c, g, or t
  misc_feature (723)..(723): n is a, c, g, or t
  misc_feature (732)..(732): n is a, c, g, or t
  misc_feature (739)..(739): n is a, c, g, or t
  misc_feature (765)..(765): n is a, c, g, or t
  misc_feature (848)..(848): n is a, c, g, or t
acctacaaattggaatttcatcttgtttccatgctgagtngtgacccctgacaaagctaatcataataccctacatcaaaagagaactaagctaacactgctcnctttctttttaacaggcaaaatataaatatatgccctctagaatgcccaatggtttagtccctaaaanattcaaatgggatcttgaagaatgtatgcnaatccagggtgcagtgaagatgagctgagatgctgtgcaactgtttaanngttcctggcactgcatctcttggccactagctgnntcttgacatggaaggttttagctaatgccaagtggngatgcagnaaatgctnagttgacttaggggctgtgcacaggaactaaaaggcaggaaagtactaaatattgctgggagcatccaccccnggcnggnctttaccttccaggagctcccnactggcaccacccccagtgctcacatggctgcctttatcctccgtgttccatttggcacagcaagtggcagtgtctccaccacctatgatggtgatgcagcccctagnngtggctttcancanntnatcnatgagagntttggttnnnngggcaaaagnttcnnattcaaatacccccacaggacnattcnacanaatntgnttagcccgagtganagcntcagcatacttcttgcngctttcaggacnanagtcaaagcanatnaagnaagcaggtatgcnagaagcaanagtggcntggcaagtcttggcattctcatcaancttgtcagcagtggcaaagtcaacaggcaaggtaatcttcacaccattcttctcagctttggacattaggtctttgacaatcntggctccctc

SEQ ID NO: 621100 - DNA, 9801 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatatgagcagggatcctcttttcccctaggactgactctggcactatgatgagcagctggattctgtagcgcccaacaaacaactctccctgaccaaacgagagctgctggggtggtggctagcagttccaaggtgaacaatgcctcgttacaaaagatgccaatcgtcccggcgcagctggcagggctgggcggctctgctcgcggccgctcgtgccgaattcgctgggcgcgaga

SEQ ID NO: 621101 - DNA, 4755 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaaaaaaaaaaaacaaaaaaaaaaaaaaaaaaaaaaacaaaaaacacaaagaaacaaaagcaaaaaacaaaacaaacaaaaccagaaaaaacaagcacaacccctaccgaggacaacacaagaaacaacaacaaaggcagaggggcgcggggcagaaggacatccagcaagcccgtgcggggaggcacggagaactcccagcaccagcccaccacacgcaaaaacaaaagaggcaaaaacacaagagagagaggggacaaaatacaaaacaagaaaagcgaagcgggcgcaatcggaccacagcacgaccaaccggcgaggagagcacaaagaaaaaagaaaacaaacagaaaacaaacagactgacgagaagcaaggaaccacacaaccgacggagggagggggcagaagcagaaaagagacagaaaaccacaaaacaaagaa

SEQ ID NO: 621102 - DNA, 8165 bp, Homo sapiens
cgtaatcggggatgcagctattcgtgtgctgctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621103 - DNA, 8193 bp, Homo sapiens
ccagacaaatcgctccaccaactaagaacggccatgcagcacatctcgtacctgaactgctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621104 - DNA, 290 bp, Homo sapiens
  misc_feature (225)..(225): n is a, c, g, or t
  misc_feature (277)..(277): n is a, c, g, or t
aaggcttggaaaaggggtgggaggacttcaagcgagatgtgtgtgatgatttgagtgactggggattgaggtactgggggctgaggcactaggcccacactcacgagtattgactgctgtcactcttcctgatatctgggaggccgcagatttctggaagcaggattcggattgatgcaaactaaacagcgatgaagtttaccctagctggcgtggggacccgangttcgggcagtcagacgcgggcaaggcttgagcgtgttcagtgcccccttgnactggctggcctg

SEQ ID NO: 621105 - DNA, 701 bp, Homo sapiens
  misc_feature (153)..(154): n is a, c, g, or t
  misc_feature (248)..(248): n is a, c, g, or t
  misc_feature (316)..(317): n is a, c, g, or t
  misc_feature (340)..(341): n is a, c, g, or t
  misc_feature (417)..(418): n is a, c, g, or t
  misc_feature (420)..(420): n is a, c, g, or t
  misc_feature (448)..(448): n is a, c, g, or t
  misc_feature (450)..(450): n is a, c, g, or t
  misc_feature (523)..(523): n is a, c, g, or t
  misc_feature (542)..(542): n is a, c, g, or t
  misc_feature (571)..(571): n is a, c, g, or t
  misc_feature (573)..(573): n is a, c, g, or t
  misc_feature (618)..(618): n is a, c, g, or t
ccccgtggaacaccgtggccccgagctcgtgtcccgcgcccgaggatcctccacggggctagatggctgcgtctgtgggtgctgggacgctggagtgtgagctgggcgctagtggcctgcgagcccccgccggcccttcctccagcgccctgnnggaccccgcagaaggctgctctgcctccctagccctgcaaaaacatatctgatttttctcgctgtgtgcaacggggacgtcctgatagatcctntgctccaataggcaactccgtgccttccctgccctgacctggaacctctgggagggctgcagagtaanntgcctgcctctgcgctcctgacnngatggcactgagtgcctgtggagtagtgtccctctgttcctgacagtgtgcgacacttggctgctccatgcttgcnngntgccgggaggcctggcctcccccagggncngcacctctgctggttgctctgtgctttcaccttaaagctctgccaagcagaggctcccgtgcaggaagagaanctgtcagcaaacacctcanatttgccatgctggctggtggaagagtangnggtagcagaagagtgctctccatgctctaatttccgggctaaaantacccctgagtgtggtccccccaggatatgtcgagaaaatcacttgcagcctcatctagagcaaattgagtccaacagctgcg

SEQ ID NO: 621106 - DNA, 83 bp, Homo sapiens
gcatctttcttcttctcttcttcttcttttttcctcttcccgcaaacgtttcttttctaactctccccttctgtcgtcttctc

SEQ ID NO: 621107 - DNA, 745 bp, Homo sapiens
ggaactcggtggtggccactgcgcagaccagacttcgctcgtactcgtgcgccctcgctttcgttttttcctccgcaaaccagtgttctgacaaaacccgataatggctgagcatcgacgaaattcgactaacgtcgtaaaactgaacgtaaagaccagagacgcaaagagaaaaatccactgccttccaaagagaaacgattgaacaggagaagcaagcaggcgaaatcgtaatgaggcgtgcgccgcacaatattgcactggtacatttcccaccaaaggcattgccttttccttatttttactttactatattaggcgtggtcgttaaacgttctgttcacgactggcccaaaccgacgggtgggggaacttccgaggctttgttaacatttgacctttggtggtcctggcgccccccttttttcaccactttcacgcgaggaaacatacccatggaaccacaagccggaaaggcgacccgggccgacccacgtggaccacttattatccccacaggtacagtgggtaccttaactcccctttcaatattccctttggtagccatttggggacccaatcggtggtgcaaataggtaggactgaacgggacactcccctttttgcgatattgtatctggggattggcacgtgggcgaaagagaaactggttgtagtgtgatgggacaaatgcaaagactggaagggtaggggaccaggcaccaggtggcacaatgttatagca

SEQ ID NO: 621108 - DNA, 303 bp, Homo sapiens
cagcagaggtgacttggtggaaaaagctggaagattggcgcacctgtctgactacaacattcagaaagagtcaccctgcacctgtgttccgtctcaaagtgggatgcaaatcttcgtgaagacactcactgtaagaacatcaccctttaggtcgagcccagtgacaccatcgagaacgtcaaagcgaagatcccggacaaggaaggcattcctcctgaacagcagaggttgatctttgccggaaaacagctggaaaatgggcgcaccctgtctgactacaacatccagaaagagtctaccctg

SEQ ID NO: 621109 - DNA, 360 bp, Homo sapiens
  misc_feature (7)..(7): n is a, c, g, or t
  misc_feature (127)..(127): n is a, c, g, or t
  misc_feature (129)..(129): n is a, c, g, or t
  misc_feature (153)..(153): n is a, c, g, or t
  misc_feature (157)..(157): n is a, c, g, or t
  misc_feature (176)..(176): n is a, c, g, or t
  misc_feature (237)..(237): n is a, c, g, or t
  misc_feature (309)..(309): n is a, c, g, or t
  misc_feature (327)..(327): n is a, c, g, or t
  misc_feature (345)..(345): n is a, c, g, or t
ggcatcncattgtcctggggacagcaaccggccggtgctcctggaacccacagatctcgccgtgttcctgatggaatggcctttgggaggctcagttttggcaccagctgagtgacaatgctgtggntntggggtcctctggatgcagcgganccantgaatcagcacttaatctntggcttttcccaaagccggggctcactggtccaggcgtggaggagtggaaaccccaacttnttcccattgtcgttaatccccagtgagccacaagtgaaagttttgccccctgcagtgttgcacgctgtgggnctagaggcctcagattcncaggggaccaactcatcncagtttgcttaagac

SEQ ID NO: 621110 - DNA, 222 bp, Homo sapiens
ggaccaagcggactccagctctatgcaataacatactattccgtggagcgctctgtggacagatgcttgacatcccaacaccttgcgaggtctaccgccctggagcactaccgatcctccactatgcccaagatgtgaatctggataaccaggcccacttgaccaactctgacccatgtgcccactggtcacaggcgcttcatcggctacgatagatggatc

SEQ ID NO: 621111 - DNA, 189 bp, Homo sapiens
acttgacaagttaaaattagctcctctgtactcatgggactgacagcagtggatgtcgtgttagcaggcatggaagtcgacctgtccgtgtttttagcttttctctggctcctcttttctaatctcttctcttctcttctcttctcttctcttctcttctcttctcttctcttctctgctggataccta

SEQ ID NO: 621112 - DNA, 339 bp, Homo sapiens
gaagcgaggggcacggcgctgagacagagctggagatgaggccagaccatggacactaacacccagcaatagagacgggactgcggaggaaggaggacccaggacaggatccaggccggcttgccacacccccccacccctaggacttattccctgcttgactgagtctctgaggggcttccaggaaagcgcctccaaccctagccaaagtgcaacatggggagtcacaggctcggaatgcagggacagatccagtaagatcccccagaaaagaaagctacagaagaagctgcggctctttcagggtggcagctacaatatatagtcatgctcggcagc

SEQ ID NO: 621113 - DNA, 394 bp, Homo sapiens
cgtgtgggtcatccggtaatcctagcactctggaaggccgaggtgtgctgattacttgaggtcaggagatcgagaccagcctggccaacatggtgaaacgctgtctccactaaatacacaaaaagtagccgggcttggtaagtgtctgtaatctctgctattcaggagactgaggtaggagaattgcttgaacccgggaggtggaggtcgcagtgagccgagatggcgccactacactccagtcttggtgacagacagactcaaaaataatataaaatggaagttaaaatacaaaaattagccgggtgtggtggcagacacaccagctacttgggaggctgaggcaccagaactgcccgaacccagcagacagaggttgcagtgagccaagatc

SEQ ID NO: 621114 - DNA, 450 bp, Homo sapiens
  misc_feature (6)..(6): n is a, c, g, or t
  misc_feature (71)..(71): n is a, c, g, or t
  misc_feature (175)..(175): n is a, c, g, or t
gcctcncggggcatcagatccacgcgacttactccggagcacttgccctgctcggaactcctccaccgggncaggagcctcctgcagcgtaccgatgagggagacctctgcgagtatactgcatactgcctcctataccactgctgtgcattcaccgcctgggttcgaggccccngctcaggcgtggagcgggcccactgctggctgaggtgatcgagaacttggagtgtgaccctaggcactaccagcagcgcacgctcacttcgccctcagggctgacgaccccctgctcaagctcttgcaggaggctcagcaaagctgaattaactcaggcagaagagcacagatgtgtgggattgggggaggagtggggacaagattatctccaagtgaatctaaaaatgtattttataccggcttattcctagtattgaataaactagcgggctc

SEQ ID NO: 621115 - DNA, 616 bp, Homo sapiens
  misc_feature (567)..(567): n is a, c, g, or t
  misc_feature (583)..(583): n is a, c, g, or t
aaatctccgcaattgagagcagtgcaagtgctgagaggatgtagactgggctggggcgagaacatgtcacactagatcccagtccacgatgatgagtcagggagactcgataactgctccttggccattcattttcctccagcccatagctctgcccactccagtgtcaaacaccgcccaggctttccagctgacctctgttatcttgagagctgaggctaggtcctcccagctactgttaggcattgaggtactaaaactgcaggtgggtatgtccatctcatccattgtggcttgagaccggccttcaggaagtccgctctccatttaaacatcctttcttattcataagcgcaccacccaaagtctgtgtgtttgtgacagtctgtggggactgtcccagtgcctttgtgatgacctaaactgcactgagtctcttgccaagaagcaatgctttttttgtgaaggccactcagagcatcttgcagtcacagctgttcctgagcctgaggccagaagattccctaaccaggactttgaagccaaacctaggcaaatgatgggganctccccattcttcatnaaaatcccctcagatcctcaagttgaatgtttg

SEQ ID NO: 621116 - DNA, 410 bp, Homo sapiens
tcagggaaatatgacaatcttttattttgttttaattaatattttttgagtcagcgtcttgctttgtcacccaggctggagtgcagtggtgcaatcatggctcgctgcagcctcaacctcctgggttctagcgatcctcccaccttagcctcctgagtagatgggaccacaggcacgtgccaccatgcctggctaattttttgtatttttagtaaaggcagggtttcaccatgttggccaggctggtcttgaactcctgatctcaagtaatccacccgcctcagccccccaaacaaagtgttgggattacaggtgtgagccaccatgtccggcaaaaacaaaacaagcaagcaaacaaacaaacaaaaaatcataatgttttacactgattaagtgcttaccctgtgttg

SEQ ID NO: 621117 - DNA, 150 bp, Homo sapiens
  misc_feature (21)..(21): n is a, c, g, or t
  misc_feature (140)..(140): n is a, c, g, or t
  misc_feature (147)..(147): n is a, c, g, or t
cttcttaaaagggagaggagnccaggcgcagtggctcacgcctgtaatctcaggtgatccacccacctcggcctccgaaagtgctgggattacaggagtgagccaccgcgcctggccccgtattcattttttatactggnaaaaaanttt

SEQ ID NO: 621118 - DNA, 120 bp, Homo sapiens
caggatgttatgcctgtggccggaagcacagccgagacacatctgctgttcaatgacgcacacttcctgatggcatccttggtgcacatgaaccccagaacacaacagggagctgctgaa

SEQ ID NO: 621119 - DNA, 4334 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggaaaaaaaaaa

SEQ ID NO: 621120 - DNA, 210 bp, Homo sapiens
gatcgagctcggcacctcttcgcggtcgaataatccttgaggagtagctgaatagcagatagaatagcagatggaacactgagaagttatttccttgaggatagattactacaatggaaaggaaatgagaggttctaagagatgggctagtggcttgtaatatggggaaatggggtgaatgtcaggtggatcagagagatgcagtaatgg

SEQ ID NO: 621121 - DNA, 4297 bp, Homo sapiens
  misc_feature (4261)..(4261): n is a, c, g, or t
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcaatgagtacagnattagggatccttagagtacctcaacatgcagctga

SEQ ID NO: 621122 - DNA, 4136 bp, Homo sapiens
  misc_feature (4117)..(4118): n is a, c, g, or t
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgagctgcgtctgnngaggaggggtaccgagct

SEQ ID NO: 621123 - DNA, 367 bp, Homo sapiens
taagagaagttgtaggtagccctcttctcattcagtaagccctcaacttgctgctaagagctttaacaattttgcaggatctcacttgagtattttaggttcagatggaacaattcttatcacttttatgaatcagatgttttaaaattcaaatttagattgatgttatatgttaacaccgtctataacatctgcctacaccctcggaagggacctatgaaatattaactagccaaggaatccttttctgactgtgggcttttctgtaggaatgaaatctggcagaaatatttaatgaagaagaatctgaacatagcagttgagaaagaaagattgggagaagactccagatgtcgtaaagcaaaga

SEQ ID NO: 621124 - DNA, 902 bp, Homo sapiens
gggaaacttgactacttatgagtgtggctcctccttccctttcaagtcccttaattaaatagcttcccctctacaggcttttgaagtggtagcagttcctcctatactcctgccacgaaacagctctcctcaaacatgagagctgcacccctcctcctggccagggcagcaacgccttagcccttggtttctgtgtcatctgcttgtgtttctgctgggctagaccgaagtgtactagccagggagttgaagtgagagacttcggtgtgtcggcatggagaccgaatgtcccattgagcaccttgcccactgaccccataataggagatcctcatggccacaaggatttggccaactctagcccagactgggcatgggtatgcagcattatgaacttggagagtatatacgaaagagatttcgaaaattcttgaatgagtcctataagcatgaacaggtttatattcgaagcacagactgttgaccggcacttggatgagtgctatgacaaacctggcagccctgtttccccagaaggtgtcagcatctggaatcctattctactctgggagccagtaccggtgctcacaggttcctgctttctgaagatcaggtgctattgcctggcgttgtaggaaactggcctcgttataagaaacttgagagtgagacttttgaaatcgacggatcccgaagaggtgcccgttataggtttatagctactctgggaactttccggttacatggcggactttgggttgcgccactacaccttttttggagtggtccctatattactccgggctaagaaccgcatggaataaagcccgctcataaaaaaaaagcggggtccacccagagacaaaaatttctgggggacgccccttgtgagaggcccgtgg

SEQ ID NO: 621125 - DNA, 4288 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaa

SEQ ID NO: 621126 - DNA, 369 bp, Homo sapiens
  misc_feature (11)..(11): n is a, c, g, or t
  misc_feature (16)..(16): n is a, c, g, or t
  misc_feature (86)..(86): n is a, c, g, or t
  misc_feature (362)..(362): n is a, c, g, or t
gtatcctggtnggttntttcgtcgctttccccatggtgtcaaattaccccgtggtcaactggggtcccaaaattattaaagcatgncccaggcacagtggctcacacctataatccccagcactttgggaggccccaggtgggtggatcacttgaggtccggagttcaagatcagcctggccaacatggtgaaaccccgtttctactaaaaatacaaaaattagctgggtgtggtggcgcatgcctgtagtcccagctactcgggaggctgaggcaggagaaccgcttgaactggggaggtggaggttgcagtgagccgagatcgcaccactgtactccagcctggcgacaaagcaagcccngtctcac

SEQ ID NO: 621127 - DNA, 406 bp, Homo sapiens
aaaacgccacccccagaaacgggaggctcttttggtcagcccacagggcccccccaatccggaagaagatgatggaaatcctgcccccagagggggccgcccaatgccttgaaaaaagtggtccattaattttctcccgcccgccttggaaaagacataaaaaaggcctgcccatctttttttcccccccctgatgttttcgttagaaaagtaaaaatgctgaaaaagccccagttttaattgggaaagcccctggagcttcttggtgaaggccgtagttttggaaaaccccctgggggcgagcccggggctaaagttgaacgagctgatggatttgacccccccgccccagaatttgtttaaagttccgccttccaataggggcaaataaaaagggctttttgta

SEQ ID NO: 621128 - DNA, 7135 bp, Homo sapiens
gggtgacgtcgtagaggagtccccacaaggcagggaccctgccttgtccagcgtaccctgccttgtccaggggggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621129 - DNA, 3896 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccaggagacctgagcaagccaggagacctgagcaagccaggagacctgagcaagccaggagacctcagcaagccagg

SEQ ID NO: 621130 - DNA, 832 bp, Homo sapiens
ggttactagcggtaggattatttcagcttgcaaaatgttcttgtctagcacttaaatggtctgcattttaaaatgtagtctatcactttatttatttttttttggtacaaggtaactagtaggccatggtgtggctgttttacattggtttttaaaaattttttgaaaatgtttttggaaaagtttggaaaatgttggggcttttttttttttaaacccaagagtgttgagtggttcttttataaatttatggtagagtctcattttcttagggccatttaccctaaatattaatcagtttttcttagcccattggatctcagtgttagcgtgaaataaataagtgtaggataatggcagagtttattaaaatacagagctttcattttggtccataaatctagaaatcttctctgggtttttcaattagactttacccaccgggagccagatgaggtcaggggctttttccagttataaggatcagttcttatttatttaataccagtattagggttcctaattataatttagttcttacatgggatatgtatctcctaatttagaggggcccatgactgttctgtgacccgggtgtgctgttcttcaacgtggagtttttttacgatggtagaactttataggtaggctctcaaattggtcccgggagtcccccccattcggctattagggttcttcccagttgcgagttataaattacctgtattcttccgggcccggcgcgtgtgaaactcttttcggtagccggttgccggccggcggtggacgcttcactcggggaattttaccaccgggtttttcaaaaacggtg

SEQ ID NO: 621131 - DNA, 6768 bp, Homo sapiens
ctgggctccacacctttatctgctagctgcctcctagaaaggctcactcgcaccacccccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621132 - DNA, 348 bp, Homo sapiens
ggggagcatctcatcagattggctggacaggggacacaggctgcccgcaggtaggccggggtccctggagctgttgggggagggtgttggtggacatagctcttggtggctcaggggttcaaattcctggcataggcctcatgggggcgctcaggggtccagggctgaggccaactcggttgtgtttcggctccaggcttggagttggtcagtggcaactggtgggctggggcccagaagttgttgcccctaccagggcagtgtcaaacagaactaaaggacccagcccatgcacccagccaccccttccctgggtcattgttaggccaggcaggtcctcccaccaca

SEQ ID NO: 621133 - DNA, 6144 bp, Homo sapiens
  misc_feature (3)..(4): n is a, c, g, or t
  misc_feature (11)..(11): n is a, c, g, or t
  misc_feature (17)..(17): n is a, c, g, or t
ttnnccatacnccttangggtttaggtgtaagtgaactattatcattggagtggagaactggagagaaagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621134 - DNA, 2724 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggaggtaggagtgggcgggcgacctccaggactgagaggcagcacaggccagggcctccgagaagccggtacggcgcggctccttcagacctat

SEQ ID NO: 621135 - DNA, 2265 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggctctgtttagacagcggacagacgctcacgcccaggggatgtcctcacgctgtcgccgcgcggtttcccttcgcagatgtgtatactcatgataggtcagaaagtgtatccgctacaataaagttctggttctaactaa

SEQ ID NO: 621136 - DNA, 239 bp, Homo sapiens
cgagggggtgcagagtctcggaatactgggtataggcagggaacgttcatgaaggaaaatcggcgggtagtggtaggtatgaagtacagaccgcacattcttggcaaacaaatacagactggtgagcttcacacattcttccatcttatcattagtgaaaaccgggtaaaaaagaaaacgcagcattagaaatattagggacgggccccaccccgtcgggtgggagcgggtaccgagct

SEQ ID NO: 621137 - DNA, 257 bp, Homo sapiens
tagctgggactacaggtgtgtgccaccacacccggctacatttttgtatttttaagtagagacagggtttcaccgtgttggccatccatgatggtctcggtctcttgacctcgtgatctgccctccttggcctcccaaagtgctgggattacaggcgtgagccaccacgccagggccaataattttttttttggtaccttagaaatactagtgtttccaaagtattgtcccgtcctgggaaataagtgctgtagtgg

SEQ ID NO: 621138 - DNA, 220 bp, Homo sapiens
tgaacattcgtgtccttaagggctgatctgttcatccaattcagcaagaggctcaaagttctttctcaaggacttcacgactctccttaggtttatctcactttcatcgaacttcactccttccttggcaacactgctggaacctcgttcccatcaaattcgggaagggcctgaatacagtattcatccacaggttctgtgaggtggacacgaatgttca

SEQ ID NO: 621139 - DNA, 432 bp, Homo sapiens
  misc_feature (53)..(53): n is a, c, g, or t
  misc_feature (104)..(104): n is a, c, g, or t
  misc_feature (118)..(118): n is a, c, g, or t
  misc_feature (156)..(156): n is a, c, g, or t
  misc_feature (162)..(162): n is a, c, g, or t
  misc_feature (211)..(211): n is a, c, g, or t
  misc_feature (246)..(246): n is a, c, g, or t
  misc_feature (367)..(367): n is a, c, g, or t
ggcggcagggctgagcagcgacgccctccattcactgcaacctccgcctcccnggttcaagcgattctcctgcctcagcctcccaagtatctgggacaacaggngcccactaccacgnccggctaatttttgtatttttagtggagatggggtttnaccatnttgcccagactggtcgcgaactcctgacctcaagtcatccacccgcctnagcctcccaaactgctgggactacagatgtttttntttcattgtttgtgtgtgtgtgcgtgtgtgtgcatctgtgtgtgtgtgtttgtcttaagacagagtttcactcttgttgcccgggctgggagctcaatgggctcaccacaacctccgcctnccgggttcaggtgatttttcctgcctcagccttccttgagtaggtgggggattacagggcatgtt

SEQ ID NO: 621140 - DNA, 161 bp, Homo sapiens
tatacgtcataggtttattgacaaacatatctagtatggcatatgagttctagtctgatccacttgccagaggctgcacctcgtaaaatgctctacatatctgttaaatggaggactgagacatcctgatgtcttagcagtggtgtctcactacagtgagg

SEQ ID NO: 621141 - DNA, 499 bp, Homo sapiens
  misc_feature (54)..(54): n is a, c, g, or t
  misc_feature (68)..(68): n is a, c, g, or t
  misc_feature (488)..(491): n is a, c, g, or t
tatacacaatttaaatttgggaaggctccctcaacaaaatcatcttattttccnagtttcaaaaaacnaagttctgaagtggagattaaagacagggtctctttatttccccagtgcaagtctccctatctatttatttgtgaatgaatgaaattagttaattaatgagcccagggtttcactttgtcaccccaggctggattgcagaagaagtcatcgtggccaagcgtggtgctcatgcctgtaatcccagcactttgggaggccaagacaggtggatcacttgaggtcaggagttcaagaccagcctggccaacatggtgaaaccctgtctctactaaaaatacaaaattagccaggcgtggtgcgcgtgcctgtaatcccagctactcaggaggctgaggcaaaagagtcacttgaacctgggaggcagaggcagcagtgagctgagattgcgccattgcactccagcctggccaaaaaatgcnnnnctccgtct

SEQ ID NO: 621142 - DNA, 207 bp, Homo sapiens
cacgaggcggacattaatattgcagaaatgattgaaaggttacagaaggactgcatggaagaaataaacttgtttagtgaagacaagttacagttaaagcacatgggtgaccaactgatcaaggtcagcaacatatcaagagcagctgagatcgatgacacgctcaacagaattaacgatcgttggcaacatctttttgatgtcatc

SEQ ID NO: 621143 - DNA, 749 bp, Homo sapiens
  misc_feature (457)..(457): n is a, c, g, or t
tgggcatggtggctcatgcctgtaatcccagcactttgggaggctgaggcgggaggatcacttgagcctagaagttggagactaacctggcgagaccctgtctcaaaaaaaaaaaaaaaattcaatttagctagcaggaatttggacattttaaagagggaatcttcttcttaccttcttacaaaatcaacactttaacactttttttcacctttcagaaattattttagcaagtggtggatttctacttgggtctagttttttcccttttataggtggtaatttatgggttactctctatttacgggacttaccagagattattacaaaattactggtggtgcaaaagaattgggttacgtggtctcaaagagctttacaaacttaaattttaaaagaattagcaagttctgtgaaaaattagaagattagctcaaattatttgggttatagtgcntaagaaacgtggttttaaatttccagcttggagtgtaaattggctagcttagggtgtcttaagtccaagcattgttaggaaatcctctttattcttaaatatagatactgtcggcctttttgatggaattttagagccagaaagctgtagagcagtctgtgattgtagaaaataccctgacagaagatttttgccttttttcccccaggctgcagtacttgattggggcctaagtctttaacgctccttgataaaggtcccggcctgtccgggctggatccgaggcagaagc

SEQ ID NO: 621144 - DNA, 108 bp, Homo sapiens
tatgaggcaggagctgataggcccgcggtgtatccttcgtacagcccgtcccgcctggtggccacaggtggcctgaactgtaccagttacggtgccgcagggaatagc

SEQ ID NO: 621145 - DNA, 322 bp, Homo sapiens
aagtgagaatttatgaacattaattcattttaagaaaagtgcagccaggcgcggtggctcatgcctgtaatcctagcactttgggaggccgaagcggacggatcacctgaggtcaggagttcaagaccagccatggccagcatggtgaaaccccatctctactggaaaaacaaaattagctgaatgtggtggtgcacgcctttaatcccagctactctgggggctgaggcaggagaatcacttgacttgggaggtggaggttgcagggacccgagattgtgccactgcactccagcctggatgccccagcgagactgtctca

SEQ ID NO: 621146 - DNA, 269 bp, Homo sapiens
tatcaccggtcctttcggcgcgagcacttctgttctcttgtgtctgggcgctgctgcaggggagacttctgcctcgattgaagtcgactagcctcccagagcagggctgcaggtccttgggctgagggagctcaggacagcagagtcacgtgtgcggggctgtgcgtgttcttcccgtctccccgagcacctctcatgggttctcaggatccagtgagggccgctgcttcttcacctggtgggcccaggaagcttgcactttaaggccg

SEQ ID NO: 621147 - DNA, 825 bp, Homo sapiens
  misc_feature (1)..(1): n is a, c, g, or t
  misc_feature (62)..(62): n is a, c, g, or t
  misc_feature (64)..(67): n is a, c, g, or t
  misc_feature (69)..(69): n is a, c, g, or t
  misc_feature (89)..(89): n is a, c, g, or t
  misc_feature (97)..(98): n is a, c, g, or t
  misc_feature (100)..(100): n is a, c, g, or t
  misc_feature (130)..(132): n is a, c, g, or t
  misc_feature (134)..(135): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (168)..(168): n is a, c, g, or t
  misc_feature (176)..(176): n is a, c, g, or t
  misc_feature (178)..(178): n is a, c, g, or t
  misc_feature (180)..(180): n is a, c, g, or t
  misc_feature (191)..(191): n is a, c, g, or t
  misc_feature (227)..(227): n is a, c, g, or t
  misc_feature (231)..(232): n is a, c, g, or t
  misc_feature (234)..(234): n is a, c, g, or t
  misc_feature (243)..(243): n is a, c, g, or t
  misc_feature (248)..(251): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (268)..(270): n is a, c, g, or t
  misc_feature (273)..(273): n is a, c, g, or t
  misc_feature (277)..(277): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (334)..(334): n is a, c, g, or t
  misc_feature (336)..(336): n is a, c, g, or t
  misc_feature (338)..(339): n is a, c, g, or t
  misc_feature (349)..(349): n is a, c, g, or t
  misc_feature (351)..(351): n is a, c, g, or t
  misc_feature (353)..(353): n is a, c, g, or t
  misc_feature (357)..(358): n is a, c, g, or t
  misc_feature (366)..(367): n is a, c, g, or t
  misc_feature (429)..(429): n is a, c, g, or t
  misc_feature (748)..(748): n is a, c, g, or t
  misc_feature (764)..(764): n is a, c, g, or t
  misc_feature (816)..(816): n is a, c, g, or t
nccccgggggggggaagaaaaggaggaacatgctaaaaaccttatgacaatcatccaaatgngnnnnangaacaaccgattcaccaagnccactttnncnattttacaactttctacatctcactcttgnnngnngggttggggggnggnggngcctgggagtccctngggccccngngnggggcccgggntctccaggggggggggggggggaggccctggggggngggnngnccacttccnagggnnnngggggngngngctcccnnnggngtgngccaacagcctaatgtgaaaagaaactgcactgaagggggggggggggnanggngangngnngggcttatgngngngtgnntatatttnnataacacagccccagagtctttctctcagttacagcctcagggaaaccacgttctggttggngggttctgcagggatctctcccaccactgagcctctagtcccaaaaccatccttgacaacatcgtgtgtctgttacttccctttgcccacctccaggccacctggggaagcccacaggcagccaagaccctgaaatgaaatgaacacaaagtctgactcggtaagtattagtttcaaacagaacactaaagagaaaagttgaagctgcaatgtgtgtttaaggcagagcccagcagatccgtgtccacccatgtgccaataagacaatgggcagagctacaaatggcaagagaaaaatgggactattaatgcgtgtggnaaaggccttaatagtnaagttacagctaagaatgtcatgtcttgggttagattttcattttagcacgntaatgtatc

SEQ ID NO: 621148 - DNA, 338 bp, Homo sapiens
ggtgaaggacgttcttgcccagtagccgactggccaatcacaggcaggacgatgaaggttctgtgagctgagtcgctgtgcacattcctggcaggatgccgcaccaaggtggagcaagcggtggagacagagacggagccctagctgcgtcagctaaccgagtgacgtagcggtcagagctgtgaactgggactggcttgcttttgggattacctgcgctgggtcgcagacacatgctgagagggtgcagcatgagcagttcagttcccaattatccagtgttgagggcggtgctggccagactctgcacgtgtgacggcctactttccctctgtcgg

SEQ ID NO: 621149 - DNA, 101 bp, Homo sapiens
  misc_feature (46)..(46): n is a, c, g, or t
  misc_feature (98)..(98): n is a, c, g, or t
attgtgggtacttttgtgtgctcatttgtgttttccccccctcctncaacatttttttaacccccaacacagcttctgtggctgactgtaatactgtncaa

SEQ ID NO: 621150 - DNA, 462 bp, Homo sapiens
gtagggaccgagtgtactggcaggaatgacgagtcgatgaaagataggtactggatatattagagaattaggaaattagatatattacatacaacttaaccattactatataaaagaaagaatagtggccattaagccttacggattctgagcatgggaattaggaaatggcttaatatccaactgtcagcatgatattacaaggctccatatacttactaacatggaaaataatgtacaaagagcaggagcagtgacttcacctgagaacatcccgcggaggacagagaatcatgtatatacctcagggatactgagtgccctggagtagctgccattctactgtaacatgttatcgtaatgcttaaactccagcactggtatgacattgaaaacagttcgttatacagtttgaatatatctctcggagtgtaggagtggttcaataaataaaacaatggg

SEQ ID NO: 621151 - DNA, 652 bp, Homo sapiens
  misc_feature (154)..(154): n is a, c, g, or t
  misc_feature (276)..(276): n is a, c, g, or t
ccctttcccccccgggcccccgggtgggtggttgtgggtttattaacccccccctaggggattttggcccccgggccccaaatttggggggggggaattaaaaaaccaatttccccccccccacccaaggagggaacccttttggttttttttnttgggggggggggtttccccccccccccaacacccagggtttttttcccccgggggggggccccttttcccaaatttcccaaaaaaaattttttggccccccggggccccccggggggaaanaaaatttttttttttaaaacaaaacccccccccccgggggaaacgtttgggggggggggggtttttccccccaagggggccccccttttttcccccccgggggggccccccttttttgtggtttttggggggaaccatttttggcccccctttccccccccggggggattggttccccccccccaaaaaggggcccccgccccttttttaaaaaccttttggggggggggggcccggggggacccttttttttttttcccccccttttcccccccccttgggggaaataaaaaaggccctttttcccccccccgggggcccccctgggggccccccattttttttttaaaacccggggccccggggttggttttta

SEQ ID NO: 621152 - DNA, 158 bp, Homo sapiens
tagacatatgtacagcctccatcttccttgagtcttgtgtaataacaccctttgccacggctgctacatacatggtaccaaaccttttctttttctgttgccaccagtgaaattgccagacccatcctttcagctcttcctactctgccaattcgatg

SEQ ID NO: 621153 - DNA, 419 bp, Homo sapiens
attcgcggccgcgtcgactgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggatgcaggagatgaaaataatagctggtccattttcttcgaatcataagcagagaaacacctggcttttagcacctgtgcctggtggaatactatggaaggtctggaggctgggaaggcgtgaagattatgtgcattccggaagatgaaatataacgcataagacttcatggagttccgcaatgcaaggggatttaggtgcactgatgtgaggcccgggaatgattcctgagta

SEQ ID NO: 621154 - DNA, 387 bp, Homo sapiens
tcatgaattgttggcccctctcaaaaatcactgtacatatctgtacatctgttttgcattactactctatcttcattgatctgtgtatgtcccccagctgataatatattgtctcgattactatagctatataataagctctgaaatcaggtacactgataatagccccttcattcacttttgcaaaatagttcctggttattctagtacctttgtcttctcagataaattttatcatacactttactgtatctggaaaaaaatctgcggtgattttgataggcattgcatcaaatctttgcaagaattgacatctttactgtgttgagtcttccattctatgaacatggtctgtctcaccatttgtttgccaacagatagcctggg

SEQ ID NO: 621155 - DNA, 271 bp, Homo sapiens
tagccggtaccggtgttccttgtctgcagttccaaatctacttctggagctcgtcctctactattttcctggagggaacaggctgggaaggaaggtggtgtccccttaaaacgttcagtcagccgcggcttcagacggagcagtcatttgtagataactaggacatgggaagatattcaacactgcttcctgggaggttttatttcttgacaaaggtatttgatactcgtgcagtccctggagggtctcactggagagacaaagggaaaca

SEQ ID NO: 621156 - DNA, 888 bp, Homo sapiens
agatggaaatgcagaaatcacccgtcttctccgtcgctcacgctgggagctgtagactggagctgttcctattcggccatcttggctcctccctccatcggtaaaccaactctttaacaaaggggagctgaggctctgtggctggaacctgggacttaggcctgaattaatcagagcaatgcactccactggccatggaggtggaagttgtattcacaagctctaaatgtcagccttcatctttagacctagtggaaagcaaagaagacaaaacgtgatgcaatgaaccttgttatggtacccaaaatatggggatctagcttctgttagcatgcctgcatccctgtcttggccccactgatgaggagcaggcaagatagggattctgagtatgaaggaagttactgaagcaattaacaatcagagtgtctgattagttgctataatttcaaatgtaaacaacaacaagaaaaccttttagatttcaggtgagaattgcactcttcaaagatggttcctctctgtggctgtagttagtgtagtgaatggatatcccctgggattgagtcaattctatatcctcaaagtatatttctttcttacttgcttctattcattctatcttccggacaccggggattggcttgacccggaagggcacagtcgcgcggcctaggttggcactgcactctacccggggaaagacgggaatcctctcgagcaaacaaacaaatagagagaaaactgacgccctataggggttctcggaggaagactccacgacaacaatgtttcgaacggtgatcctctcaagagatagtttcacaacagcaaggcgccggaacatgggggcagaatagcagcggtcaccacgcatctacactgaac

SEQ ID NO: 621157 - DNA, 450 bp, Homo sapiens
attcacaacaatacacacaaatctaaagtaaaataatggaatttagaactaaatattaggacgagcaatgtcggagtggctttgagtaaaatatcgtagaatagaatacagtatatacatatgaaatgagtaaagcagtatgttaacattattattaaagcagtatgttaacattattaaagtgactagtgatttgtgggttgagaaccattaggataggtgatgatttgtgggttgagaaccattaggataggtgatgatttgtgggttgagaaccattaggataggtgatgatttgtgggttgagaaccattaggataggtgatgattggctttggtgacattaactaactagctagcagtttattttcaagatattactgccgttaacatcattatacgctattagagcttacagtagacatagcagcttatgttagcagtcgacgc

SEQ ID NO: 621158 - DNA, 275 bp, Homo sapiens
ccccatggcacatgttgctaggctgggtgaggtggctcaggctgggcgaggtggctcacaccaggcgaggtggctcatacctttaatcccagcactttgggaggccgaggcaggtgaatcgcctgaggttaggagttcaagaccagcctggctaacatggtgaaaccccgtctctactaaaaatacaaaaaaaattagccgagtgtggtggcgggcccctgtagtctcagctacttgggaggctgaggctggagaatggcgtgagcctgggaagt

SEQ ID NO: 621159 - DNA, 217 bp, Homo sapiens
aattttttttaaaattatgaatcaaaccaaggggtggtttcccttttttgaaaaaaaaggaactcgggccccaaaatcaaattggcagaattttttgactccccaggcaaaaaacaagtttgcggttttgcccctttgtagaaaaagggggtggagggtttaaaaatctgttgggtccggctttttggatggcatttttttcaaaaaccccccccca

SEQ ID NO: 621160 - DNA, 438 bp, Homo sapiens
cccgatttgacgcgtccctaactttgaagtgtttataaatccattagtaagtgactatggcaaaggaagttattctctactttttccttcaaagtagtagtgctatcatctacttacttccttaccattcattacaggctctaatctatcacaatgctagcaaaaaactagacacaaccatatgtccatcaatagggaaccggttgtataaatatggtacatccataatagtggaatatgtagccattaaaaagaattgagggagatctagatgaactgccctggaaaatggttcatgacatacgtgaaaaaagcaaattagtcaccagtatgtgtaacttttgtttttgttactaagcaaaaattgaaattatatgcatatgtatatagagatgtccatttaatcaatcaagtcaggaaggatacaaacaggctgta

SEQ ID NO: 621161 - DNA, 806 bp, Homo sapiens
gggtcccggggaggtggagatgtgtgaagtgggcagacgtactgacgtggtgccctgcgctacactgcagttgcagtacatcggcgagggcgcgtacggcatggtcagctcgtgcctatgaccactgtgcgcaagactcgcgtggccatcaagaagatcagccccttcgaacatcatgacctactgccagcgcacgctaccgggagatccagatcctgctgctgcttcctgccatgagaatgtcatctggcatcctgatgacattctgcgggcgtccaccctggaagccatgagagatgtctacataagtgcaagtgacctgatggagactagacactagtacaagtatgctgaaaagccagcagctgagcaaatagaacatatctgctacaatcctctaaccagatccatgcggggccctcaagtacatccactaccgccaaaccgtgctaccaaacagagaattctagaaagaccctacccaaacctggatacatacaacaaacaacatgcgaaccatataaagaatataggagaataacacgccttggcccggggatatggccgaactcgcatgagcagttgaacaaacaaaccgtgacataacactagaccgggcagttatgcttgataaccgacgccatgaataacccggagcaccatacagtatacattgcattgaacatcaaagagagtaatacacaaagttacattcgacaatctgggaacaaggtataacatgaaaacaatgataggaaagagaacacaaaacagaaccaatattacaatgacagaacgtacttgaa

SEQ ID NO: 621162 - DNA, 189 bp, Homo sapiens
acaggagatggctgaattagcattgcaagctgtactcaggtctgctgtgggtgggctgatgagatcctcgcaggtgaacggggccaacggtggtagggctgtgcttgtgtcacattaaggagctcctgggccactcagagagcttgtcaatccgtgtcctgaggcagagaacttgttggctagtcgggg

SEQ ID NO: 621163 - DNA, 186 bp, Homo sapiens
atgcgacggactgatcacgaggtcaggagatctgagaccatcttgtgctaacacggtgaaaccccgtttctactagaagtacaaaaaaattagctgggctgtgttggctgggcgccgtgtagtcccatgctacttgtggagtgcttgaggcagtgagacatggcattgaaccctgggatggctgga

SEQ ID NO: 621164 - DNA, 403 bp, Homo sapiens
cccgtacgtcgaccgctatctgctggtgatttaacacccatctagtgccagaacttccgaggggccggcttggcctggtatcgcctgttccgtgacttggggtacagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacgggg

SEQ ID NO: 621165 - DNA, 602 bp, Homo sapiens
tcgtgccgaattcggcacgagagagaccagaacacatggcctctcatgttctactataggatgatacaacacagaggccctcacaagatggcagccccttgatcttggacttcccagcctccagaactgaaactgcacgcccacagtgaagcaggacagagcaagtgctgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccacgctaactgatcaatgtactttgtaatctcccccacccttaagaaggtactttgtagtctcccccacccttaagaaggttctttgtaattctccccacccttgagaatgtactttgtgagatccacccctgcccaccagagaacaaccccctttgactgtaattttccattaccttcccaaatcctataaaacggcccccacccctatctcccttcactgactctgttttcggactcagcccgcctgcactcaggtgaaaataaacagccatgttgcttcaccc

SEQ ID NO: 621166 - DNA, 227 bp, Homo sapiens
gtcccccaattcctgaggccagggggtttttccagctgaaaaaagtcccgacatttggaaccaacctgtggggtccaggaccaagctttgatttttccccaaaagccccttttggggagaatgtgttaaaaatgagctttataataattcctttaagggccgcccaaattagggttgctgtagggaagccttttttttttttgtaattaaaggttttggagatttca

SEQ ID NO: 621167 - DNA, 170 bp, Homo sapiens
ggacagtgaccattctatgccgacttgtgttgctacatctatgtccatgtaacaatacagaaagctggctccactagctaatacagcataaccgtattcgtcatgaaaatcaggtgtacgttcctggtggctctgcgtgtgcagtgtgggtactcggcgtgtggcaggga

SEQ ID NO: 621168 - DNA, 1968 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatctggttctctgcatatctggtaccggtg

SEQ ID NO: 621169 - DNA, 1911 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatctggttctctgcatatctggtaccggtg

SEQ ID NO: 621170 - DNA, 2188 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcattaaatgaactcgggaccacaaaaatgcaatgatcgaagcgatgccacaccccaagaggggagagcacaaacagaacggaactagaaggggaccgcggataacctacccacctcagaccagaaaaacaggccgctcggtaacatacacaaacagacaccaacaaacaaggggagacgcgccccatcacacagcatgaccaccgacgcccactcactcccggaaacgacaacgcaggcgaacgcaacacctggcaggcacgaaaacgcgaccaacgacagactcgaaacggcacgacccacagggaacaccaacatacacacgcacgatcaacaagaagcaaaccacgacccaccacactagacaacagaccgacacacacaacagcaggcccagcc

SEQ ID NO: 621171 - DNA, 200 bp, Homo sapiens
tcttaaatactgtgtactgatatttgctggtgctactgagtggtgtaattttacatggcgttctgcctctgttggattacacagccatcatatgggatgtcatccaagtacacaagatatcaattcttaagtgaacataatagttatgtcctaggcagtaaccgtcggtgaccctttggctcaatatgttgctactctga

SEQ ID NO: 621172 - DNA, 1808 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagatgtgtatactcatgataggtcagaaagtgtatccgctacaataaagttctggttctaactaa

SEQ ID NO: 621173 - DNA, 380 bp, Homo sapiens
  misc_feature (13)..(13): n is a, c, g, or t
ccctccggcctcnccatgaggcttttcctgtcgctcccggtcctggtggtggttttgtcgattgttttggaaggcccagccccagcccaggggaccccagacgtttccagtgccttggataagctgaaggagtttggaaaccccctggagggcaagggtcgggaactcatcagccgcatcaaacagagtgaactttttgccaaaatgcgggagtggttttcaaagacctttcaaaaagtgaaggagaaactcaagatttactcattagggcctgaagggtgacatcccaggaggggccttttaaatttccccccccccagggcctgtgttgaggactccccccatgtggccccaggtgccccccataaaaatcctccaga

SEQ ID NO: 621174 - DNA, 1792 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtacctgtcattaccccccgccctcgactcgagaattaagttgtacctctttactaggttggtggcagcaggctgtgatcggtatcctacagccttaccctcgtgtcctggatcttttccttccatttcctgtgtacagcctttttggggacactgccgttaccccactctagctagcatagctctgtctgtaggtgctccataaaggtgataggactgaccacaccgtcacctttcccggaaacccaagagggagcgttccacagagggagcgtgtagtggggggaactgttttataaattaatccgtttattgaaaggttcacaaggacaaagaggcaacagcaagagtcaggcacagaaataaaggacgcgccatcgtgcgctt

SEQ ID NO: 621175 - DNA, 5083 bp, Homo sapiens
aagacaagccgcaccacaaactaagtaagtcagagagaaagatcccagcacgccccctcgttctcacacttctggtacctcagcactctcacagcagttcccaaaggtgatggttctggaagagttctggcctcatccgttaaaacctgctttcagaggtggcttagacatggcagagtgggccgggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 621176 - DNA, 1122 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtaaggagaccaggcgttcttgcatccggctggctttggtgaaggtgggagggacctttacaactggaaatacttgtgtgtgttgtgttcataattataaactgtgacagagaatctgcatttctgaagtgaactttgctgccttgctggctagttttcatactggatgggcttcgggggtggggcagggggtggacatcaactcctaaacgtctattcaacatgttgtgtatatgtgcattttaagaacc

SEQ ID NO: 621177 - DNA, 366 bp, Homo sapiens
  misc_feature (266)..(266): n is a, c, g, or t
atcccccgctgatccggagccctcggccttcgccgccagtacgatttatagttctgggccgagaccaccgcgctgacaaccaagattcagacgctcactgtcaagagcccgcagtaggtcacggaattcagccggaacatagccgctcgcatatgaagaacgcctcagtaatcacgaggctcacgagccaatttcatggtcaccagaaggtgcctacttgttctcgggagaccgcacccgatcttgcgttctaacgcgaggcttangaaaggaacgtgcggtgtccaatttcgtcgaaggtaccgcgtgcggtgcggaaggatgcgaaattgctgaaagccgcataaagcctgtcagcacgagtgc

SEQ ID NO: 621178 - DNA, 865 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgttttttcattttgaaaaaattaaatgctctctcctaaagattcttcacct

SEQ ID NO: 621179 - DNA, 1247 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggtgagcttcattctctcccctgcgctcacatctgctcttaaaactgatgtatgcggcagcaacctagagtgtgtgttttccttctctcttcccctgctgacttgtggaccaacacaggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtaaggagaccaggcgttcttgcatccggctggctttggtgaaggtgggagggacctttacaactggaaatacttgtgtgtgttgtgttcataattataaactgtgacagagaatctgcatttctgaagtgaactttgctgccttgctggctagttttcatactggatgggcttcgggggtggggcagggggtggacatcaactcctaaacgtctattcaacatgttgtgtatatgtgcattttaagaacc

SEQ ID NO: 621180 - DNA, 319 bp, Homo sapiens
acacaagtctgtgcaaactcctgatggacaggcaccagacctgcacgagcagcagcctttcccccactaagatcggcccactgcaatccaagctcttcctgcaactgaaggtggcacgcaggcagcaagcactggggaaaatgctcacaagtgccccttcagcatgccggtgcccttccttgcaacagtgtcccccatgtacccttgctggtgtgcacagctctggggcggcaacagctgcatagcactcaaacggggcttccccacaggcccagcttcctcagagacgtcgtcgggcccttgtctgggctagtcgggg

SEQ ID NO: 621181 - DNA, 1285 bp, Homo sapiens
  misc_feature (111)..(111): n is a, c, g, or t
ttctggggcacagggcagggttgcctatttgcccccaagggtagggtctggggagttcacaaatgacactgggaaatatttgttcaaagaatgaacaaactgatgcccaangccccacgccacttggttatcctgccacgttgagcttgcctggggggacgttcagttgagccccacacatgcacagacacctggcaaacaccatctgatgccactgggggaggggggcttgcggatgactgaggagtttcacagaggaagtgctccccatggacagagcagcctggatgccgcaggccacgcatgggctcacctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatatgagcagggatcctcttttcccctaggactgactctggcactatgatgagcagctggattctgtagcgcccaacaaacaactctccctgaccaaacgagagctgctggggtggtggctagcagttccaaggtgaacaatgcctcgttacaaaagatgccaatcgtcccggcgcagctggcagggctgggcggctctgctcgcggccgctcgtgccgaattcgctgggcgcgaga

SEQ ID NO: 621182 - DNA, 81 bp, Homo sapiens
catggatttgctggtgcagtacaactaggcttaatagggacatgtttatctgatatgtaaggatgagatttcttcggtgca

SEQ ID NO: 621183 - DNA, 344 bp, Homo sapiens
ccccaaaaccccggggcttttccaaattttggtacccccccccccccttttccccaatgggggggggggggggtcgggggggggtttttttttacccggctctttttttttcccctccgtttccccgggggccccccccccccttttttttccccccttgaagaccccggggccggtcccccccccgggttttttccttgggcggggggggggttaccattttcccccgggacacccttttgccctttggccctttttggggcccctttttgccccgttttttcccaaaagccgggtggggccgggccgggttttccggggtttttttgccccccggggcccca

SEQ ID NO: 621184 - DNA, 708 bp, Homo sapiens
gacaaaatacccaaaatagtcatcatactattgaaggacaaagtctgaggactgatactacctgacttaaagacttactgtaaactttagtgaccaagacaatgtggcattggtgacaggacaaatagatggatggaacagaatagagaacccagaaatactcacataaatacagtcagttcaacttttaccaaggagcagaggcaatacattggagcaaaaaatagcccttgaggaaatggtgctggaacaaatggacatccactttcagaaaaaaaaaaaaaggaagaatcttttaggcaaaaactttacatccctcacaaaatttacttggaaattgggttcagagacctaattggtaaatacaaacttggtaaaactcttaggcaatagcataggaggaaacctagattacctttggtggtgggtggataatatttcaggtacaaccagcaaaggcatgatccatgtaggagagaagtgataagctggacttcgttaaaatttaatacttgggttctgtcaaagatactgtccagaaacatttaatacttgggtcctgtcaaagatcaatgtccagaaatggtgatgacgggtacagactgggagaaaattttcgggaaagacacttttgataaggaccatcaagcaaaattacaaggaacgtctaacattaactattacgaaactgaagaacctgttctagaa

SEQ ID NO: 621185 - DNA, 339 bp, Homo sapiens
atgccttttagtttaatgcatatttaaactaaattgatcctgtacgtgttcctggagcaagctagcagcctgattgtaggctactactcatcaattaacttctacagtggagactacttctgggcactggcaactactgaacacaacgaactcaacacggcttctgactttctgagcttgcaactaaacgggaaagaccatgctcatagcaagtgccaacatctgaagtgtggcagccttacccatttcatcacctacaacggcaagctacgcttcactggaagagattaccaagagaataaaaagagactcattcaggtggaacaacacacacaaaaa

SEQ ID NO: 621186 - DNA, 374 bp, Homo sapiens
  misc_feature (28)..(28): n is a, c, g, or t
  misc_feature (138)..(138): n is a, c, g, or t
aattttttgtaacgacagggtctccttnatgttgccccaggctagtctcaaactccctgggactcaagagaacctccaacctcatcttcacaaagtgctgggagtcacaggcgccagccacggtgcccaacctgtganaattattttaaactcattttacaaatgaggaaagtgatattcatacttgtaaagccattggggctgaattttcatttttgtatccacagaactaacacataaagtttacatgccattagaatgtaagctctctgtaagctacagatcttttctactgtaatatccttagtcctagggcagtgactagcatatagtaggtgttcaataaatatttgtagaattaatgaaaaaaaaaa

SEQ ID NO: 621187 - DNA, 111 bp, Homo sapiens
caccatacgagcacacgcctggcaagggcagtcggcagactccgatcctttgatgacaatattggggaagtccagtaagtgcaacctccagtgggtccatctgacccattt

SEQ ID NO: 621188 - DNA, 729 bp, Homo sapiens
tccaatttggggtaccccaggccctgtttggggtgcgccgtatgctgcctctcatctggtctaaggagcctggtgtcgggaagccgtgcttaatgcctaccgtcaactctacctcaaccccaaaggggactctgccagagccaatggcccaggtctttgattcagaatctctctctgctgctagtggatgcctcggttgggaccattcaggtgtctatgaggaaatgtctctgtgcagttatgtagcacgaaggagtgagttgaataccagcagtgacccagctgctgtggtgagcagggccaccgagaatggtcgcctgctgtcctctggagcgctgttcctctgtcatgcttcttggcatgatggcacgaggaaggccagaagtgtgggaagcaatttagacaccatctggtgagacatagtggctggactgagaagtttcacaggactacaggtctggcccagccaggtgtgccatgccatatgccaacatctcggacgggagacagccttctctgggcaaatgtcaccgcgctcgcgttccggctgcctcaggaacacaggtgtgtgtgagcgactgcgggagacagtcgcaaaaggctttgtgcatccagacccagtctggatcccatgcaaagaggtggcagtgaccctctatttaccaagtggcagagggcccgaagtgatctgtggccagatattgcagggctgtggcaacaggccctgga

SEQ ID NO: 621189 - DNA, 163 bp, Homo sapiens
caggtatgttcccccatgtgacaagaggaacatcaaaatatcaacctaaaatatggaaacaaaaatacttgaactggtttggccacatttaaggaaccatgaatgatacttcacgttgacgaagcatcatataccctcattgaaaacaaatttggacagggta

SEQ ID NO: 621190 - DNA, 549 bp, Homo sapiens
cgggcaggtgctatgatgccactgagtgaggtgggactcactgagaagtatttgtctggacacatcatccagaatgcagattatctttccaaaagttcaggtgagaggtaggtgatgggagagaatgacagatcctcttgagactatagcccctattaaggcagcatggatatatgggagcccctatccttgagacacagctaatgtacttcaatatcaaaagaggtaaagctaagctctggtttctttatttaatgcatcatctgaaaaaagtaagtttccagtaaccaaagtgtgtaagaattatttctcactagaaaataactccgtccttatttgcaagagagaagaagataaactattttcctttttatgtgtggcccaatatacagactatgtgatttcagaatgaggaacaccagattttgaacctggacactatttcttcaaccttaagccaattgtgtaaattccctttatataaaagtagaggtagccgtacttacctcacagacttgtacagtttaaaaataaatggcactcaataaa

SEQ ID NO: 621191 - DNA, 143 bp, Homo sapiens
cgctagaccggctgtgctacctactgggtggtgggcagggaagcttctgtgcatgcttgggcattcagacccaccatcattaatgttaatagcggaaatgcagccacgtcaaacagcaaggcaggttggttcattagcatctg

SEQ ID NO: 621192 - DNA, 966 bp, Homo sapiens
  misc_feature (569)..(569): n is a, c, g, or t
gtagaaggagatcactgccctggtacccagcacaatgaagatcaaggatcatttgctcctcctgaggcgcaaagtatctccgctggtgggatcgggcggagtccatcctgagtcctcgattggtcccaccttgtcccagcaagatcgtggcatcgagcgaagcaagggagtgatgacgcagtccagtggccctccaatctgtccagcgctaacatattggttctgaaggcgaggagtatgactcccagtggctgtttacatcacttttctttgaacaaaacctaaacattgcgctagaaaaaaggaaggatagaggatacggctatggggtatgtatttgtgatgaattccgttatgagtgtacgtccctgtgaacaataattggcgtcttggagtccgcgcagttttaaacacaacgctcgggacccgcagtgtgcggcggacctcaacagtagctctagttcgtgcaggacaaaggcttacctcacactagaagttaccctacacttgtggtggcacccgggcgtactattttatttagcgcactctcggaggttgtctcagaaganctgtctttcactggtgtactcaagacctgcttttgtggaatcgtgcaatagtcccatgagctttcttcattaaaatggacctggcacctgatgtacactataaagaagaaggggcccagtactttttccacatattactgccggctgggtgaaatgacattatgttcaggtgtacgacaattggaatagcaaacttctaattacagttaagcgctatcaatgtttacccccttggcacaggattgattagacgccgttggtgggggccatttccccttattgtgtccgcacagcctgacattggtactacaggcgagggccccatataagagtggaatacccatgtgttatttatcctgcttggcaacatggtctagggtgcccccaacaaaaccgt

SEQ ID NO: 621193 - DNA, 889 bp, Homo sapiens
gagtcttttcgtggacggccgggtgagtgagacagttgctggcggtcggcccggagcacgaggcgggaagactcatcggagcgtgtggattcgagccgccgatttgtgaaccctagatctcgaaatgcatcgtgatcctgtccattgtggctgtaaggttgatgtaggcaatcttgtggatccaattggaacaaagagggaattggaaggggggcgtttcggtatgatggagccatctcgcgaagtgtgtgggtttgctagaaatccgcggggtttggccttcagtggaagttggaagatccctgagatgcagtgatgcagtccgagagctagatggaaagaaacactatgtggtgtcggtatgagtggaactgtcgcgtggtggaaactacgaagtacgaaatcgctggcccaacctccctctggggggtgcgtcgccctcgagatgatatcgtacggaggagtgcctccatcttcgtacgcaaatctccaagaagggggaggcttcctttcgtcacgcgggcaggtcccttcactaggagataggcggaagagagaggatcgctgcctcgggagagaaactcacaaggcggccggagcccttgtcctaaggtgtcgaagccgatcccaggtccaatgaggtaactcagcaggacgttgcagcgacgtggtgtacagcacaatacttcttgacgaagatggtgcgcaaatcccgtttgggtggcctcataagcggggactcacagacgcgaagcggcaacatggaagccttgacaggggcccagggaatcctagtgaaggaacacagggtacacccaagtatacagtcctacacaattgctgctcttccccgaaaacacacgccggggttaaaaaccacacggaacgc

SEQ ID NO: 621194 - DNA, 102 bp, Homo sapiens
tggagggagaggatcatgaaaaataagtcgtgctggtaagatactacctgggtgatgaattaatatgtacaacacacaccatgacacaagtttacctggtat

SEQ ID NO: 621195 - DNA, 117 bp, Homo sapiens
catagtgagcacccatcgttacaaacacaatacaaaccattcagctggggtctgggcatggtggcaccagcgggtgtagtcccagctactcgaaaggctgaggctgtgcgctgtcct

SEQ ID NO: 621196 - DNA, 535 bp, Homo sapiens
cttgcagactatccccttggctgaatatcccactgcccctgagctccctatgtctgctctctaagaacctagcctgttcattacatgtggctgcgcttcttgttgaacaatatggcagaatcaggagccaccttagcaggaccacatgtttggagcctcgggataaaacgacagtgaggctgaaaagagagaaccctagaacttgaataggtgcctgatcttgctaggagaaatgagaaatcgcattcggatccaggccccaggtggtcaccatacagcagtcttgcttccatgcacctcagtaagaagaggatctgcctttgggacctgctcagtgaggaaatctcttgcaatttctgcttctgaatgattcaatggtgggagcaatagaaataacactccctttgccttttctgagtgtttagggaaatagcttttttacctcccatgaccatactgttttgagttgtcaccaatttttcccatgcgcccctactttgaacatccttgtgggggccccctttgagttcagccc

SEQ ID NO: 621197 - DNA, 257 bp, Homo sapiens
aagattctgaagttcttcataaatcttatcatcatagtacaattatatagctctaaaataagcaatgatttctgaggatactcttaggtattttttattaactgttttgtcacggccattatttcaaactattttggttcacattctataggttgcctaatctgaagcacaaacactcatagtttgaagtcttcagatgagccttcctactctccctgttaaacataaccctcaaactaacaaaaacatttccaata

SEQ ID NO: 621198 - DNA, 142 bp, Homo sapiens
aaagaaaaatgttcaaacagatgcagcattgctggctttgaagactgaagaaggaatcacaagccaaggaatatgggtggcctctagaagctgggaaaaaaaaggaaattaatttttccctaggcctccagaatgatgtagc

SEQ ID NO: 621199 - DNA, 1258 bp, Homo sapiens
  misc_feature (1206)..(1206): n is a, c, g, or t
  misc_feature (1236)..(1236): n is a, c, g, or t
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgttttttcattttgaaaaaattaaatgctctctcctaaagattcttcacctactttcgtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatggggctccctccagcagtgcgagggtcagagtttctgggagccttggggagggaggcatccctgttgagggggnggttaggggagatggggagggcaccagggnaaagtgatttaggagtcaggta

SEQ ID NO: 621200 - DNA, 210 bp, Homo sapiens
cgcaatggattggggacgctgcacactttcatcgggggtgtcaacaaacactccaccagccatcgggcaggtgttggcatcacagtcatctttattttccgagctcatgcatcctcgcggctggctgcccaaggcacgcgttggcgttgcacgagccaaaacgcacttcgctctccacacacactccaacccggatatcacaaaatattg

SEQ ID NO: 621201 - DNA, 371 bp, Homo sapiens
  misc_feature (11)..(11): n is a, c, g, or t
  misc_feature (16)..(16): n is a, c, g, or t
  misc_feature (18)..(18): n is a, c, g, or t
  misc_feature (22)..(22): n is a, c, g, or t
  misc_feature (24)..(24): n is a, c, g, or t
  misc_feature (37)..(37): n is a, c, g, or t
  misc_feature (43)..(43): n is a, c, g, or t
  misc_feature (70)..(71): n is a, c, g, or t
tgcggctcgcncacgngngctntntttgccggggacngtgcgnggcgcggcgctgcccgggctcgctggnntcccgcgccctgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgttttttcattttgaaaaaattaaatgctctctcctaaagattcttcacct

SEQ ID NO: 621202 - DNA, 1396 bp, Homo sapiens
  misc_feature (710)..(710): n is a, c, g, or t
cgtgtgtagccagtcgttgtgcaccacgcggtggaacccacgctgattggcgaccccctttggggccctcattttttaggggtgagccactcgtatgtgggggacccaccaagggtgtgttgtgcgacacggaaatgaagccccacgggtgctggtggggtaagccccgcggctttcctcggggaaattttctcccccggcggatattttttcgctcttgagacccccaccgcgggcgggtctccgcgcgctctctaatatttttttttgaggccctttttctaatagtgtccttttttaaatgttttccggacgggtaatgtggtagtgggaagtaaaatctcgtgccgccagcccgaaatctttgtaaaggtggccccttttttccccgctcgcctcttttccacaaaaggggacacacacacttcgttttccgcgggaaaaaggggggagagaagaaccccgcaggattttttcccggcacgctgtttaaaacgaaaggtggggggagagccacacttgggcacaacaggggggaaggagagacgccaacatttctcgtggaagcttccccctgctcttctctttcccccctcggggtggttgtgtttggtggagatccccccgggggagaaatgaggaaaaaagagaaaattttggagacccccctcgcgagatttgggtgtttctctctccccttctcggagacntctataagggagattttctttacaccctctttgttcctcgtgcacacacacacaagtgttctcccccacggccacaagggagaccacagtctggggccccactctgtctgagggccctcacgggcacagacctttctttcacacaccactctatattgggtgtctaaaacactcggggctttggtccacagcgagaacccaatcagcccacacccctttcgcaccacattgggcgcccctggcgtgcgtcttatattcttggtagccacacagtatcctggagagagaaataagcacgtcacaaggtttttataagccccctttgtaagcggttcttaaccctatagtttctccacatcctctttctctgttggagggccacacaaccacacactcctttgccacagcacggccaccacaacacatgcacttgaacacacccggcaccacgctgagagaataataaactgagatgggctttgaaacctcggttggccggggaaagctgtataggggtggataagaagctggctttccttttgggctgtctccacatctgagccctatccccttccacatgtcccacccccacactcccacccacacaaaagtatcacacaaatacaaggaaagtttttcacctgtccacattgctttgtgttttaataaaccaattgcagtgacca

SEQ ID NO: 621203 - DNA, 150 bp, Homo sapiens
ttgtgggtggatcagaccctcggagagagccaagtcaaacgcgagtacaacgtgaagctggtggagacagcgggcgtaccgtgagactccagtcgtagctgtcacctgtggccggagactcgcccttcaataaaaaatctcttctagctg

SEQ ID NO: 621204 - DNA, 284 bp, Homo sapiens
aaaaccctgtcgctctcccagagctctgttcctcttctcactgtttctggaaggcagtgcactcaaaagtgaagtcaccagtctgccgacagttgcctccattgacacaaggcgaggtgcacagtgcacatacagactgtcacagtactggcctgtgaagccctgaatgcactgtcacttggtaggaaccaggcaggtttgaggcaagatcccaccattgctgcaggtgtcctggaatgtcacacctcattggcatcaagcttcacactttttgccctgtgaag

SEQ ID NO: 621205 - DNA, 543 bp, Homo sapiens
  misc_feature (39)..(39): n is a, c, g, or t
ttatggcaaggccaagtcgattggatacttgagcccagnggtttgagaccagcctggttaacatggtaaaaccctatctctactaaaaacacaaaaatcagccaggtgtggtggtgcatgcccgtaatatcaggtactcaggaggctgaggcacaaggattacttgaacctgggaggcagaggttgcagtgagccaagattgctccactgcactccagcctgggcaacagagcgagactctgtctcagaaaaaaaaaaaaaaaaaaagagaaaaaaaaggagcgggcccaaagcgggggggtgatgaccctcctctggggccttggatggcagaaaggcctcttgtgacctccgggggatccaccttgcccccagggaaaaggacaccggggggcatttcttctatgtatacctccggcgggcccgggccttaaacagggggctcggctctcagtcctcagttaagattgggccctgaactcgagatttctgacacccctggggggcagctccaagcaccggcggtgtgtgatgccggggact

SEQ ID NO: 621206 - DNA, 788 bp, Homo sapiens
ctggagcaaggtctgccgggtggcctggtgcgattttgacaagatcaaagctgcaggaaaatggacagtgaggttcagagagatggaaggatcttggattgattgatgatgcttgggagaagacaagtgcttatgaggatgtcgcaataccactgaatggagcttcctgaaccctgaacaagacaatggtggcacacaagaatctgtcaaagaacacgacatgacgtgacagacttagccttacagtacctccatgagatatgttcccccctatggaaactgacgctctgtcctttctgtgtgggattggattttctcaaagtacacagataacgcatggtggtttacagtctccaaattcaaacccttgtgagtaataaatcagcactcaaaatgtacacccaatttagttgtgtggtagcaaagtgcaatggggaaattgaatgagaaactgagatttctcagtaatggtgaatatttcgttctttaaaacctaaaactcttcatgtgagtaggttatatctgaaacatgatggggtttaaacaatttgcctctaacctctcgatatgtctttgtgtgtcaaagagtttaaacacccttccaactacttattgtgtgtcctgtaccacaggtggattgaccgtatgagaggggacaggcacaagaaaaggaagccagacattagggaaaattttaacttctcataattcccaaattggggagcgatcggggagtataatgccggtagtgttgggtttgcaatatcccctccgggtatggatccaaa

SEQ ID NO: 621207 - DNA, 649 bp, Homo sapiens
  misc_feature (20)..(20): n is a, c, g, or t
  misc_feature (22)..(23): n is a, c, g, or t
  misc_feature (26)..(26): n is a, c, g, or t
  misc_feature (77)..(77): n is a, c, g, or t
gggcgccgagctaattcccngnnagngcaggcgaggcgcaccgacgcggaagactataagccccagcgggcgacgancgaacgcccccgggaacaccggccccgagctcggtcccgcgcccgaggatcctccacggggctagatggctgcgtcgggggcgggacggaaggtgagcgggcgctagggccggagccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcagacacttgagcgctccatgcattgcgtggtgccgggaggcctgggctcaccccagggccgcaccatctgactggttgatctgtgctttcaccttaaagctctgacaagcagaggatcccgtgcaggaagagaaaggtgtcagagaagaaccgtcaaagtttgcacatgctggcatggtggaaagagttaggtggtagcaggaaga

SEQ ID NO: 621208 - DNA, 1015 bp, Homo sapiens
tgatcgccatcttagggaatgttctcgtccgtggcgcactggcgcgggcgaaccccttcaagcacgcgcacatctgcttagctggtgcacgatggtctcggggacctccgtcagtcagctccccagggcccacgggccagccccggcgacctcgcagtctggcagccggcgccgtggaagagtacagtatgtgaatttggctccgcgaagtatatatgcatctgtgtgtggtttggtggggtcttaagttgtggtcggaacacagactgctgtggttcccctggatttgagtgaaatgctcggtatgcaggtggaactcccaaaagtagaagggccgtatttaatggatgctcagttacacttaaagaggatggtgttcgtggtgtggtaaaggatgggcatccgtagatttggtggggtgagtccatgcagggaagtcggtaaagtttggggttctatatgaagtcttgtaaagtcttgtatagacaatatgctgtggagaggagaatacttatctggggcgcaatcagctatgattgggtgtcgtctgacagtgctgaattctttgatgacattgcctggttcctatggaagctgctgaggtttgaattcaaagccagccaggttatggcaagattttgagggatgcaggtcccagaatgtgtgagggaagaagggctaaaaagcatgttaccaggggggttggtcccccccggatgagacagattcatacaccaagatgaaggtgggcggttgaacgtcggtaaggccggtcaagtgtgggccaatggccgcaggaggttcaagcggcgaacgggtgtacactgtcacgggaaaccgaggctttgtgaaaagatgttccccccggaaatgggcgctctggtgggaacaacaaggaggcgtctgtgccacaaggattaagatagtaggggggtgggacacaatagaggcgggaagggaatatataggatagagagatcccccgcacacgagagatgaaataacagtgtcagga

SEQ ID NO: 621209 - DNA, 402 bp, Homo sapiens
aaagcaaccaggcctccggagacccaccagatgaagagcaagtacagaacttcacatcagatccttcagcattgccagaattttcacagcttcttagaaaccaaattgagacccaagtaaaacctctctccctgcctgggatttctagcatcaaagatcttcaggatttattccacaagactggtcaagatgtggatgggatgctgacctaccaggaactctggaactccctaggttctgccatgccaagaccagagagcttgagagcatttgattcgaatggagatggaagatactctttcctggaactaagattagctttaggtatctagtctcatcaggtatatttgaaacggatatgtagcctggactacctaaaaatctacttaactaaaaagacag

SEQ ID NO: 621210 - DNA, 774 bp, Homo sapiens
  misc_feature (20)..(20): n is a, c, g, or t
  misc_feature (22)..(23): n is a, c, g, or t
  misc_feature (26)..(26): n is a, c, g, or t
  misc_feature (77)..(77): n is a, c, g, or t
  misc_feature (294)..(294): n is a, c, g, or t
  misc_feature (308)..(309): n is a, c, g, or t
  misc_feature (312)..(312): n is a, c, g, or t
  misc_feature (348)..(348): n is a, c, g, or t
  misc_feature (377)..(377): n is a, c, g, or t
gggcgccgagctaattcccngnnagngcaggcgaggcgcaccgacgcggaagactataagccccagcgggcgacgancgaacgcccccgggaacaccggccccgagctcggtcccgcgcccgaggatcctccacggggctagatggctgcgtcgggggcgggacggaaggtgagcgggcgctagggccggagccccgccggcccttcctccagcgccctgcggaccccgcagaaggcgctcgcctccctagcccgcaaaaacatatcgatttttctcgctgtggcaacgggggnggaaaaccgggttnnccnccgaagagaagaaggggtttgccaatcgaaagggcntcgaagggttggggaggaaaaaagaagangggggaggggggggagggggggggaaaaaaaggagaagggggggaggcgaggggggaaaaaaaagtggtttaggcaagatacaaaccctagttagttagtccttactcaagggctgcagagtaagtgccgcctctgcgctccgacggaggcacgaggcctgtggagtaggtccctctgttccgacaggtgcagacacttgagcgctccatgcattgcgtggtgccgggaggcctgggctcaccccagggccgcaccatctgactggttgatctgtgctttcaccttaaagctctgacaagcagaggatcccgtgcaggaagagaaaggtgtcagagaagaaccgtcaaagtttgcacatgctggcatggtggaaagagttaggtggtagcaggaaga

SEQ ID NO: 621211 - DNA, 747 bp, Homo sapiens
  misc_feature (79)..(79): n is a, c, g, or t
  misc_feature (146)..(146): n is a, c, g, or t
  misc_feature (165)..(165): n is a, c, g, or t
  misc_feature (178)..(179): n is a, c, g, or t
  misc_feature (192)..(192): n is a, c, g, or t
  misc_feature (199)..(199): n is a, c, g, or t
  misc_feature (371)..(371): n is a, c, g, or t
gggaccgcgtgggctcgcctccctgggactaggtttcagcggccgctgcgatgaccaaaataaaggcagatcccgacgngcccgaggctcaggcggaggcgtgttccggggagcgcactcaccaggagctgctggtcaaccagaancccatcgcgcagccctggnttctcgccgctcnngcggaagctctanaaatgcntcaagaaagcggtgaagcagaagcagattcggcgcgggtgaaagaggttcagaaattgggtcaaacaaagggagaaaaaggggatcatggtttggggcaggagacacacttgccatgtgaggtatactgccatctcccagtcatgtgtgaggaccgaaatttgccctatgtntatatcccctctaagaggacctgggtgcagccgcaggtctcaaagcgccccaaccttgtgtgataatggtcaagccccattgaggacgtaccagggaggctcaacagatggagttgctggaaggagggttgcaatgtccctgcccttaccctttatgaggggcttccgggtagaaactcgtgggcaccttgccggttgaaaagcaaatggggcttgcaagaggagacgcatggttgtctcgtggcaaacccaaatgaggggattttgccagttcccaagggaagcttttttccaggaggttataaagctttcatgagggatgagtctttgccacagggcattctgtaaataaggtgccaaatgtggggggaagatg

SEQ ID NO: 621212 - DNA, 144 bp, Homo sapiens
gacactcccgaagcagccggtgccagccggcgctcagcgtactggagctgcaggttgatctcccagtgcgtcatttgccagtgcccagctgtctgcggcttcatgactggtgcacgggcgcgaatgagcagtgttgcacagcct

SEQ ID NO: 621213 - DNA, 189 bp, Homo sapiens
tgatggcacgcgcccagcccgaggttctctcttaaatggcaatttaggattcactgatgtccttcatacagaagtgtcttcctttactttcataaagatatgaaacttcattcaggcttctttttgatgacagtcttactgtttctgtcacccagcgctgggagtgcacgtgtacaactgagtggctca

SEQ ID NO: 621214 - DNA, 571 bp, Homo sapiens
  misc_feature (567)..(567): n is a, c, g, or t
gcactcacttgaccaccatctttgtctgccagccgtgttctcatttctaggggagacgttgatcatctgtgaatcttgcttctctctgaagtacgtgtttagtggccatactgaatgattttgccccgcactgtcctgtcttgtctcctttgagacatggcttccctccagcttccctagccctcctgcatacccacaattccatgatgaatatgtctggataccatgggttctcagctgtcacagtgagtttattgatatcaccatattcttctgggtcacagctgctgcgtgggtattcccagatctagagcacagggcacagaaggatgtggtatggttgaagtctggaactggcttatgtcagccatctcctgcccttccattcctttacaaatatatacatatgtatttttttctaaatgtaggtgctatgggcttatgatgaaactttaacaattccgcaatggtgtaatatataaagcaacattctccctcctcgattcaccccaattcagtccctgtcccacctcagtctcattattaacactttcttgtgtatcatcnaaaa

SEQ ID NO: 621215 - DNA, 198 bp, Homo sapiens
  misc_feature (86)..(86): n is a, c, g, or t
aaatcctcctcctcctctgagtattaggacggcgggggcatacgtatgcgcagctagaggtgacactcttggacactgcgcctgancggaccatagcgaactgcatttgccaagactgttttcatataatcaagaacgaaagtcggaggttcgaagacgatcagataccgtcgtagttccgaccatcaacgatgccga

SEQ ID NO: 621216 - DNA, 1369 bp, Homo sapiens
  misc_feature (138)..(138): n is a, c, g, or t
  misc_feature (215)..(215): n is a, c, g, or t
  misc_feature (393)..(393): n is a, c, g, or t
gcgctatcttccagtaattcgccaaaatgacgaacatcatacagggacaagaggtagaggcgacccgcattatatgttctctaaggcctattatagcataaactagtggagattagttccctgttggcctagcatatnatgcgatatctagtaagaaaagggtgatatttgtacgacttcaacggtgaatgcggtacatgttcacacagaggaantgcccacacaaagtgtctaccactggtgcaaaacatgcgcaaggaggtcgtacaagtgcttagcccagtcatgcctgttggcatatgtcttgtaatacaaatgcaaggttaagggtcaagagttctctgctcacacgagagattaagtagtgctgtatttgaagcacagttaatgcancgtctaatgaagcccgatgactagacttccgtgacaagcgtgtgatagggaacaattcgattcgagaagagaaggaagagaatgccaagatgacgaatagggtcacctgtgggttcaagctacacacgcagccacgcgcttagcctcctaccccatgaggaaacgcacgactttctgtgacgaaccaatctcgcggaatcggagcctgatcgctgcgtggaaccctgtatttccctcctattggaaattccagtgggctcttaattagggtcgtgtagaaaagcatagcttgttgaaaggatcgctcgtgagggcataagcaaaatcaagggatggacaaaagagaccgggcgggggcctctttaagggcgggaggctgcgaaacaaaaagagggttcacaatgcagagtttgttcccacttgggtcccaactaacgtctggtttaacccgcgcgtagcccaaatgttttgttctgttgaccagaggggggggtggaatatttcgcggaggtttgcccccatagataggtgggcagacccgaaataatagcttgtgcacaaataacacgccagggggttttacccccgtgattagatataacatacgcgcggaggacagcacatcatgttgcagttgctaccgatacttataggacaaaaggggccgtcgtgtcaaaaaccatgaggtctgcggtgtgttcccggtgttgtaggggacaacatgttaatgttaggtagcgtgctaacagaaaaacaacggtggcagccatgagtggttactactaaacgtataacccacgtgttcgtcttttaaagtgacccctgtgatgttcctacgccgagcatgtgctgttgtcctattatcacatataaaaacctggtggccaagtgatgggaccacatggcactaattaaacttccaacaaattaagttggcgcaagtggagggcgcagcagggatctggtcattacaaca

SEQ ID NO: 621217 - DNA, 298 bp, Homo sapiens
ttttttttttttgagatggagtctcgctctgttgcccaggctggagtgcagtggcgcaatctcggctcactgcaagctccacctcctgagttcaagcgattctcctgcctcagcctcccaagtagctgggaggctcaggcaggagaatcacttgaacctgggaggcagaggttgcagcgacccaaggtgatgccattgcactccagcctgggagacagagtgagaccccctccaaagatagaaagacaggaaagacaggaaagacagatagacagacagaaaaagaaaaaggtcgacg

SEQ ID NO: 621218 - DNA, 398 bp, Homo sapiens
cggggagtcctttatcctagctccaccaccaaatcgttagcgcgtccttccttcttcctagcttcctgcaccaaactcgcacaggctcctggactctgtttcactatcttcaccacgaactgctgcttgatcgcttgctcctcagtcctagcttcatcaagcactggttcctggaatcctgtctgctgctgtcttcctagattacactgaatccacttctgtgtagcacctgggtcagctgtcaattaatgctagtcctcaggatttaaaaaataatcttaactcagagtccaatgcaaacacattaagtcggtaattactcttgatcttgaattacttccgttacgaaagtccttcacatttatcaaactaagctactatatttaaggccttccaaa

SEQ ID NO: 621219 - DNA, 308 bp, Homo sapiens
tatccagacagtatagtgtctcctgatatgcgtatgacgaaggataggatacagacatagagagtcttatatactctagtatatatggagaatgcgtctcatataacagttaaattggtcttctagtcaatgatagcatacccctatagcattagtaagaaaccaatatccattaatcgtaaatcctttactatgtctagctctgtcttgctacctaaaggatataagaaattattattgctctagaatgtattactttgttctcccatgaaagaatttcagtttgttagtacctatattttacaact

SEQ ID NO: 621220 - DNA, 395 bp, Homo sapiens
tgatctagaggatcgtgatgtacccaacactcagacaggcttacgaagaattcaaatatcaatagagaagctgttaattcacgcacgttatgacttcaggttaattcttcccagtggtttaagacttccaggagctggtaataacactaaactccataccgtgtttgttgaggtctgtcaatcaactttgttttggaaaaagctgctccaggtgtgaagacccgtccgccttaggcagatgagaagcatcacttagaagagtcatggctgcctgaaccatagctatggggggtagccacatagccagcctcagtgccttggctgtatccttgaccaaagaatgtcagcgtgaatgaggcagcatcaatctgtttttgtgttgggcgataacatca

SEQ ID NO: 621221 - DNA, 164 bp, Homo sapiens
tccacaaatgacgatgtgttagggtcgctcaatgaccgtccatccttcccactgctccacgggctgctcgggaaccaatatcgaccgaaggccgtcttcccaaatcgccacctacactgcttttctaggaaacctaccctaccacgtcatcgaagaaccaatta

SEQ ID NO: 621222 - DNA, 290 bp, Homo sapiens
gtcttgctatgatggacactgcattccagctcaggtgaagagagagacactgcccctaaaaaaaaaaaaaaatggattggatgggaggaagggtgaggtgggcagagccttgaatggccaggtgggagtgagctggggactttccattctgtggggtggatagggagtcatgggagggtttggtgagcaggccagggattagatagctgaaggcgggatttactggaagccaatgagcagttgggctatgggtccgtggtccactgcggcccatggtggtgggcagtgac

SEQ ID NO: 621223 - DNA, 362 bp, Homo sapiens
attaagcggtagtggacctctctaatagcacatgcaatgctatatgtctatgtccacccatccacatttaatgcgcctatatccacatatatccatataccgttctccaattctatctctttgtgggataagttttagaaaaaaaattccaacctccttttgaccatctaagaacatgctatttagcagatcggaagggttacaaaaaccaagagtcacagagtagcaacattcagacataatggacctaaaagtgaaatgacttcgtctcttatacatcaataatcccacatttgttgttctagactgtcatctcttatactgtatagtgtatatactagtgtagcacaacattatgttct

SEQ ID NO: 621224 - DNA, 232 bp, Homo sapiens
gtatttggtagctgggaggtgaggctacagtgagcagatggtgctactgcactccaacctgggcaacaaagtgagacccccatctctacgaaaaaaaaatttaaaaattagccaggtgtggtggtgcacacctatagtccctcgcagctactcaggaggctgaggtgagaggatcgcttgagcctgggaggttgaggctacagtgagccaagatggtgctactgcactccag

SEQ ID NO: 621225 - DNA, 684 bp, Homo sapiens
cgattacctatacatccagtagccactacatagatagcaatcgtgtactgaacatagtagatagacatctaatacaagattacaacatctgttacattctaagtagtgttcaggcttctgaaggtaaagggacactggatccagaagctatggaaccagcagttgattcttgtattcctgattaacctacttgtaaacttgaaagcaagaccttgatagcaccaacaggtccagagtatgagtgcaagcaaagcagaactctcatgcgtgcactgagcagacaggctggtatttaacaaggtgcctcgtgttgagattacgctgccttaatgtaacacagtctggcagttgctaaatttgtgttcccattttacattgagcaatttaggggtgtgacacttttgagcggttgaatcgggagaatgaagataagtaatttacctgtccaggatcaaaagaagcctagaacagaagcagtaatctacctctgccgataacctgtttaagatgactcagcagaacaccgcgtttcattctattggtcaattccatgtggctgactaggtcaatttatactctgaacaaaagcaggtttttatatgtaaaccgtgagacaagacaggctaaacactatgtacatgtgaatggcaacatggaactactcgtattataaactacaaaaac

SEQ ID NO: 621226 - DNA, 240 bp, Homo sapiens
atgtcggagatctctccgtatgtccctatggtctacaagcttactatgtatctttaaacaaacacataatcaaaattcattaactggagaaacaagatggtggccagtagtccacactctataatgtcgccagtctgcaacactatctctgcttaaaattctgccgtactatcttcagaataaggataatgaattggaaatacgaccatttctttgcattgcccttgatggttacctttt

SEQ ID NO: 621227 - DNA, 276 bp, Homo sapiens
  misc_feature (21)..(21): n is a, c, g, or t
ttttttaaggggggggggggnggggggggtccttttgggcccccggaaaaagggggtttgggggcccggccccccttttttggggggtttttttcccccccccccccatataaaaaaggttttttttggggggggggggggggagggggccccccccggggggggcccaaaaggggcccccttttttcccggggccccaagccccccgggggggggggggggggggtttcccccccccccctttttttttttttttttttttttttggccccccga

SEQ ID NO: 621228 - DNA, 267 bp, Homo sapiens
  misc_feature (7)..(7): n is a, c, g, or t
  misc_feature (46)..(46): n is a, c, g, or t
  misc_feature (89)..(89): n is a, c, g, or t
  misc_feature (93)..(93): n is a, c, g, or t
  misc_feature (97)..(97): n is a, c, g, or t
  misc_feature (99)..(99): n is a, c, g, or t
  misc_feature (234)..(234): n is a, c, g, or t
cttcggngttttaattgttctataaaataaaaattaaaagtggttngggcacctgaggaaggggtacagatgcgtgtacagatgcgtgngtgngtgngngtgtgtgtgcgcgtgcacacctggggacacacgtgcacacagtgtaaggcagatgcagagttgagttctcacgtcctactccaacacagagtagcccctgatacaggccacccatcatccagttgatgacatggngagtgaccgatgggtgcatctgggctctttttt

SEQ ID NO: 621229 - DNA, 229 bp, Homo sapiens
cgctagcggataagtgaacgattcgttaaccactgagccacgatgggaactccaacatatctttattgttgaagagccttccagaagtatattttaggtatctttgttcaggaaaactgtcctctgaatcatgaacggctcctttatggtatttcacataggggtgaatctctggcatcataacaggaagaagatgtcatatggagataacacagatgtgaaagatact

SEQ ID NO: 621230 - DNA, 221 bp, Homo sapiens
ctacagcctcatgctacggaatactagaacatatcctaagagcaggcacagaggggacctaacataagtgaaaggactttggacccaattgatatatcctgacggacgagtcgcgcaccgagagttccccaagtatccctagcttaccgggaaccacggccaggaagaagagagcttaagctctgcagtacccagtgatagaattccggtgctaacactaa

SEQ ID NO: 621231 - DNA, 142 bp, Homo sapiens
ggaccgacggcttattggaactttgttttcttttactccagtaattaaagtaggtacagatctgtccacaacaatattgccctctcatgccttgcctctcaccatgctctgctccaggctcagcccccttttggcctgttct

SEQ ID NO: 621232 - DNA, 152 bp, Homo sapiens
actacgcaactggtacggcggggctgatggggtaggaggaggaggatcccaccgaggaggaacgggagcggaaaccaccggcgttgcccgagagcatgtcggcgaactcggtgatggagagcgtgccggcgcggtacggtgcgttggcccaa

SEQ ID NO: 621233 - DNA, 568 bp, Homo sapiens
cgtaggtcaaagttgcccaatgtcactagctcatgaccctcagatcctggttatcgccacatgtcacccctcaggctcagcgtatccctacaggatcaccccagcagcaccacttcagcatcagcttgccatcctaccctatgatcacgcgatgtgcaaaactctttccacatctacgggtttccctacctggtcacccacatgatccaggacacccccaaggtcacctttccaagcacaggataccctgctgaacagagcaggtggggcagggatgggcaggcaggagcccggagtgccaggatggtaaattcacggcccatcaaacagctgaaaactccaagcgctggggacggcaggacagtgaatcacagacccagaccttcaggacatgaagtcagggcaacttatatttacttgaacaagagacatgccacacagcacgatctctcctctccatcccatcccaagcttcttgtccacgactacccagggtggggacaaaaggcaatggcccaagccccgattaccttgggggacttcagtgtgcctcctcagtcccacgcag

SEQ ID NO: 621234 - DNA, 120 bp, Homo sapiens
cacgagcgcccaagtggcggaagctcttgtagaggctgatgtcttctttcacggcagttggcgcattagtactgccaccaccaggccgctacacgtcgatcatgccagccactgatccac

SEQ ID NO: 621235 - DNA, 466 bp, Homo sapiens
  misc_feature (84)..(84): n is a, c, g, or t
tcatgggcccgcttcccccatgctgttctcgtgatagtgagtgagttctcccaagatctgatggattacaagggctcttccccntaccctcctcactctctcgcacctgccgccatgatctgtttcctgaggcctccccagccatgtggaactgagtcaattcaatctcttttctttataaactgcccaatcttgagcagttctttataacagtgtgacaacagactaatacacccacctactcgggaggctgaggcaggaggattgcttgagcccagcagtttgagactgcagtgagccatgatcatgccactgcactccagcctgggcaacagaatgagatcctgactctaaaaaaggaaagaaaagagaatgttgcatcatacaagtgtggctctctgcctttgcagccacacaattacatctgcctcagagtgagcctgattggagggtcgaaagcagacat

SEQ ID NO: 621236 - DNA, 170 bp, Homo sapiens
agaggaccgtcaattctacacaacatttggattagataactacattttacttgatgtctaaagtgattatcttttttcccccccagttagtcttcaatcttttgggtttgaatgaagggttacataagaaattattaaaaacaaggggggtgggtaataaatgtatataa

SEQ ID NO: 621237 - DNA, 360 bp, Homo sapiens
aagcttatagtgcaattaaaaaaaaaaaaaagaaaaaggttgacccagcctgtcactcttcactcagatgccatgaaagacttcatcaccagacagtccccacactcttgccactttggcaggacaggctccatgacagaggattttccactctgtggaattataaagcctatctctttccccatgtgggcagagagaaattatgaagtcacttgagttgcctggacaagttactcccaattttatagctgatgcgaggtgaggagtggacagaatgggcgggaaggaatagtaacaatttaaatactgcactaatgggtttagtacagacttgatttttcccaaatattatctcacagg

SEQ ID NO: 621238 - DNA, 337 bp, Homo sapiens
gcccatatttcctgggtggtcgccctatcctcccgactttgcttaaaaccacgtggttcgatggctgccgcgggtacgctgaggctctccgctcagatcctgccctggatggatcagcggacaacacacagaccggtaatttgggtcaatcagttttgccatcccccccagaacagaaaacagcatgaaaaactccctttaaccccctatgaatccatttccaaccagagtgatcagcactccccccttcccaagcccctacccgccaaattttgaaaactttgatcccagaatgctcagggaggctgatttgaataataaaactcctgtttcccga

SEQ ID NO: 621239 - DNA, 594 bp, Homo sapiens
cttgaacctccgcgcgttgccgcccgccctagactattggatccccgggcttcacctcatgcaagcttgtgtcaacctcttggcttcaagtgatcctcttgcctgggctcgcaagggtgctggggttataggcataagccactgcattgggtatgcacggaacacatcacttgcagtttaggcacatctcaatatgagaataacttacatcctctgttaaacccagttggggtgagataaacacagcctccttactgcacattcggtacaatgagccagtgtcttatgtgcttcctgtatatactctcacttaatactgaaaatcagtctcggccaggcatggtggctcacgcctgtaaacctagctctttgtcagggcaaggtgggcggatcatgaggtcaggagttcaagaccagcctggccaacatggtgaaaccccgtctctaataaaaatacaaaaaccggccaggtgtggtggtgcacgcgtggggtcccgcctgctaggctgagtcaggaaaatcactcactgagacccgacaggcagagcttacattgcagtgagccgagatcactcggctgcactctgggctgca

SEQ ID NO: 621240 - DNA, 246 bp, Homo sapiens
caaaaaaaaaaaaaaaaaagaaaaggggaaaagaaatttccacctgtgaaacgcctggggatatagaaagatatgtccccccttatatttggcccttttgggtccctgagactaaaaaagtttcccagaccaaagggaatgaaggaaagtgtaaatattggtaggtttttaaaaaagggacttggacccttttttcccaggggaggatggggatatatggcaaaaaaaataaaagtcctaatttta

SEQ ID NO: 621241 - DNA, 91 bp, Homo sapiens
tccaaaaattaagtcttttacctactttttttaaccagttgtgtttaaaaactttttatttccctgtgtctttaaatatttctttcattgt

SEQ ID NO: 621242 - DNA, 111 bp, Homo sapiens
cttttttatgctttaaatttacaaaatttcatgattagacaaggcactcttacttcttatctcatttatttaatcctcataaaaaccctgtgagggccagtgtggagagag

SEQ ID NO: 621243 - DNA, 377 bp, Homo sapiens
  misc_feature (8)..(8): n is a, c, g, or t
  misc_feature (13)..(13): n is a, c, g, or t
  misc_feature (67)..(67): n is a, c, g, or t
  misc_feature (112)..(112): n is a, c, g, or t
  misc_feature (185)..(185): n is a, c, g, or t
  misc_feature (284)..(284): n is a, c, g, or t
cactaggnccggngcgtggtggctcacgcctgtaatcccagtactttgggaggccaaggcgagtggntcatgaggtcaggagatggagaccatcccagctaacttggtgaancttgtctctattaaaaatacaaaaaattagcgggcttggtggcatgcaactggtcgcccagcgtgggcgcagnagcaagactctgtctcaaaaaaaacaaaaaccttaatacggctgggcatggtggctcacacctgtagtcccagcactttgggacgctgaggtgggtggntcacctgaggtcaggagttcaaaaccagccttaccaatatggtgaaacctgtactggagactgtcataaagatctcagtgtttgttaggaaat

SEQ ID NO: 621244 - DNA, 155 bp, Homo sapiens
aagatacagccacatagacagcagtatgtcaaagggaagaaccttgtcaaaacccatctcttaatctactttgtgtgtcagtgataaggaaggaagaaggtcacagtacagtatacttcacgaaacatcatccactcgaaaaagtgtctggaaca

SEQ ID NO: 621245 - DNA, 196 bp, Homo sapiens
ctcttgagtatcccctgtatctgcccaggccattcagagagtttcagaacgctcaccgacagctagacgataaaactgctcaggtagaagattttctgcagtttcgtttatggtgcaagtggcccacggatgtcatagtggcaaacacgccgagtgacagaactagcttcagagactgcacagcatgagccattga

SEQ ID NO: 621246 - DNA, 213 bp, Homo sapiens
cttgcaaatacggtttttgtgttgaccataaattttcgtttgtcttccataatcctggaatgagattgctgggtcatatagtaagtgtggttaagcttttcagaagctgctgaacttgccaattgactgcaccattttgcattcccacaggctatgagtgagtgtataggttgctccacgtcctagcaagcactgagatggccaatatttttt

SEQ ID NO: 621247 - DNA, 1038 bp, Homo sapiens
  misc_feature (1010)..(1010): n is a, c, g, or t
taggcccggccaggagttaatctgggccctggggccgcctccagtgtgtacgtcgaagtgccttgttgaacatgatcatgccctggatggaatgatggagctgcctgcgagtaaggcgcgagctggaacaatgctggctgcgtgcaagtgcaggaaccggagtgaaggaactgacctgacttcctgcagtgctgtgagactgacaaactggaagatgagaaatctgggctgcagcgagagattgaggagctgcagaagcagaaggagcgcctagagctggtgctggaagcccaccgacccatctgcaaaatccctggaaggagccaatggagggggacacatggcagtaccagtggcaccagcagaccaacagccaccctgccggcctgtaccttgtatctccctttccccagggcctgtgcttgaacctgaggcactgcacaccccacacactcatgaccacaccctccctaactcctatcaaccccagcctggtctacactaccccagcactcctgagccttgtgcctcagctcatcgcaagagtagcagcagcagcggagacccatccaatctgacccccatgggctctgcaaccaatacatcgacatatgaagaggctgccatgagccactaagtaccctgcagattgccaaccctaaggccaaatgtcaccatccaccataacacgcacaagcggtccagctggcgccttgtacgagtatccgcagatccaactaacagcaactatcttactccatacgctctaattgagacttgaccatattggtgcattcaacagtagagccaagatatgggggcccaccaaaatgcatgccccaagagggaagacatctattgcaacatgggacaatacaatatggcaagcaaaaataggggaccataacattcaaggaagtacgaaaaagtaatatacccaagtgtgtggatgccatgaataggaatgtcttgtgccatgcccacagagagcactattggatgaaattccngttaaagagacgcccctctggggagccc

SEQ ID NO: 621248 - DNA, 166 bp, Homo sapiens
gcattcttgatgcgctcggacgtgcctttgagcaccagtgctggccagcaggaacgccagcagttggacgacggcgtgcgatcacggcccagtacgtattaagtcgagtaacgttgatcgagataggcaatcacgttgctcggccggtaatggcagaaaaccgacg

SEQ ID NO: 621249 - DNA, 1049 bp, Homo sapiens
gtgtactcctacgacaggtaaccaccttgttaggtacgcgcgatcgggggcaaggcaccagaaggaacgcgtcggcgacacgcaggctgtgctctagtgcaccatgcggtgggggagcgagcgacgaggagcgaacgtggcatgggaccgaagagctgaacgacgaagaggtcgtcgagacccgaggattgggaggctctcattcatagcatgggtgctccttgacgcgtccgtagaaagcgcgtacgagctccattcgactcgtatggcggaagggtggcagcggtgtgtcttgcatgtcacgggatggagacggctcccacattgaacgcccaagtttgccccacgaaggtaggagcacgccgcataagttgagcgctatcaaggcgcttcgcgttgaactggtttcgcagcgaaatggctcctcccaattgttcgcattaaggacgggtttcgtaacgttcacgcggaagactgcgtactctggacgcccttgggagtcccccctgtgagcagtgccacgttggaagcgtttgggctagaaaggaaccgcacgcgaggattctgaggccgactatagggaacgccaaagtagtagccccaggaacgcacctgccggcgtacgtataccgggcccttagggtggtacgcacaagtagggcccacgcattagggggatacagtggcgagtaatgttggcctctacacaaaggtgtcaaatgggacagtcggttggaggagccagggcgatgccacaggacggtggaaacattcccgtcccggcgacgcttgggtacttgagctctcattgtgacaatccatggacccggggacagggcggagcaccaagggagacccagactgtgagaccgcaaggcatcgggaggagattccaacaggcgacctggacggggtgaccaccccgcctccacgcacgggaacactcgggccacagaggaaaaatacaagagggacacccctgcaacccaggacttaggatgcagacggtaagcatgcgcaagaacccaacccgcaaacaaccgcggagt

SEQ ID NO: 621250 - DNA, 470 bp, Homo sapiens
agaatagtcagctatgcttcaacgcgttgggatgctctcccatatagtacgactgcaggcgagcgcgaatatcactagtgatatcctgagacagagttgtgcaacgcatgtgtgccagaaccatcagactcctcagatatagcctcaaatacctggagatgtagaagtaccgtggagggactcaataagagggcaagcaaaaagattgctagaagcctgtatagctatctggtcaggatgaacccttagccaaagttcttgaggaacacaggtctataattcctgaagggacagttcagtttgggactctattagcgtatcagtagtaatataggctgctatgcaatacatttaaacattcatagggaaaatctctttgagcaggctataaataaagctgtagcaggtagggaagaacaggaactgaaaatgggaaccaggaagtgagatctcttggcaaagggaatagt

SEQ ID NO: 621251 - DNA, 109 bp, Homo sapiens
taccctgtgtagtgctgtgtaggatcatcacgttgtatatcaggttcattacaaagtggtaggaaattgatatgtgtcaaattgtttattgttgtggcatcgataaaca

SEQ ID NO: 621252 - DNA, 114 bp, Homo sapiens
cctctcagtataaaatggatgttactgtaatagatacaaagattttcagattctacttcaaagactcctcctcaagaagaattacctactcgagtgtcatctcctgtatttgga

SEQ ID NO: 621253 - DNA, 338 bp, Homo sapiens
  misc_feature (85)..(85): n is a, c, g, or t
  misc_feature (222)..(222): n is a, c, g, or t
  misc_feature (228)..(228): n is a, c, g, or t
  misc_feature (238)..(238): n is a, c, g, or t
  misc_feature (254)..(254): n is a, c, g, or t
aggcgggggggaggtggcgaggggggggggagggtggcgggcggggcggtaagaaagagggggggggcgggggcgtgtggggagncgggggggatgcgaggaataagggccgtcgtccatatatccaaacagcaaggcataatatttggcccggtaagccaatcactttattgggtgctaggcggaggcctcctcattttaacctgaatgggggggcaaccngtaagntacccttttnccatcatggggcaagnggcatcgggactatacttcccaacaatcctaatcctaataccaactatctccctaattgaaaacaaaatactcaaaggggccta

SEQ ID NO: 621254 - DNA, 331 bp, Homo sapiens
ataattgatctctatagaggaagtgtcacgtcactacggtccataggtttgtccgaagatgtcatctcattctatgttacagaaaagattgatgggaaactgcttgtacagctaacggacgaaatcctctcagaggatttccacttgagcacattgcaggtgaagcagataatgcaatacattaatggctggaggcccaaaatatagccaaataaaccccggccagaatgatacaaaactgatcaatgcgtgtgctcgagggggtgggctgggacacaataccatgtacccgcactaaacaccttctctgtaaactagggataagaagaaa

SEQ ID NO: 621255 - DNA, 280 bp, Homo sapiens
agttatcaagcctcgatagtaaacttctgtctaccaaaaatagaaaacaaaaaattagccaggcatggtagcttgtgtctgtagtcccagctacttgagaggctgaggtggcagggtcacctaagcccaggagtctgaggatgcggtgagctgtgattatgccactgaactccagcatgggccataaagcaagatctgtctcaaaaacaaacaaaccaaaataatgatgatgatggtgatgatgacgactgcttggattacaaggagggtaccgagctcg

SEQ ID NO: 621256 - DNA, 422 bp, Homo sapiens
ctgtcacccaggctagagtgcagtggcgcgatctcggctcactggaacctccgcctccagggttcaagtgattctcctgcctcagcctcccgagtagctgggactacagaagcccggcaccacgctcagctaatttttttgggtatttccaggagagacggggtttcaccgtgttagccaggatagtgtcgatctcctgaccttgtgatccgcccacctcggcctcccaaagtgctaggattacaggggtgagccagcaggcctcgctattttttaatttttgtaaagacaggtgtctccctgtgttatccaggcgggtctcgaactcctgggctcgagcaatgttcccacgtccggcttccaaaatgtggggatcacaggcttgagccatcgcacagggtcctctctgttcctttcctttc

SEQ ID NO: 621257 - DNA, 752 bp, Homo sapiens
gagcgggaggaagggacgtctggtcaacagcatctcttggtgctaccaggtagcatagtaagaacctcagccttggggcttccagtcccttcctcatcacctccaagacacatcagtagccagatatctcggcgttagatggtatccagagcccatgagaatccagctgtgctgccgtattgattggccgtctgcagctccattccatagacttgcaatacatccgcagcatgtccttcagtccgtgctttgtgagatgcaataagctcaagaagttggtgtccttcctcctccacagcttccttgagagcacgaatgactgtctacattcaagtataaaaactcaagtgtgtctccagatacagtttaaggtcatccatgctctgctttagggggagtccaattctctgtagtttccatggcttcatttaacgcattgcactgagttcatccaggttagtgtacaaagcccgtcgtatgatagtcccatatggcttcatagtagtctaggtgctgacatatctagcatcagtttctgacattaacagctgatttagctggccagaatggctcatcattatatctcgaaagagatgacagctcctttactgactttctcaatcagacataacttctcaatgccacgcgagagggctactggcactcctacatcagcaacgcatgtcagctcaggggacccagatttcaatgctctccccctaagtgacagaggctatgtacaataacataac

SEQ ID NO: 621258 - DNA, 593 bp, Homo sapiens
tggctctgtgacagacaagcctctgtgtgccatatagagtggcggtgggaagggaggcagactgcactctcgcacactggtggggcaaggaaatccccactcttgcatacatgtgccagcaaagtgatgtggggagttgctgtgggcccagaggaagctgcagtgtaaggagggaatgtgtgggctggtgcatggctacaggggctaccttgctgaaactctctggcagtcaggcacggtctgtcagtgcagttggtgtagtgcaagccttcagggaacctgagaatgcccagcaagcaagcatgggtatgctggggccttgggagaggccagcagaccaaggggagctcaagtcggaccgcgctcatctgatggggaagaccaccctgttatggctaaagtctcttatgggagcaagttgagcctagatggatggccgaccctatatttgttccactacggatgcgttcacacccactgtgggctctacataacctgggttgctgctcctaccatatctctcagcagagcccctggcctagagtgtgcacagtgattgagaggtcgtccttttgctggggttccagaggccc

SEQ ID NO: 621259 - DNA, 134 bp, Homo sapiens
tgtgctggttagtcttcattgcccccacaagtcctgcgcctacccgccgtcagtattgatcattctatttccccctcttttgattcccactgcgtaatatctcatcaccaaacgactaatcaccacccaacaat

SEQ ID NO: 621260 - DNA, 125 bp, Homo sapiens
gtatctcagactcctggctcaagtcatctcccgctcagcctcacaaagtgtgggattacaggcgtgagcaccacgctccgcctcctaatctttactgtattacctactgggcaatggtggtatag

SEQ ID NO: 621261 - DNA, 2361 bp, Homo sapiens
gtggagcagaagccacagtcacttcctgaaggcagcggccccagctcgggtcccactcatcccatggcccatcacctgcctgcagccatggagagccatcaggacttccggagcatcaaagcaaagttccaggcctctcagccggagcccagcgacctgcccaaaaaacctccgaagcctgagtttggtaaactgaagaagttctcccagcctgagctaagcgagcacccccagaaggccccgctgcctgagtttggtgcagtgtccttgaagcccccgcagcctcagttcactgacctccccaagaagcccccgccgcctgaggtcactgacctccccaagaagcccccgccgcctgaggtcactgacctccccaagaagcccccgccgcctgaggtcactgacctccccaagaagcccccgccgcctgaggccactgacctccccaagaagcccccgccgcctgaggtcactgacctccccaagaagcccccgccgcctgaggtcactgacctccccaagaagcccccgccgcctgaggtcactgacctccccaagaagccgtccaaactggagttgagtgacctctccaagaagttcccacagctgggggccactccgtttccaaggaagcccctgcagcctgaggtcggtgaggcccctttgaaggcctcgctgccggagcctggtgcgccggcccggaaacccctgcagcccgacgaactcagtcaccccgccagacccccctccgaacccaaatccggcgcattccccaggaagctctggcaacccgaggccggtgaggctaccccgaggtccccgcagcctgagttgagtacctttcccaagaagcctgcgcagcctgagttcaacgtgtaccccaaaaagcctccgcagcctcaggtcggtggcctccctaagaagtccgtgccgcagcctgagttcagcgaggccgctcagactcccctctggaagcctcagtccagcgagccgaagcgcgactccagcgcctttcccaaaaaggcctcccagcctccgctgagtgactttcccaagaagcctccgcagcctgagcttggggacctcaccaggacctcctcagagcccgaagtcagcgtgcttcccaagaggccgcggccggccgaattcaaagcgctctccaagaagcccccgcagcccgagctgggcggcctccccaggacctcctcagagcccgagttcaactcactccccaggaagctgctgcagccggagcgccgggggccaccccgcaagttctcacagcctgagcccagcgctgtcctcaagagacacccgcagcctgagttcttcggtgatctccctcgaaagcctccactccccagctccgcttccgagagctcactgcctgcggccgtggccggcttcagctcccggcacccgctcagccctgggtttggagccgctgggacaccccgctggaggtcaggaggcctggttcacagtggaggggccaggccaggcctcagacccagccatccaccccggcggaggcctctgccccctgccagcagcctgggacaccctccagccaagcccccgctgcccccggggcccgtggatatgcagagctttcggagaccctctgcagcatccatagatctacggaggacccgctcggccgctgggctccacttccaggaccgacagcctgaagacatcccgcaggtcccagatgagatctacgagctgtatgacgatgtggaacccagagatgactccagccccagccccaagggcagagatgaagcgccctcagttcagcaagccgccaggaggccaccacaagacccagcgctcaggaaggagaaggatccccagccacagcagttgccacccatggacccaaagttgctgaagcagctgaggaaggcagagaaggccgagagggagttccggaagaagttcaagtttgaaggggagatcgtggttcacacgaagatgatgatcgaccccaacgctaagacacgtcgcgggggtggcaagcacctcgggatccggcgcggggagatcctggaggtgatcgagttcaccagcaatgaggagatgctgtgccgggaccccaaaggcaaatatggctacgtgcccagaacagcgctcctgcccctggagacggaggtgtacgatgatgtcgacttctgcgatcccctggaaaaccaaccactccccctgggacggtaagaccggtaggcgtggggccaggacagccagccagcccagcgcccgctcacccaggagccctggatcccggcgcgggaaaagtcacagaagcttgctgggctttgtaccctggccacataaagccccagtttaaagcaaaaa

SEQ ID NO: 621262 - DNA, 368 bp, Homo sapiens
actctagcaggcaccatacgtgactcactctgaagaaaaagagtcggtgcaatgtgggtacgaagactgctacgtacgactattgtagtcatgtcagaactgatcacggtgtacctggctccgttacagatgaggctgtgtatgctccttccccatcacgttgttatcaggagactggtctcttgttgaatccgaaattcttgggtgaaacatacatccgcagggttcggatgagaccaggtgttgcttgttcagtatctcaagcccagaaagatgaattactccttgacggaaatgacattgagcttgtttcaaattcagcggctttgattcagcaagccacaacagttaaacacacggatatcagg

SEQ ID NO: 621263 - DNA, 951 bp, Homo sapiens
  misc_feature (34)..(34): n is a, c, g, or t
  misc_feature (74)..(74): n is a, c, g, or t
  misc_feature (349)..(349): n is a, c, g, or t
cctccaggcgcagttgtcacgcctttaatcccancactttggaggccgaggcgagttgattccctgagttcagnagttcaagaccagcctcgcccacatggtgaaacctgtctgtgttaaaaatacaaaaatcagccaggtgtggtgatggacacctgtaatcccagctactcgggagcctgaggtaggaaaatcgcttgaacccgggaggcgaaggttgcagtgagccgagattgtgccattgcactccagcctgggtgacagagcaaaattcgtctcaaaacaaaaacacaaaaacaaacaaaaaacagctaccagggtaaaggctgagccggcgggccctgccttnactcggagtcctaactgtccccagatgaagcgccctcagttcagcaagccgccaggaggccaccacaagacccagcgctcaggaaggagaaggatccccagccacagcagttgccacccatggacccaaagttgctgaagcagctgaggaaggcagagaaggccgagagggagttccggaagaagttcaagtttgaaggggagatcgtggttcacacgaagatgatgatcgaccccaacgctaagacacgtcgcgggggtggcaagcacctcgggatccggcgcggggagatcctggaggtgatcgagttcaccagcaatgaggagatgctgtgccgggaccccaaaggcaaatatggctacgtgcccagaacagcgctcctgcccctggagacggaggtgtacgatgatgtcgacttctgcgatcccctggaaaaccaaccactccccctgggacggtaagaccggtaggcgtggggccaggacagccagccagcccagcgcccgctcacccaggagccctggatcccggcgcgggaaaagtcacagaagcttgctgggctttgtaccctggccacataaagccccagtttaaagcaaaaa

SEQ ID NO: 621264 - DNA, 390 bp, Homo sapiens
ttctagcaggatcccccagtcacagtacacttcagaatcctcggtagggaaatgagtagaatacttcagtgcagattcctcgctctacaggattgcctaggaggacactgtcctcagtctttggggctagaaggttgaagagaagtaaactttgactgaattatccttctcatagagtttaacaggcacagtggaaattcctaggccgatttcactctcatataacactgttggcaggagaatgggtagcatgggagagtatcagcgataccagaatctgaccagaaggacaatgtacaagaaaaggtagggactttctgaaggcatttttggtggccgttggtggggattaggtatacagcacagattagactgtacaaaaagactaaa

SEQ ID NO: 621265 - DNA, 275 bp, Homo sapiens
agtgagagagaacggacgggctgctgagaaggcaggttaagagccaatgctcaggtttctaccttgggaaaccagggagatgatgctgtctatttactgctaagagaaaaggagaaggtgaggtagtttggggtggatcatatctgagatattggggccttgactcactgaaaggactgtccagctccagagtgtggctttctttctgaaggattgtgagctccagctcccctctgggcatctctacatgatagtcttcagatccacaaacccag

SEQ ID NO: 621266 - DNA, 134 bp, Homo sapiens
agaacattcttatgaaggagataggtcctcttctgagtttgccataatatagattggcgtcttttgaaaatggccacacttttaagagtcaattatgcatatataagataatcatttgaatccacagtaccaga

SEQ ID NO: 621267 - DNA, 504 bp, Homo sapiens
cgggtccaccagagatactaatggcaccctgagcaaagacgaggcagcagtgcaccaggatggcacagccaacgatacagctatgccattctcatcatctatgccatcaactcctctccaggccaagaagatgaccctcagcgagatttcacgctaggctctgtgataacttcccctatgaccagaatgctggcataggttggaagaattcaatacggcacaacctttctctcaacaagtgtttccggaaggtgccagacctcgggatgaccctgggaagggttcctattggaccaattgacacctgccctgacatttcccgaaagagaagagagcctccagatgatgatctgtcccaagactcaccagaacaggaggcaagcacgagcccacggggaggcgttgcagggagtggagaagcctcactgcctcctgaggggaatccggagatgttacttcagagccccacatctatagccagctacagccagggcacaggatctg

SEQ ID NO: 621268 - DNA, 245 bp, Homo sapiens
tgtaggtggagcccagtgacaccatcgaaaatgtgaggcaagatcaggataaggaaggcgttccccccgacagtcagaggctcatctttgcaggcaaggcagctggagagatggccgtactctttctgagctacaacactcccagaacggacgtcgagccctgtgcacctggttcctgcggtctgagaggtggtatgcagatcttcgtgaaggacccctgtgagccggtcgaagcacccagtcca

SEQ ID NO: 621269 - DNA, 376 bp, Homo sapiens
  misc_feature (5)..(5): n is a, c, g, or t
  misc_feature (9)..(9): n is a, c, g, or t
atgtntgangttccgaataaagtatgttggtgccatcgagaaactggccgtgtctgaggggaagagccttgaaggaccactagacctgataaattacatagatgtcgcccagcaagatggaaagttgccttttgtgcctttggaagaggagttcattctgggcgtttctaagtacggcataaaagtctcgaccacggatcagcatggtgttctgcataggcatgccctgtatctaatcatccggatggtgtgttacgatgacggcctgggagcttgggaaaagcttgctggcactcaagaccacagatgcaagcaacgaagagtacagcctgtgggtttaccagtgtaacagcctggagcaagccccaagcaatct

SEQ ID NO: 621270 - DNA, 670 bp, Homo sapiens
ttcgtttttgaaataaacagtctttaactatcagtcacaaacctatacacacacacctgggtacttataaaaactaaagaagaaaactactgaaaataaaaaaattcaaaaaaattatcatctatataaaaaaaaccctttgggcccgtttcgcccaagacctttttagactggccaatttttttcattgggcccaattttggtctaatttggccaattcccccttaaggggggccttttcaaaataaagtgcccgtttttaaaaacttttgttccggaaaaaccctgggtttccccaatttaaacccttttgaaaaaattcccttttccccagtttgcggaaatcccaaagggccccccacggtcgccttttcaaaacgttgcccacccttaatggcaaatggaaattttaggctctaattatgtctaaaaaatccggttaaatttttgttaaaaagcgtttttttttacccaaagggccgatttcggaaaaaacctttttaaataaaaagtattcccccaaaattggttgaagggttgttccaattttggacaaggactcccttttaaagaaagtgggcttaaacctaaaagggaaaaaaccctttttatggggtatggcccctttggggcccttcccctttacaaatttttttgggactgggccccc

SEQ ID NO: 621271 - DNA, 1057 bp, Homo sapiens
gaacgcatggctctaaccctgtgcatccggttcttccggggtcctctcgcgggaaatccaggggccttgttcgtcacggaaacgttgggcacaattctgctggaattgatggtaacaatcacattattgccgtggaagatgcagacgtcagccttagttgttgccatcagctttcttcgatcctgtggaacagctggtcagacggtgtacccactgcgaggcgactgttaatacatgaaagctatccatgatggaggtcgtaaacagacttgcaaaaggcctagtgcacagatcccgagtcgggaacccatgggaccctaatgttctctcatgggccactccacaccaagcttaggcagtgagcatgtttcttggagcagtggaagaagcattagcaagaaggtggtcacagtggtctatgggggcaaggttatggatcgcccgtggaaatttatgtagaaccgatcaaccgtgacaggtcttggccacgatgcgtccagttgcacacacagagacttttgctccgattctctatgtcgtcttaaattcaagaatgaagaagaggtcttagcatggaataatgaagtaatacagggactttcaagtagcatctgttaccaaagtatctgggcagaatctttcgctggcttggacctaaaggatcagactgtggcattgtaaatgtcaacattcctacaagtggggactgagattggaggtgcctttggaggagaaatagcacactggtcggtcgcgacatgggagatctaggcacgtcgatgcgctcggaaactagtacgactgtagagacggtgctaatctctgtagcgtatcgaagcgtaacagtagtaagagccttcctactggcacaagggatcaagctgcagtaaaggtgttttagatgaacatcccattaatttgaggtgttccagcagcagtttctggagaagacaaagaagattaaagttgtacctgaataaatgcattagtatgagctgtgaacagtgactaatccccctatgacccctatagtacctgattaggatcaagagattcc

SEQ ID NO: 621272 - DNA, 225 bp, Homo sapiens
ccggcccgtaggcatggattgaatgatcgctgatcgcacgaagattggtcaagtcatgtacgcatgcaagtgcatagagtaccagtggagtcgaatattatacatattatcagcgccccatacgatattatagttctacatactcggcgtgctttcattctcagtgattcatccctattatttttacatcacatgtcaaatgtagctcagcaggtttcaaacaac

SEQ ID NO: 621273 - DNA, 102 bp, Homo sapiens
aaagaagacctacatggaactgactcgtctgacatctgacgacacagccctgtatttttgtgcgagagagcaattcgactttgagaactcctttttaggcta

SEQ ID NO: 621274 - DNA, 171 bp, Homo sapiens
acttttctctcattctttgggttttcttttcattttcttattgaagtacaaatgtttttaataattttgatgaggtccactttgtttcttctttgtttcttgtgctgttcggtgtcatgtctaataaatcattgcctaaaccaaggtcacaagagttattcctatgtgttc

SEQ ID NO: 621275 - DNA, 176 bp, Homo sapiens
tgcctacctcgacccttcacacgatcctgatagccagtcttgggactgagcatagtgctcggatccatgtattacgaggcccaggaccttgattgccaaagaccgtttactatgggggagactggtgacagggcaagtacagaccccttatgtcaaaactaaagatttgcagagac

SEQ ID NO: 621276 - DNA, 852 bp, Homo sapiens
gcgcctcgtggttgtttggcggcgctagcgcccctcttgttggtgatccctgtctcccggggttttcttttatgcgccgtgtgtcactgcgatacgtccagtgtggggtgttcgccggcggtgtcctttggggtcacaactttttttgtggtgtgtctgttgtccccctcctcttttcggtgtcgcaggggtttctcctccacacgatgtggtgggcggttgccctcacgacaccgtccacgccaagcaacggggagctacgaagtccgtggttttttcccccaccaggggtatttctggttcgcgtcggtgcttacagttgggggtgacatcacagaggctctttctttagtgggttggttcgccccccccgctacgttcggtgactcatccccgccctggtcccttccgggtgtccttggtgccccagcctcctcttgatcagccgccgctggggcggctccccccccccgtgttatagtggacatctggcgccattcttacgatggcgccgctaggttggtcccctccgcgctctacatgtctcgggggcgcccgcagaggtctgattctccccctccgccggcttcattaggtgcgccgcggtgcatttcgcccggatcgtcttgtatatccgtcgcgcagagttctctcccacatggctgacaacacaccagcttaatactatacccatcgctgccacaattcagtaattcccctgcaccccgcctccatgttaccattgttttcctccgtcccctcatctttctctgtcgtgctctttctttctatctctcctgtttcttcttacagtctttatcaaaaatcagacaccaacaattatccaacaaa

SEQ ID NO: 621277 - DNA, 450 bp, Homo sapiens
  misc_feature (46)..(46): n is a, c, g, or t
  misc_feature (50)..(50): n is a, c, g, or t
  misc_feature (70)..(70): n is a, c, g, or t
  misc_feature (86)..(86): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (103)..(103): n is a, c, g, or t
  misc_feature (158)..(158): n is a, c, g, or t
  misc_feature (182)..(182): n is a, c, g, or t
  misc_feature (211)..(211): n is a, c, g, or t
  misc_feature (215)..(215): n is a, c, g, or t
  misc_feature (241)..(241): n is a, c, g, or t
  misc_feature (244)..(244): n is a, c, g, or t
  misc_feature (252)..(252): n is a, c, g, or t
  misc_feature (285)..(285): n is a, c, g, or t
  misc_feature (386)..(386): n is a, c, g, or t
  misc_feature (392)..(392): n is a, c, g, or t
  misc_feature (395)..(395): n is a, c, g, or t
  misc_feature (405)..(408): n is a, c, g, or t
  misc_feature (413)..(413): n is a, c, g, or t
  misc_feature (416)..(416): n is a, c, g, or t
  misc_feature (420)..(420): n is a, c, g, or t
  misc_feature (443)..(444): n is a, c, g, or t
cctgttggataatggatggatggatggatggatggatgggtgggtnaacnaataaatgagtggataaatnaggggtcagtttttanagtnananaaacatggnaattagactccaatccccaggccccccatggaatagttcccggaatagttttgcnaaagtttcccttattagctataancagccaaaatttagtgagtgttccaactnaaangaggcctggaattgtggctttatttnganggaaaaanggagtcccaaattcccagggcttatttgttganatctatctagggctgaaaaaaaaaaaaaatagcccccaatcccaaatgattgtgcagtcccatgggaccccctgcccagttccttgaccagtgtccctcanacaaanggncccttattannnnaaaangtntttnttgtactgaataaagttttaagnnccaggg

SEQ ID NO: 621278 - DNA, 596 bp, Homo sapiens
agagtatccatctaagatggggttgcaaagcagattacttgaaggcagcatgcatcacttaagagtcatcatcactccctaatctcaagatacccagagacacaaaaactgcggaaggccagcagggacctctgcctaggaaagccaggtattgtccaaggtttctccccatgtgatagtctgaaatatggcctacgtgggaagggaaagacctgaccgtcccccagcccgacacccgaaaagggtctgtgctgaggaggattagtataagaggaaggaatgcctcttgcagttgagacaagaggaaggcatctgtctcctgcctgtccctgggcaatggaatgtctcggtataaaacccgatagtatgctccatctactgagatagggaaaaaccgccttagggctggaggtgggacctgcgggcagccaatactgcttagtaaagcactgagatgtttatgtgtatgcatatccaaaagcaacagcacctaatcctatacattgtctatgatgccaagacctttgttcacgtgtaagactgatgaccctatccccacaattgtcttgtgacacttaacaaaccactgagatggg

SEQ ID NO: 621279 - DNA, 138 bp, Homo sapiens
aatataactacatcatctggcctatcttcatcaatatgtctgtgggactctgtgcatcatatgtattgcatatactccagtcttgtcaatctcgtctcatgtcaattcaattagcagcccagccaaggaacatagagg

SEQ ID NO: 621280 - DNA, 740 bp, Homo sapiens
  misc_feature (41)..(41): n is a, c, g, or t
  misc_feature (76)..(76): n is a, c, g, or t
  misc_feature (192)..(192): n is a, c, g, or t
  misc_feature (200)..(200): n is a, c, g, or t
  misc_feature (203)..(203): n is a, c, g, or t
  misc_feature (294)..(294): n is a, c, g, or t
  misc_feature (329)..(329): n is a, c, g, or t
  misc_feature (357)..(357): n is a, c, g, or t
  misc_feature (391)..(391): n is a, c, g, or t
  misc_feature (407)..(407): n is a, c, g, or t
  misc_feature (409)..(409): n is a, c, g, or t
  misc_feature (453)..(453): n is a, c, g, or t
  misc_feature (457)..(457): n is a, c, g, or t
  misc_feature (459)..(459): n is a, c, g, or t
  misc_feature (462)..(463): n is a, c, g, or t
  misc_feature (476)..(476): n is a, c, g, or t
  misc_feature (483)..(483): n is a, c, g, or t
  misc_feature (533)..(533): n is a, c, g, or t
  misc_feature (572)..(572): n is a, c, g, or t
  misc_feature (591)..(591): n is a, c, g, or t
  misc_feature (598)..(598): n is a, c, g, or t
  misc_feature (644)..(644): n is a, c, g, or t
  misc_feature (647)..(647): n is a, c, g, or t
  misc_feature (655)..(655): n is a, c, g, or t
  misc_feature (674)..(674): n is a, c, g, or t
  misc_feature (676)..(676): n is a, c, g, or t
  misc_feature (739)..(739): n is a, c, g, or t
ttagtgtaatcctatctgtaattaaaaatacaaatgctgtnataagatcaaatgttatcaaaaatcagtatttaanattaaatttacccccaaatttctttcaaaaaaaatttgtaatgttctttttcagtgaagcctttgcactgctagagctgaagaatgtgatcaatcggcttgtggaataatcccgcncagtaggnatnccgctgaagccaactctagctgggggctcgagagcgaaagacacagaaggggccctgccgcccctcgaagagtcggatgggggcgcccgtncccggtgcatcaagaggctggccccgccaggggangcggctggcaccgaaccccgcgcacctngccgcgggcggggctgggccgtagtcggctcganttaaggctggtatccnangcttctgccggggcaggcgaggcgaggcgaggggcgagagcaanggtncntanngagaacagccgcnggcagcncaatgctgggtggctaacgctcgacggtgcccggcagcaacccggccganaccccgacccggatcccgagctgcgttgcggacaatgcngcgggcccgttccggactnacgactnccagacgggctgctgcgaccgctccgggggcggcccagcgtgcacngcnccggccantttgacagctgggcgcccnantcggctagctctgctcccagcaagggacgctggccttctcgcggctttcccccgatgtctctnt

SEQ ID NO: 621281 - DNA, 110 bp, Homo sapiens
  misc_feature (21)..(21): n is a, c, g, or t
ggcacgaggagagagctcacnatgagcttcaataccctgacaatgctatatgctggatgtcataactcatagcctatagttaaacaatgtacagccaatgactaatcaat

SEQ ID NO: 621282 - DNA, 187 bp, Homo sapiens
cgtcagccgcagacacattgtacaatctgacctataccattgaaatgtgaaggagcctttgaagcagcaaagagagagagaaaggagtctttcaccagccattaactcagccattatggttgtgagcgagctcattttctcatatgccagaaatgcttcctagagaaggtgttgcagtgtgcttccg

SEQ ID NO: 621283 - DNA, 419 bp, Homo sapiens
  misc_feature (298)..(298): n is a, c, g, or t
  misc_feature (317)..(317): n is a, c, g, or t
  misc_feature (405)..(406): n is a, c, g, or t
gcgcgcgactggacagcaggagtctgaaaagaagagaaggcggttatgaggtgctggggctaaaagcaaagcaaaggggtagataggaaaggaggcctggattgtttctggggcatccagggaaaggagttgcgagcagaaagaggaccctggcattctgcacacagctagtgcccctatacttggcgatgccatgtagcacagaacagaaaggtttactagggtgggcggcacatgtgacttctcccctagcactccacccggtttgtcacgtagtgtacacgttggaggggtcacncaagatataacgggcacangtgcaaataagaaacacagttgcaagggggacggcaaccaggcccatagcagctcatggaagaagagaaagaattccttcagggtcanntgatcccccacca

SEQ ID NO: 621284 - DNA, 238 bp, Homo sapiens
cacgggccatcacttgaatttatataagcccaggaactaacaaattaatataagcagtacaaacagggaattcaacttaattcaaattaccatctgttctgttctgcttctgttacacagatagctcatgtttgattggtaagtagcagtgacatcttatactcatggaagtcacactgattcatttgagagtttcctaagcgaaagagtgtagggagtgatatgaacatcttacgcg

SEQ ID NO: 621285 - DNA, 116 bp, Homo sapiens
ctgcttagtagtgtgtcccccgtcgactcccttcatacaagagtccgccacaccacggaaattcggggagtactccccagaggttcccagtccggccacgctccctcctcccattc

SEQ ID NO: 621286 - DNA, 530 bp, Homo sapiens
  misc_feature (131)..(131): n is a, c, g, or t
  misc_feature (166)..(166): n is a, c, g, or t
taggcagccatgcgggcggtctcaatgcgtgatcagagaatcttcactttgctgaaagtgagctcagatccagcacatgttctcctgacccatactgtcttatcttctcagttgagttttaatctcacttngggtttcttgtgaagttggagggaagttataatangctaacactagcccagcccaaataggaggaactcctgtttcaagagagatgcctgtcctgtgcttggatagtcagtccattatatgtgtatgacacaatgtacaaatccatgttttgcaaataatgattctcagactttctaagttcaattttacaaatttcgattgttagccatatagaggtgggtttactcttagaatcgcatgctgtagaaatgctcaaaagtgcatattggactccgtccttaggtgttctctttcttttaagaaataacctcttacagttgtaaccattgcgggtcttgtcacttctcgttgctgctctgtggcacatatcggaagcagtacagcgcgcggttctacac

SEQ ID NO: 621287 - DNA, 1183 bp, Homo sapiens
tggagggtggagttctttgcactgtgatcgcccaggcttgttagttgcaatgggcgcaaatcatcaagctcaatgtgcaaagcctccgcctcccgaggttcagtgccattcatcctgtgccttcagccctcccgagttagcgtgggactacgaggcaccttgccacacacacccggcttaacttgtttcagatattgttaagctgagcagaagcgggtttcaatcagtgtttgagccgaggagtggctctgagaatctccgtgaacacttcatggatccgcaccacctttggccctccccaaaggtgctgggatcaataggctgtgagcccaccggtgccgcgggcataatttccgagctcccttatatggcgtgttgaacccactttgtgacccttttgttagcctttttatgcaataatctttctccccaaaaaagtccgtcgacttctgtggtcacacctgggtgtgtgctcttcgagggggaacaaaatttttttccccacccaacgcagagatctgtgttaaaaaaagaccttttaaactaactttgggggcgttggaagaaacttaagttcagagcaagggactatttatagtggggacgggtggctacattaggggaaacagattgtcctttttataaacaggtttaggaacctgtgtgttcttacacaaggggggttgcaaggaggaaggggcaataggatttcatcccgttgattaaaagggggcaaggttgaaaggggtcaagggttccaacgaggctttggggtttgtgacaaagacgctgtttgtaagtaaccttccgtgtgttcacagctttggacccggaagcacctaaatgttgaacattcttatagggggtgctacaaatttggttttgccccggaacaaggaggatgactttgttccccccttatctgtggacagcgagcaaatctgggcctagaggggaaccaactggggggccccactagcgctcttaacagcgtggacattacacttaacttgggaaggttctaaaaccacgggcgtgttcacaacacagagtggaagaattcacgctattgttggcgcgcacacgcgcggttttcctaagcatggtgatgatttacacccgttcttaagatgtaaacagcagtggtggagcccgctaaaatgtgcgcaagcttagcactaga

SEQ ID NO: 621288 - DNA, 245 bp, Homo sapiens
agactggtcacaggccatccccacagataggttcctacagaatagggtagtgtagaccatgtactactcctcctaccacacccctctggaggacttacagctaaccaaatgccctaaaatcctatcagggactcagagcctcagggactaaaacagtagattcaacagacttatcacactatccccacaacacccccgacagcatgccaaccttattgatttcggataaaataaagaccattcaa

SEQ ID NO: 621289 - DNA, 237 bp, Homo sapiens
tcgtcttttgataggcgatggccttggggttcatggcctgggccactttgcccattttttccatcatgaagcggttcatcttgatgtcgttttcttgccagtcgaaggtcatgcgcagcagcggcaggccgtaggcatcgcggtaaaccgggtctagatccaggtagttgctccggtaggactgatgggcaccgtgggaatccattgagacttgatgggtgtcctatcaaaagacga

SEQ ID NO: 621290 - DNA, 1390 bp, Homo sapiens
  misc_feature (522)..(522): n is a, c, g, or t
tccatggttaaaatcggctttttttcaagaagggcttgagatggccagggaaagaaatctccccaatgtgggagaagacaatggcgctgtggaccccttggcatgggagaaccaagggtcttcaggcctcttcctctgattccccagagacctggcgcgggagacagcgtgggagacgccacatgttcactggagagggtgtctcttctggggtgtgggcgcctagggtgtgtgcctgagactctgtgtgcctcttctgggcccacagcgtgtgagactctgtgtgagactctggagagtcactgagaagagtatccgcagagtgttatcacaagagaagatgtctggcgaaagatgagaatgtccattgagcgaagatgggcaaactcgccagagagagcgcccccagaaacggggggagagaatccccacagtgtgtgtgtgtccagagaaatatgcgcaccgtgtgtgcgctccgcacaatgttggcaacaattcccacgggtgggctcccatccaacngtgggtgtcactcacccagagtggacgagactgcgtcgtgtgggagcagtgcggtgtccacacgatgataagggtgagaggagccctcatccacagtgagacagccccccatacaatacacgaagaacttgagcaccagtgagacaacacagactgcgttaacactggcttggtggcaaaaacaaggccgagaacccagacaagctgtctctgcgccaaagcagtaggaaaacacccaaagtgtcgtaaagaggaaaacagcacaacatggggccccagggggccccaaagcgttgaaaaagtggatgtgcaaacagagaaaaggaacccgaacaaacaggtgggccagcgaaaacaccaccacagaccgagatgaaacaagacacagtggaccccaggcggagaacagaggtcgccaaggtagaacaccacggaaaaagtccgccccaacaaaacaaaagggaagacaaaaaaaggccccgggatacacagaacaaccatcgggaaaaagagcaaacaacggcaacaaagagagaaccaactagtcacacaaaggaagaaaccgtaaagcaagtgtaccaaaaattacacgaaagcaaaaatgatgaacaaggaaccgagaacgacaacgacagacaacgaacgtaagaaggaagagaaagagaaacaagaccaaggatttctctcaccaaagagagaacaaagaaccaacggcaaagattggacaacaaaaaaaggagcacaactggaagaacaccacacaaaaagaagacactcataagcaaaaccaaatgatgccataaatatagagataaaacaccccactcaaacacgatagacgcacagaactagtaacatcagaacacaa

SEQ ID NO: 621291 - DNA, 927 bp, Homo sapiens
  misc_feature (567)..(567): n is a, c, g, or t
  misc_feature (579)..(579): n is a, c, g, or t
ggccgcgatcgcaccaaaaccgtgaacgaaggcggcccgggtcactcatagaaaagtacgtacacgcgccatgggcgaagcgatcattccacgacgaaagcaatgcgcgttgtgcgaggagatcgctcattatccccgagctaaaagctccgcatacaagatagcaggttatgtcacgcgatctgatgaagcgaacttcagagagtgcccattacagaggtatctccatcaagctgcatgaggaggagagaagaaaggagagacaatttatgcttcctgaagcctctcagccgcttggcatcaggacgattattgcaagctagcatcctgatgactacaggaaatgctgaacgacttatcggacttcggacagtcatgtccagaactgtcagtgtccactcagcctacagattggtgatgaaatttcgagaaacggcctcgagggaccctgtattgaaacttgttcctctggaagctggctagtataacttcgcaatcaaatctggtgacaacaaaagaaaacgctcaaaatgagttgcggagaggcagctatcatattgaccggtngtgcgtcgccanaacagaggcgtggcattcgacattctcgtgtcgccttggcgccataatgctctgtaccccatgagcgccgtcccttttccttggcgcctaactcgtggcgggtgcacaactttcgaccggagttttcccaccatatttagtgtaggatatgctaccgagagtaaaagaaattccctggaatacaagcctcgatggcggttcatctcctgtggccatttgatgagcagctctcgggcgaaaaaaaccccaaaacgggcggcgccttattagggggcataacagcgcttggttggcgaaaccgccttatccaacggagcccaagttaaccaagttggaaccaggaattac

SEQ ID NO: 621292 - DNA, 344 bp, Homo sapiens
  misc_feature (118)..(118): n is a, c, g, or t
tccgtgtacatcctcaccagtcattggccgcgcaaggtagtagccgagctccagctcgcatgtgcccgctcaggtggcacggctggcctggaccctgcccctgcacggcactggatgntacttcccctctctcttgtcccaggcacagctagggaaaaggatgctctctccaacctcctgtatgtacactgcagatactccatttggaccgctgtggcacacatggccctttagtcctccgccccgccaaggcaccaaggcacgtttcgtgccactctgtctactcattgttgatgagcctgtctgcagccacccagggactgggcagcacaggtccgggagag

SEQ ID NO: 621293 - DNA, 1513 bp, Homo sapiens
cacaggcacagtggtgggtccccgatttgtgtctggcatcgcttggtgttgtgacgttgtgcgccccggccgctcttcggagccgtcgtgatggtgggtgtggttcgtagctcgtctgtggcggcggctgttgttgtaggtggagcgtctggtgtggtgatggcccccgctccccgctgtggtcgcgcggctgtgttggctccccagttgctccccccccctcttggggggtgtccgactagggcgcgtgtcgtcgaccccgttgtgaggggcccccgcttcgcccgtgagagtgtgttaatgttttttctgtttaggcccccccgctcccgttttgtgttgtgctctcctttagctcccccggcggttgtttttaggccttccccgaagacgtgccgccgtgtgtcttgtgggaatgatccacacacggcgggtgttgttgtgagaggccctcctgtgctcgcctagtagtccgtccctcctaaagcgtttgagtgcgggcgccccctttggggaagtttcctggggggccgccccctcctcttgtggccggaaggcaccaccctgttgattgtggcgcccccgcggcacgccaccgagttgtcgttgtccacctgaaggtggggagaggggtggtcaccccccccctttatgggccgcctcttggccacggtttgcggacgtcgtgagttgtcggcagcgcaccgttgtgatgtccttatgaatatgataatggtggggggcccgtccccctcgtgttgaaaccccttctttgtccccacgacgcccctgtttagttgtcccctccgcacggccacccacaggggaccacaccctcttctctgtgagtatgtatcgtctcctccgccgcacttcttcactgggagccccctctggggccactactataataatagtaggagtgttttagtagtctgtcgcacccactcttaggctcacagagagagtccctacactccgcgagaacccccctctgttgcgagcccctctggcccccgagataggggggagagttcccgagaacttagagtgtctcccacggtcgttgtcacacacacttccgagtatttatcgctctctctcacaggccaccccttctgcgccctcatatttcgttacaatataggccgagaatatacaccacaacacacttatatatatatataatataacacacaccctccacccacctaccacacttctttctctataggagaccacacacactatatgagacccacactttctcccgtggaacgtcttaccaccaacacataatgttgtggtccacccgaggacccgtacagtgtttacaccctcccgtggtttttatggaattctggcaccagccatacccccgtattccggctacggacccaactccatcacgcaccgtcctatgtgaaaaacttcctacccctcaccctagccttacttatatgataagtctccataccccgtcaccatctcccagcattccccctccaaccta

SEQ ID NO: 621294 - DNA, 238 bp, Homo sapiens
  misc_feature (95)..(95): n is a, c, g, or t
cggcccatcccacacctcagcttcatgtctgtcccatccctataccatcccaccctgttgtatgtattataggatttgtattttcttctcctccnctcctcttcctcctttctctttgcattcaagattatgaaactttgctgtggccctgcctttccttcacttcttcctgttcaccctggtggtgtatgggtgaggtgggaaggtgaccccccccccaaatatatatcagcccaac

SEQ ID NO: 621295 - DNA, 1012 bp, Homo sapiens
ctgctggatgagacagggcctgaagtcttgcaggactcactggatagatgtgatccaactccttcaggtagtctgaactgcctgactcatgccagccctacagaagtgccttttatgtattggagcaacagcatgttggcttggctgttgacatggatgaaatctgaaaagtagcagaaaaggtggaaaaagaccaagagccatcatgccccgaggcgtcagcagggagctgctggatgagcaaagagcctgcaagtcttgcaggattcacgtggatcgatgtcattcgacatccgtgcaggttggcatgaacgtgcctgacctcatgcgcagacgcctacagaagaagccggaagaacagcagtaggaaggaacaagagatgctaaggacttggcatcctatggacgatgggacaaaaaactggaaaaacgaacagcggggacaagtgagagagaacgcacccagagagagccgatgatgacgccagagagacgtacaagcgaggacacgcgacgatggcgcgggacagcatggaacgcagctggccacgacacgtggcgaagacgaatgtccacgagaggatcacacttgatgcacatccagaacgaagacgcgtaacacgaggatacaaacgcagaaacagcaagaacctaggggcccggaatcacgacagaggcacgtaagcacagtgaagtaagtaccgggctgactaccagacacgtaaggggaagaggaaacgacaacacagattggctgcggggcataccaggcaaccacaagaaccagatgggatgcaaaaaccacgtgggaaacacgacacaagggcacaaagggcaaccaacgcaacacaacccacagaacaccacaacgcaggagaccagaatggagccaaacaacagacgggcatagaaagagatggagacagggcaagaggaaaaggccaacacaacgcaggaggagcgaaagaacaagcgagcgacaacagcagaagtcaacgctagcgcagaagaa

SEQ ID NO: 621296 - DNA, 499 bp, Homo sapiens
aagcaatagagcacggcacacatcgagacctgccgctccgccaagacaagactactagactgggccacggcgtagagtgcacagaggccagctatatgctccttcaaaaactacaacaaaatgcagaccgattcccagacaggcactaaacaatatatgccagtcaaattgtaatccccaaatatctagggttctaatataacatcagatataacagaacctaaatccaaattattacagggttaccgcagaatactactaatgatacaaaaataacttcctatgatatatactcataattaatttatgcacatctaacagcattctctctctctctacacacacacacacacacacacacacacaatcatatagaaacaggaaacttttaacccacctctcttacgtctcttcccttactcatagtaccacagatttgaccacagaatgaacatgtctgctgtagtgcactatagtaaaatttgtacctctatgttct

SEQ ID NO: 621297 - DNA, 250 bp, Homo sapiens
cggcggggttttcccccccaatttttgggccctttttaaaaggtggcaagaaccccctttggggcctttttagttggggaggggccctttttgttaaccccccccggggaccagaaattggcccttggggttaattgtttctttaaaagggccgttttccctgaaattttctatattttttttgtttttatttgaattgcccgttccgggttccttttcccaagaaataaagccgattccgggtttggga

SEQ ID NO: 621298 - DNA, 201 bp, Homo sapiens
ctagctattcaagcctactaataaggtggctcctgttaacctctccacccttatcacaacacaagaacacctcctaagttactccggccatcatgacctcaattatcgatgtcgggactcctctagtagttcgcacctgtgaggtcttgcagagctgtggcatcttgtgcctgatcgtttatcacaacgtccgttgtacgt

SEQ ID NO: 621299 - DNA, 148 bp, Homo sapiens
tggtccggtaatatagcttcttgtctttgaagagttccgccttagtaattcagtcttatatccggggttggaaggctcgaaaaattctgcgggaactgaagcatcaagaagcgctgtaaggaagcagtcacgaccattgctgcatatt

SEQ ID NO: 621300 - DNA, 399 bp, Homo sapiens
  misc_feature (89)..(89): n is a, c, g, or t
ccaccgtgccattcctcagcgtgcaggaaatcagcctcttctgagtagccccatcacctttttttttttgggacagagtctcgctctgntggcctaggctgaagtgcaggggcataatctcggttcattacaacctctgtctcccacattcaggcaatgctcttgcctcagcttcttaattagcttggaactacaagtgcgtgccattgtgcctggcttaattttggtataagtagagatggggtttcaccagtgtggccaggctggtctcgaaaccccgtaacctcaaagtgatctgcccgctttggcctcccaaagggctggaatgacaggcgtgagccacaacccttggcccttcatccatctcttaatccttgagacctggttgtcccttaccca

SEQ ID NO: 621301 - DNA, 190 bp, Homo sapiens
ctactcctgcaattgtacccattctaattcgcaattggcaattccttaattgctttaccggaacgataaaattgctagtgcttattagttacgacttacgcgaagagtgcccccacacgtttgttagtgcccccttacgggccttacttacgaacccttttggccttggcggtccaattaaagctttttc

SEQ ID NO: 621302 - DNA, 1352 bp, Homo sapiens
tgaattcccgggatcgggggccggcgggggcggtgcagcgataaggcggtggcggcggcggtggctcggggaccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcagaagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcaggggcaagggaccattgcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccactggggcttgggaccatctcgaaccaccagcgtggagaagcagaagcaaaagcactcgccaggctgcagcctcatgcactggcaggggctggtgcggacccactcccctcccccgctcccatttgtgcccatcctgttgtgaccaaccccgttttaaacatgtttcaatagaaaa

SEQ ID NO: 621303 - DNA, 949 bp, Homo sapiens
  misc_feature (23)..(23): n is a, c, g, or t
  misc_feature (48)..(48): n is a, c, g, or t
  misc_feature (68)..(68): n is a, c, g, or t
  misc_feature (122)..(122): n is a, c, g, or t
  misc_feature (257)..(257): n is a, c, g, or t
  misc_feature (260)..(260): n is a, c, g, or t
  misc_feature (553)..(553): n is a, c, g, or t
  misc_feature (790)..(790): n is a, c, g, or t
  misc_feature (806)..(806): n is a, c, g, or t
  misc_feature (818)..(818): n is a, c, g, or t
  misc_feature (836)..(837): n is a, c, g, or t
  misc_feature (839)..(839): n is a, c, g, or t
  misc_feature (933)..(933): n is a, c, g, or t
cacctctccgaccgatcactacnccggctgtcgtctctcgcaggctanctcgctcctctggcacaganagatgtcttaagcctggtctagtcgatactcctgctctcattctcattcccacncagcctgacgagaagctactagtacatacatatagtgtctactcgtatgtcacgctgcacctccctcttctcttctgatagtatacaagcatcgacacgccaacaccttgcatgaactcgcgccacaacagtatnctngtgctcgtagagtatagcatgagtattcaccaccgcgatcacggtatctgtccataagcatactgcacgcacgctcgctgctatctgatgtactcatactattccctggaacgcctccagccacctagctatcgccgctttgtcatacagatatcgtcagcggcctacgttttgcacgtcctcgtctgctctgtccctgagagctacaccctcctctactccctatgatctccgcgtgcgttacctggctcttcgtactgatcaacgcccgcgttcactactttacccactgncctcgcgtcgcgcctgtaactctcctcgccctctcattcgtcgagtcgtcgtcttgctgttgagcgcacttcatctcattcttgtccctcctcgtctatctctcttatcctcatcatctcgcctcccagacatacctcccctacctctcgccgccatctctactagctcagatcttaacgtcggctctgtccgctgtcagccggcacttcctctgcgatctcttgatctcctcaccnccccccagtgcttgcnttaaatggactngtctcgcgagtcgcccgnnantcctctcaccatccgcgcttgtctcttcgcttaaaaagttaaatctcctactcagcacatcccatctctatattatacttttcattcatgtccncgctggtccgcggccg

SEQ ID NO: 621304 - DNA, 343 bp, Homo sapiens
gagagcctcacagaacagactaatttttgtgtgtgtgtacttgttttgcctacctgtatcccatacagacttttctgtcttagaactacctttccctctttgaacagtgtcttccttgatagtacacattaagatgtcccgctctcccctgctcaaggacgagagtgcctgacctgtagctgggccctatcagattcagtacttacctgggaatcggaataacgatggggagggttaccaaagattgccataatctttgaagcttatctacttcagagagagtccctgaagatactggcctctcattcctgctatgtttatcctatgtgactgaactctgaat

SEQ ID NO: 621305 - DNA, 203 bp, Homo sapiens
ctgttagatctcgcacgctgagacaatgctagatgattatcactcttaattccatccactgtccgctccctaggaggtctggctcccgctaagcggctactggaccatatgggccattatcgagagaatcactaaaaacaatagcctcatcatctccaccattatagccaccatcaccctccacgccaatagtcattcctcca

SEQ ID NO: 621306 - DNA, 1008 bp, Homo sapiens
gggagagaggtgcggctgctggagagccgagtgccagcaatccgcgatcctctgtagctcgtgagagaagggaggcagtcgatggggttggcggttaggggcactgaggcagaggctgaggtctccgtaaaacacatggccttggcttatgcggaccttgatggaggtcatccagtatctcagaggctccacctactaaccaggccgccgtagttgctagttccgcagaagtttcacgaatactcctcaaagcatgcgcaatgcagatggggtgacgattcgaggtttccagctggcatggacgcgtaggcctaatggtcagatgtttaaaaggtccaggaatgcgcgacccacaatagataggctcgcagaatggtgtctatgactttctcgtcgaggcatcgataatgcctagaggcatgtgcccaagcgacgcaggccaagggcaagctttgaaggtctccaaaaagtgcttaccccccagagaggggtccaaatgcttgctatgatttttcccaggcgaggcaaccgaactggtgagttaggctgtctaacaagctcgtgagatggccttcaaagcccgagaatgcctagtactaaagtgggtgccaaatgccgagctacgatttctctcagtctctcaaatgcctatgatctgggcgaaaagaaggcctaggagccctttcaaggcttggtaatgatagcatggtagcgcccaaacatggtgagtgcccaagaccacgagatgtatatcagggcagaacatgggcacttcccaggtgcaattaacagcgtggccaggtttttctgagccctgagggggcactggcggagttcagcagatggttccaaggcccgaaccggaggtcggagaataattggggcaaccgacggagatataaagtgaatgtgagaaacaggcgggggtatcacgcgggcccagagtgaccggcggtgccctttgttccccatggcacagggccacatgttgtacctttgtaccatgcg

SEQ ID NO: 621307 - DNA, 150 bp, Homo sapiens
catgaataatggagtgatatcatttgacttctattatatttccttctgtttctatattctgaaaattctgtggcagtagcattaatcttagtaactgaagatgccaaaagacccagtgtcaatgtctaaaaaacaccaatccccggtcga

SEQ ID NO: 621308 - DNA, 1069 bp, Homo sapiens
  misc_feature (339)..(339): n is a, c, g, or t
  misc_feature (624)..(624): n is a, c, g, or t
gccagaatctaccggtacatgcctaagattgacagtgacgtgatgtgaacctagtgcctagtaatacctagtctagtaccgtgtttccatacatactaacaccttcaacaacggcctaagacgacccgacggaagcggtagcctaccgtaatgcatactgccactctgagggatcagagtctaacagagttgagcatgagagcaccttacattcgaagtcccgactccatcgcttctaccataggtagagccatgctcacgcgactcatccgtctcttgtctggcacgcacagagtgggaaccgaatgtacatgcgtataaaaattgtcagtgataccnacgagcaatgttagtccatcactcaattgcccacaggccaatacagtagccgcataccatattactgcgtgcctttaaccactgcgtatgtgatcttaccccataaacgctgcctatagatctagggtgacaatgtcttgcatatctctagcgagcgtaccttctcgccgagtagttcttagatcaaaacggctaataatatagtaacctcattggatccacgtattgcgacatcggtaaccaaggagaccccatgacacccaattgctccttcccaccgaaganacgatccaatcttctgtcaacccttttatccctaagcgggcggatacccttgctcggttacccgcctataatacgatcggcccgcctttgctttaatggagcatttaaacctacgacatcctttaaaggtaagccactgagagagaggcgaaagctagaaacgaaactagatgggaacacctggttatgcccatccatatggaaacacataacagcggggggcgccattgcctttgaaaagattccaaagttttccttccctccaaatggagcttgaatacctagaaagtgagcccggctgcatgcacgaaggcaaagcttcttgtccaagcgattcaaggtccactgataaccacaaaggtgcctgcccgaagtcttaatcccaagaggcaccccaacaatgtttcaccggcgcgagagcattaaaccacccgaggttctgtga

SEQ ID NO: 621309 - DNA, 335 bp, Homo sapiens
tgcaaacccgagaggaagatagagtgatttccttacacccgctgccctacacttgcgtgcctgcccacattatcaacattccccatcggagtgcatttgctacagttgatgaacctatattgacaggtcattatcacccagtgcctgtagtttacattagcgttcatttgtggtgctggacattctgtgggtttggacaaatgtatatttacatgtatccaacattataggtttatacggaatagtttcactgccctaaaaaccctcagtgctcctcctccctgtcctggggctgttggtgtctagcaagaccctgtgctccatggaagaagccg

SEQ ID NO: 621310 - DNA, 102 bp, Homo sapiens
ggagtgcgtagtatgatgggcaccgcgcatcctcctcttctatggagaagagctacgagctgcccgatggcaggtaatcaccattggctttgagcggttccg

SEQ ID NO: 621311 - DNA, 357 bp, Homo sapiens
ggggggggggggatttgggcccccccccccagtttgttttcggtaaaagcaaattgcccttccggcaagtcgggaataattgttgattcccagagggggggcaaaccctgggggtaaatttgggggggggtgggggaacaaaaactcctttttccccattcccaagtgggtttagtgggtggcccggaaacaacccagggcagacccccccccttttttgggttccgggggtgttgtgggggggggggggtttccccccaaacttcccttcccctggggggttttttgccccgggggggctttaagggccccccctgattcctgaaaaaaaatttaaacttccttttttcttcccca

SEQ ID NO: 621312 - DNA, 838 bp, Homo sapiens
  misc_feature (478)..(478): n is a, c, g, or t
ctcgtcctcttaatcatggctcagtccgaaaacccgagtcgtgggctcgggtaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctactacattcctttttgctgaaataatgaaaataataatcaataaaaactgagggaactcagaggccggtgccagtgcaggtccttggtgtgctgagtgccggtcccctgggcccactgttgtttctctatactttgtctctgtgtattatttctttcctcagtctctcatccaccngactagacataccacagctgtggaggggcaggcacccttcaagtgagtgctgaggatcagtctaataatgtggccctaccaaattcaattgggtgcttacgcttgcacatggaatcgtgatatgatgttggaggcaagaggactatggaagcgtagtttgaggagaccacaaaggctctccgggtggagccgtctttaagagaattgtatgaggggtggtgaaagtactaacacgggtggtatggaggtatctcggtcaaaatttgtaaaaatttgcgggcctctggtttccgggtataggaaggaatcgccttgggacgccctttgcgccgggggccacgctcttcgggaggagtgcta

SEQ ID NO: 621313 - DNA, 1086 bp, Homo sapiens
  misc_feature (171)..(171): n is a, c, g, or t
  misc_feature (178)..(178): n is a, c, g, or t
  misc_feature (180)..(180): n is a, c, g, or t
gcacttccgctgtgcctggggcatccctcttctgacccaggcctgtccagacaacagcagcgcagtgacgacgtgccatctggagcacccggggaccctgcgtgctagcctctgggcagtgagtgctagtgccgtctgctacttccataggctcttggtgtagtgcttgtngagcccntngatcgcagagttgtggcctaggttgcttgagcgtgtccactatgctcgagccgtgcggccagggtgcgtgcgtccacctaggcgtcgactcctatcaccaacgttcttcccatttcggcctagcgttgattgtccattgggcgcgcactctggagcctggtgggcgtctcgttgccataagtgacttggcccccatagtcgtgtggcctatggggatagtgctccacacgagagcctgggtttgcccgctgcggtcccaagtattgccccttgttgtgtcggcgcgtcgccgctcgtagaggttaatcgtagacgagatttcgtggtgggcgctacttagtagtagaccatacgcattcacatgaactatttgaatccctttgtggcctatgtagtacccggcgtagttggagcctggcgccaccagttagcccaattccttgccctggtcgctcatttggtttgggaacgtttagcccgtcccattgggaacgtttgtgcgcgcttcgacttgggatacgcggcctgtggtgcttacgttggcgttagggcccttgctccgcttccttacttcaacgccttgccgcctcgaggctttctttccattcttacgtccccaagacgtcaatcgcttgggacacgggtcgcgcgaggcgggtgcgatcagcttgaatcttgcttggcgcgctgccttttgccgggaaggcccttggggtccgtccgcgacctatttttcaccttgtgaattggcccttgaatggggctgttccggtgtgccaccgtgacacgcctgggggtcattccgtcccggtcttggcccagtgtttgctccattccttcccgggggaggaatttcattgcccaaggtctgggttgcccggggcccgatcggacagacggcctggg

SEQ ID NO: 621314 - DNA, 396 bp, Homo sapiens
  misc_feature (41)..(41): n is a, c, g, or t
  misc_feature (44)..(44): n is a, c, g, or t
  misc_feature (359)..(359): n is a, c, g, or t
agtgtcgttgggagaagggtccgaggtggggcctgcaaagntgngggacagcacatggctccaggaagcccttgctagacgccagctgctgctgttgctaacacaggcagcggtgggtgccctgtgtctatttaagcatttccctgtcagtgggcagcaggtagcattccatttcttactatggcaacatgtcctcttacatcttgtgctagagagagtcatattctgtatcggcacctaaatccatttacaccatggtcctcaaatctgttcccagtgaacagagggctctgcaaatcatttcagagttccacaaagaacagaatattctgccaagcagaagaagattggaacatcgnaaggaattcatccttctatggtcggtgttttatttat

SEQ ID NO: 621315 - DNA, 1974 bp, Homo sapiens
  misc_feature (535)..(535): n is a, c, g, or t
  misc_feature (604)..(604): n is a, c, g, or t
  misc_feature (614)..(615): n is a, c, g, or t
  misc_feature (622)..(622): n is a, c, g, or t
  misc_feature (752)..(752): n is a, c, g, or t
  misc_feature (843)..(843): n is a, c, g, or t
  misc_feature (987)..(987): n is a, c, g, or t
  misc_feature (1614)..(1614): n is a, c, g, or t
tggcacgaggcagccatttggtgtgtctcagcaaatcccgctgagttccgaggccgcctaggtatgcaatcctgctgagagttgttcccaggtcagagaatggagagagcctgtgcatgatgggatatccctgcctagatctttcagtgagtctctacctcagctactcttaggatcagggggagaaccatggaaaggcccggtgtcagacatccggaaagaagagggatgaatgtttcacctctgaagtacatcccaaatgtgggagttaacttcagctttgctggggtctacttggccagcgaaactctgcctggttcattcgcacatccggaagccacttcacggggagccgtcgcaaccggaaccacacacttggcatcggcggttgagccaaatggggactcgtgggtgcaagcaacgctccccacgtgttagcgtgcgtgagattcaattggcggaattttactaggtgcgtgttggtagagcggggctgaggttttcttgctcctgtggatgtataggaagtcaaagntcctgcccagccctgcggtcccctgagtcaactctgtttcggagacataacgatttggattgctaacangtcaagaaannttcaagnccttggatgtagggaaaagaaagagagatcagactgttactgtgtctatgtagaaagggaagacataagagactccattttgaaaaagacctgtactttaaacaattgctttgctgagatgttgttaatntgtagctttgccccagccactttgccccaaccactttgacccaacctggagctcacaaaaacatgtgttgtatgaaatcaaggtttaaggnatctagggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctactacattcctttttgctgaaataatgaaaataataatcaataaaaactgagggaactcagaggccggtgccagtgcaggtccttggtgtgctgagtgccggtcccctgggcccactgttgtttctctatactttgtctctgtgtattatttctttcctcagtctctcatccaccngactagacataccacagctgtggaggggcaggcacccttcaagtgagtgctgaggatcagtctaataatgtggccctaccaaattcaattgggtgcttacgcttgcacatggaatcgtgatatgatgttggaggcaagaggactatggaagcgtagtttgaggagaccacaaaggctctccgggtggagccgtctttaagagaattgtatgaggggtggtgaaagtactaacacgggtggtatggaggtatctcggtcaaaatttgtaaaaatttgcgggcctctggtttccgggtataggaaggaatcgccttgggacgccctttgcgccgggggccacgctcttcgggaggagtgcta

SEQ ID NO: 621316 - DNA, 957 bp, Homo sapiens
  misc_feature (884)..(884): n is a, c, g, or t
  misc_feature (886)..(886): n is a, c, g, or t
  misc_feature (892)..(892): n is a, c, g, or t
  misc_feature (895)..(896): n is a, c, g, or t
  misc_feature (902)..(902): n is a, c, g, or t
  misc_feature (912)..(912): n is a, c, g, or t
  misc_feature (916)..(916): n is a, c, g, or t
  misc_feature (918)..(918): n is a, c, g, or t
  misc_feature (922)..(922): n is a, c, g, or t
  misc_feature (928)..(929): n is a, c, g, or t
  misc_feature (934)..(934): n is a, c, g, or t
aataattagtaggagttcatctttaaaggggatattcattgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagctagaaaaaaaaaaaaaaaagcccttttcagttggtgcacggggtatggtccggtgtaagatggatgcagattttctggaaatgaaatggttggtttagacgagatcataccgggtaaagcaggaatgacaaagctggctttccgggtatgtccaaggtggtatggggactttaactggttatattaattggccaatataagtaaatatagattatatatgtatagtggtttcacaaagcttagacctttaccttccagccaccccacagggctggatattccagagtcagtcatgggttatacatgtgtagtcccaaagcacataagctagaagaagaaatatttctaggagcactaccatctgttttcaacatgaaatgccacacacatagaactccaaaacatcaatttcatggcacagactgactgtagttaatttgtcacagaatctatggactgaatctaatggttccaaaaatgttgtgtggttgcaatatcaaacatggttcatgcaagaaattatttattaccaaatgaagatttataccatgggggttnangctgtnctnnactaanatctgtggantgcntnggtnaactgnnacaangcaaggcgatcaacacacgctaa

SEQ ID NO: 621317 - DNA, 361 bp, Homo sapiens
agcctattctagaatacttgatataagtacgaattaaatatttgttcttttgtgtctggtttatttagtatgttttcaaggttcactcatgttgtcacatgtatcataacttcattcctttgtatcagtgaataatactctacttgtatatatagatcacattttgtttgtccactcatctgttgatggacacttagggtgcctctacctttttaggttattatgaataatgctgcagtgacatacgaatatgttagagtccttgttttcaattatttcaggcatatatctaggagtggaattgctggatcatacagtaattctatttatagatttttgaagaaccactgttttccacagt

SEQ ID NO: 621318 - DNA, 607 bp, Homo sapiens
gaattcccggctctctagggcctatcatctagctgcacctcgatggtgtcaggcttcctgcggcgcatatacaactcatggttgcccatgcagagctagcaggatccgctatgttgattctcagactgtggggcataagaacacaacagtcaggtgcctatcttagtcgatgcggtttaactgacaaagcttttttgtcatatgaaagcagatgttcctagatttcactaccaagagcaagccaatctattgcggttaactatatcatctattctcataaaataattcacgtccaaggagcatacaactaccaagccaaaggtctagttccttatcttgtctttttatactcgacaatagtttgatatccatacattttccagtgtcctgatgcaatctatcaggtattccaacaaaagcattatctttgagcatcccacggtgttccgcatgccacacctggatccggtcctcccactggtccctggtaagtttgtgctggtccatcactctttgagggatccagcgctcagagctgaggtacccagacttgtgcacttctttgtagtagtcccaaacttggctgcacgcgtaggatcccagagca

SEQ ID NO: 621319 - DNA, 1508 bp, Homo sapiens
  misc_feature (134)..(134): n is a, c, g, or t
  misc_feature (286)..(286): n is a, c, g, or t
  misc_feature (377)..(377): n is a, c, g, or t
  misc_feature (521)..(521): n is a, c, g, or t
  misc_feature (1148)..(1148): n is a, c, g, or t
atcttcatcattgcattaccatcacccaacactatcagggaacctgccctgataatcagtctacagttgtatccagcagctccagagagacagcgaccagcaagaaggggccatgatgatggtggtggtttttncaaaacgaaaatggggatatgtagggaaaagaaagagagatcagactcttacagactcttactgtgtctacatagaaagggaagacataagagactccattttgaaaaagacctgtactttaaacaattgctttgctgagatgttgttaatntgtagctttgccccagccactttgccccaaccactttgacccaacctggagctcacaaaaacatgtgttgtatgaaatcaaggtttaaggnatctagggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctactacattcctttttgctgaaataatgaaaataataatcaataaaaactgagggaactcagaggccggtgccagtgcaggtccttggtgtgctgagtgccggtcccctgggcccactgttgtttctctatactttgtctctgtgtattatttctttcctcagtctctcatccaccngactagacataccacagctgtggaggggcaggcacccttcaagtgagtgctgaggatcagtctaataatgtggccctaccaaattcaattgggtgcttacgcttgcacatggaatcgtgatatgatgttggaggcaagaggactatggaagcgtagtttgaggagaccacaaaggctctccgggtggagccgtctttaagagaattgtatgaggggtggtgaaagtactaacacgggtggtatggaggtatctcggtcaaaatttgtaaaaatttgcgggcctctggtttccgggtataggaaggaatcgccttgggacgccctttgcgccgggggccacgctcttcgggaggagtgcta

SEQ ID NO: 621320 - DNA, 273 bp, Homo sapiens
gaaaccagccctattctggtacaaaagagacaagctacagcagaagagccaccattacagccgcactcacacaggctagcaacagcatgtgagcagaacctccgccagacacctccacgctgacggacgcattggagcagatgcagatccggacagagacggctcccacagccgcgaaggcccagcaggagccacaggagccctggtctctgatctcttcgatggaggacactgcggccattgctcccgtcatcgaagagggtaccgagctcg

SEQ ID NO: 621321 - DNA, 1342 bp, Homo sapiens
  misc_feature (355)..(355): n is a, c, g, or t
  misc_feature (982)..(982): n is a, c, g, or t
cagaggacccgtctacatagtgttaggagatagtggcttcctccatctcacctgcaagaggctttcctcttttactaatccacctcagcacagaccctttacaggtgtcgggctgggagacagtcaggtctttctcatcccacgaggccatatttcagactatcacatggagagaaaccttggacaataccccgctttcaagggcagaggtccctgcggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctactacattcctttttgctgaaataatgaaaataataatcaataaaaactgagggaactcagaggccggtgccagtgcaggtccttggtgtgctgagtgccggtcccctgggcccactgttgtttctctatactttgtctctgtgtattatttctttcctcagtctctcatccaccngactagacataccacagctgtggaggggcaggcacccttcaagtgagtgctgaggatcagtctaataatgtggccctaccaaattcaattgggtgcttacgcttgcacatggaatcgtgatatgatgttggaggcaagaggactatggaagcgtagtttgaggagaccacaaaggctctccgggtggagccgtctttaagagaattgtatgaggggtggtgaaagtactaacacgggtggtatggaggtatctcggtcaaaatttgtaaaaatttgcgggcctctggtttccgggtataggaaggaatcgccttgggacgccctttgcgccgggggccacgctcttcgggaggagtgcta

SEQ ID NO: 621322 - DNA, 1498 bp, Homo sapiens
  misc_feature (535)..(535): n is a, c, g, or t
  misc_feature (604)..(604): n is a, c, g, or t
  misc_feature (614)..(615): n is a, c, g, or t
  misc_feature (622)..(622): n is a, c, g, or t
  misc_feature (752)..(752): n is a, c, g, or t
  misc_feature (843)..(843): n is a, c, g, or t
  misc_feature (987)..(987): n is a, c, g, or t
tggcacgaggcagccatttggtgtgtctcagcaaatcccgctgagttccgaggccgcctaggtatgcaatcctgctgagagttgttcccaggtcagagaatggagagagcctgtgcatgatgggatatccctgcctagatctttcagtgagtctctacctcagctactcttaggatcagggggagaaccatggaaaggcccggtgtcagacatccggaaagaagagggatgaatgtttcacctctgaagtacatcccaaatgtgggagttaacttcagctttgctggggtctacttggccagcgaaactctgcctggttcattcgcacatccggaagccacttcacggggagccgtcgcaaccggaaccacacacttggcatcggcggttgagccaaatggggactcgtgggtgcaagcaacgctccccacgtgttagcgtgcgtgagattcaattggcggaattttactaggtgcgtgttggtagagcggggctgaggttttcttgctcctgtggatgtataggaagtcaaagntcctgcccagccctgcggtcccctgagtcaactctgtttcggagacataacgatttggattgctaacangtcaagaaannttcaagnccttggatgtagggaaaagaaagagagatcagactgttactgtgtctatgtagaaagggaagacataagagactccattttgaaaaagacctgtactttaaacaattgctttgctgagatgttgttaatntgtagctttgccccagccactttgccccaaccactttgacccaacctggagctcacaaaaacatgtgttgtatgaaatcaaggtttaaggnatctagggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctactacattcctttttgctgaaataatgaaaataataatcaataaaaactgagggaactca

SEQ ID NO: 621323 - DNA, 591 bp, Homo sapiens
atcctgtgaccatgggaagatcctgactagtcacaggttccgaatgacatgtacgcatgttaccttaacgcatgtggttgctttgtttgccgagaccaccagtcccactctatgactggggggatatagaagggagcaaacattgaatcgcgaccggaattcttaaggcgtacatcaatggacaatctgatggatagggaaaagaagggacgacaatactggagaagtgggcgctcttaaatgaacatagaagtggtaatgcaccacagcgacggttgtacatcgggatacaacaggccgagctgatactaattgctgaaacattgctcgagctgaacctgtgtgtaaagggatccctctatgcgcaataaatggatcagcttctcaggcaccccctgaactgcacgagtgatatcggatgtttccacattaacatatgcgagatcaggtatctactatgccttgagaacaccctgccgagccagtgcgatagacgccagcgatattgctacagctgggttgactgactgagttactgactgtggtgtcttcgccagagtctggcagcacttgcatcttatgtaaaggctt

SEQ ID NO: 621324 - DNA, 622 bp, Homo sapiens
tgctcgtaccctaatatttctggcacagtggcaggagaattgcttgaacccaggagtttgaggctgcagtgagctttgattgtgccactgcactccagcctgggtggcagagcaaaacccagtctcttttttttttaaaaaaaaaaaaaaaaaaaaaaaaaaaaaaaaggaaaataaggggatcacggtgttccatcgatcctaacatacgctttcccattttaatgttgttttcttactatatatattttggtttcctgacacctctaaaaatcaggaaatattatctatcaatagtgtgtcataagtaaatagggttttaacttctattaatggatgctataaaatcaataagtgcatcttctacctgatggctatctttttaagctgaaatgcgctttttataaagagttcctaaattgaattaccccctttattaaagaatttaagtagatctatcaattctcctggtgggaaatttttttttcccacatttctctttttggtttttcaaaattctttttattatattggacatttccaacctttccttaacattaaattattacattataacctcattttccccccaccttacctcagtatttatcgactttcttgt

SEQ ID NO: 621325 - DNA, 1512 bp, Homo sapiens
  misc_feature (535)..(535): n is a, c, g, or t
  misc_feature (604)..(604): n is a, c, g, or t
  misc_feature (614)..(615): n is a, c, g, or t
  misc_feature (622)..(622): n is a, c, g, or t
  misc_feature (752)..(752): n is a, c, g, or t
  misc_feature (843)..(843): n is a, c, g, or t
  misc_feature (987)..(987): n is a, c, g, or t
tggcacgaggcagccatttggtgtgtctcagcaaatcccgctgagttccgaggccgcctaggtatgcaatcctgctgagagttgttcccaggtcagagaatggagagagcctgtgcatgatgggatatccctgcctagatctttcagtgagtctctacctcagctactcttaggatcagggggagaaccatggaaaggcccggtgtcagacatccggaaagaagagggatgaatgtttcacctctgaagtacatcccaaatgtgggagttaacttcagctttgctggggtctacttggccagcgaaactctgcctggttcattcgcacatccggaagccacttcacggggagccgtcgcaaccggaaccacacacttggcatcggcggttgagccaaatggggactcgtgggtgcaagcaacgctccccacgtgttagcgtgcgtgagattcaattggcggaattttactaggtgcgtgttggtagagcggggctgaggttttcttgctcctgtggatgtataggaagtcaaagntcctgcccagccctgcggtcccctgagtcaactctgtttcggagacataacgatttggattgctaacangtcaagaaannttcaagnccttggatgtagggaaaagaaagagagatcagactgttactgtgtctatgtagaaagggaagacataagagactccattttgaaaaagacctgtactttaaacaattgctttgctgagatgttgttaatntgtagctttgccccagccactttgccccaaccactttgacccaacctggagctcacaaaaacatgtgttgtatgaaatcaaggtttaaggnatctagggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctactacattcctttttgctgaaataataaagatagtattcaataaaaaaaaaaaactcgaggtggggcccgggac

SEQ ID NO: 621326 - DNA, 125 bp, Homo sapiens
aggattagtggactagtcactgctgcatatccccatacatagacaggtacctggcatttagtggctcttcaataaatgtatagtgtcgaatgaacacttggcatgcatataaatatctatgtggt

SEQ ID NO: 621327 - DNA, 172 bp, Homo sapiens
gttagcggtctcagcccagctggaatttgctcaccacagaaaaatcctgaaatgattgtgactgccaactgaagccctgtgtgtgccagctgtttataaacccagacctatacacacccgatgggacgcatacttctccatcataacactggataatgttggctccaccctc

SEQ ID NO: 621328 - DNA, 315 bp, Homo sapiens
agcatagcggcagcatggccgaccctttccgcgaagtgcagccacttgcacgtattcgtcataggtggccgtggcaggatcgggttgcaggcggccgtggccgtggcggcgaatcaggtagtcgatgatcgcgccggactcgatcactacgtgggggccgtcttgaatcaccggtgatttgcccagagcattgatggccttgagttccggtggcgcaagataggttttcgggtcgcgctggtagcgcttgagctcgtaaggcaggccgagttcttcgagcagccacaggatgcgtcgcgaacgggagttgttgag

SEQ ID NO: 621329 - DNA, 1767 bp, Homo sapiens
  misc_feature (535)..(535): n is a, c, g, or t
  misc_feature (604)..(604): n is a, c, g, or t
  misc_feature (614)..(615): n is a, c, g, or t
  misc_feature (622)..(622): n is a, c, g, or t
  misc_feature (752)..(752): n is a, c, g, or t
  misc_feature (843)..(843): n is a, c, g, or t
  misc_feature (987)..(987): n is a, c, g, or t
  misc_feature (1548)..(1548): n is a, c, g, or t
  misc_feature (1550)..(1552): n is a, c, g, or t
  misc_feature (1554)..(1558): n is a, c, g, or t
  misc_feature (1563)..(1563): n is a, c, g, or t
  misc_feature (1565)..(1566): n is a, c, g, or t
  misc_feature (1568)..(1568): n is a, c, g, or t
  misc_feature (1570)..(1571): n is a, c, g, or t
  misc_feature (1573)..(1574): n is a, c, g, or t
  misc_feature (1577)..(1578): n is a, c, g, or t
  misc_feature (1584)..(1584): n is a, c, g, or t
  misc_feature (1590)..(1590): n is a, c, g, or t
  misc_feature (1593)..(1594): n is a, c, g, or t
  misc_feature (1596)..(1596): n is a, c, g, or t
  misc_feature (1600)..(1601): n is a, c, g, or t
  misc_feature (1605)..(1605): n is a, c, g, or t
  misc_feature (1610)..(1610): n is a, c, g, or t
  misc_feature (1614)..(1614): n is a, c, g, or t
  misc_feature (1620)..(1620): n is a, c, g, or t
  misc_feature (1622)..(1622): n is a, c, g, or t
  misc_feature (1627)..(1627): n is a, c, g, or t
  misc_feature (1630)..(1630): n is a, c, g, or t
  misc_feature (1636)..(1636): n is a, c, g, or t
  misc_feature (1638)..(1638): n is a, c, g, or t
  misc_feature (1655)..(1655): n is a, c, g, or t
  misc_feature (1663)..(1663): n is a, c, g, or t
  misc_feature (1670)..(1670): n is a, c, g, or t
  misc_feature (1673)..(1673): n is a, c, g, or t
  misc_feature (1691)..(1691): n is a, c, g, or t
  misc_feature (1697)..(1697): n is a, c, g, or t
tggcacgaggcagccatttggtgtgtctcagcaaatcccgctgagttccgaggccgcctaggtatgcaatcctgctgagagttgttcccaggtcagagaatggagagagcctgtgcatgatgggatatccctgcctagatctttcagtgagtctctacctcagctactcttaggatcagggggagaaccatggaaaggcccggtgtcagacatccggaaagaagagggatgaatgtttcacctctgaagtacatcccaaatgtgggagttaacttcagctttgctggggtctacttggccagcgaaactctgcctggttcattcgcacatccggaagccacttcacggggagccgtcgcaaccggaaccacacacttggcatcggcggttgagccaaatggggactcgtgggtgcaagcaacgctccccacgtgttagcgtgcgtgagattcaattggcggaattttactaggtgcgtgttggtagagcggggctgaggttttcttgctcctgtggatgtataggaagtcaaagntcctgcccagccctgcggtcccctgagtcaactctgtttcggagacataacgatttggattgctaacangtcaagaaannttcaagnccttggatgtagggaaaagaaagagagatcagactgttactgtgtctatgtagaaagggaagacataagagactccattttgaaaaagacctgtactttaaacaattgctttgctgagatgttgttaatntgtagctttgccccagccactttgccccaaccactttgacccaacctggagctcacaaaaacatgtgttgtatgaaatcaaggtttaaggnatctagggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccactgagatgtttgggtggagagaaacataaatctggcttacgtgcacgtccagtcatagtaccttcccttaaaggactttatttctctatttttatatggatcatttattaaattagaagactaaaaagtaaaaatatattttacaatcaaagaaaaatctggacaatggaccccagtaaaataatcagaagcgcacgttctgagaccactcctgcctggcaccctgcagggtagcgcccagggagcatctgcagncnnncnnnnngagtngnngnanncnnggnnctagtnttctanctnngnagcnncgcntgagnctcnaagatngnacagncangctgtncntagtgaccgctgccacngagctggngatcggnctncatcttcaaaccaggagnaggagnaagagaagctgggaaggctggtccctaaaaaaaaaggggcttaaccctggtccaaaccactgggggctcc

SEQ ID NO: 621330 - DNA, 741 bp, Homo sapiens
atctgtgtgttggtcttgaagatcaacacgcaggctctctcggtaagtctgtgtggctactacaaccagagcgaggccgggtctcacatcatccagaggatgtatggctgcgacctggggcccgacgggcgcttcctccgcgggcataaccagtacgcctacgacggcaaggattacatcgccctgaacgaggacctgagctcctggaccgcggcggacaccgcggctcagatcacccagcgcaagtgggaggcggccgtgtggcggagcagctgagagcctacctggagggcctgtgcgtggagtggctccgcagatacctggagaacgggaaggagacgctagcagcgcgcggacccgccaaagacacacgtgacccaacacccgtactctgaccatgaggccaccctgagggtgctgggccctgggcttctaccctgcggagatcacactgacctggcagcgggcatggcgaggaaccaaactcaggacactgagcttgtggagaccagaacagcacggagataagaacccttacaagaagtaggaccagcttgtaggctggtgccctactggagaaagagcagagaataacacatgcccaatgtacacgcatgacggggttcgcagaaagcccctcaccctgaagcatgagaagccatcttacccagtcgcaaccaaatacaccgatcgtgggcactgacggctggccttgactgtacctaagcagttagtggccac

SEQ ID NO: 621331 - DNA, 1634 bp, Homo sapiens
  misc_feature (535)..(535): n is a, c, g, or t
  misc_feature (604)..(604): n is a, c, g, or t
  misc_feature (614)..(615): n is a, c, g, or t
  misc_feature (622)..(622): n is a, c, g, or t
  misc_feature (752)..(752): n is a, c, g, or t
  misc_feature (843)..(843): n is a, c, g, or t
  misc_feature (987)..(987): n is a, c, g, or t
  misc_feature (1434)..(1434): n is a, c, g, or t
tggcacgaggcagccatttggtgtgtctcagcaaatcccgctgagttccgaggccgcctaggtatgcaatcctgctgagagttgttcccaggtcagagaatggagagagcctgtgcatgatgggatatccctgcctagatctttcagtgagtctctacctcagctactcttaggatcagggggagaaccatggaaaggcccggtgtcagacatccggaaagaagagggatgaatgtttcacctctgaagtacatcccaaatgtgggagttaacttcagctttgctggggtctacttggccagcgaaactctgcctggttcattcgcacatccggaagccacttcacggggagccgtcgcaaccggaaccacacacttggcatcggcggttgagccaaatggggactcgtgggtgcaagcaacgctccccacgtgttagcgtgcgtgagattcaattggcggaattttactaggtgcgtgttggtagagcggggctgaggttttcttgctcctgtggatgtataggaagtcaaagntcctgcccagccctgcggtcccctgagtcaactctgtttcggagacataacgatttggattgctaacangtcaagaaannttcaagnccttggatgtagggaaaagaaagagagatcagactgttactgtgtctatgtagaaagggaagacataagagactccattttgaaaaagacctgtactttaaacaattgctttgctgagatgttgttaatntgtagctttgccccagccactttgccccaaccactttgacccaacctggagctcacaaaaacatgtgttgtatgaaatcaaggtttaaggnatctagggctgtgcaggacgtgccttgttaacaaaatgtttacaagcagtatacttggtaaaagtcatcgccattctctagtctcaataaaccaggggcacaatgcactgtggaaagccgcagggacctctgcccttgaaagcngggtattgtccaaggtttctccccatgtgatagtctgaaatatggcctcgtgggatgagaaagacctgacggtcccccagcccgacacccataaagggtctgtgctgaggtggattagtcaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagccaaatgccttgcttatggttaattctttttacttcccaactgtaagaatgtgtttggggatgtgaataagaaaaacctagatattcttgggcatttaacgttggcaaccaattccacggtccaattgggtaacttttttaccccctttgggaaactttttaaaattanattggaccaatagagaaattccctatcttggggcttcaaccaatgggtttgaatattggctttggaaccctttttcttccccttttaatttaattcaaccctcttgggctttcttccatgggctaaccaattttcctttttaaatggcttgtaaacaattaaatggtttcttatattttcacattattccactggtctcc

SEQ ID NO: 621332 - DNA, 529 bp, Homo sapiens
cgcacatttacaaaaagtactcagaatgaatcaaagactaaatgtagacctaagactataaaagtcttaggagaaaacaggaaatgttttctgacatctgatttggcaaggatttcctggttatgaaaccaaagcacaagcaacaaaagtaaaaatagacaaattgcactacaaaatgaaaaacttctgtgcatcaaaggacacaacagagtgaaaaggcaacctatagaatgggagaaaatatttgcaagttatgcatttgataagaagtaaatatccagaatatataaaggacttgtataactcaacaacaacaaaaaccccctaacaacccaattttaaaatgggcaaaggacttgaatagatatttctacaaagatgatatacatgtagccaacaagcatatgaaaagatactcaatatcattaaccattagggtaatgcaaatcaaaactacaatgagatatcactgtacacttattaggatggcagctattagaaaaaaacagtaaataacaagtgttggtaa

SEQ ID NO: 621333 - DNA, 174 bp, Homo sapiens
ccccccaaaaatgggcccctttccaaaaaggaattttagggaaaaatttttggccccaagttaaatttttttttggaacttttttaacccccctttttccccccccggaaaaaaattttttaattttttggtttttttttaaaaaaattttttaaaaaaaatttccccccttta

SEQ ID NO: 621334 - DNA, 374 bp, Homo sapiens
agccggtaccctggtacgggagtggtggctcacgcctgtaatcccagcactttgggaggccaaggcaggtggatcacctgaggtcagtagttcaagaccagcctgaccaacatggtgaaaccccatctctactaaaaatacaaaaattagctgggcgtggtggcaggcatctgtgattcgagctactcaggaggctgagacaggagaattgcttgaaccagggaggcggaggttgcagtgagccgagatcatgccattgcactccagcctggggaacagagcaagactgtctcaaaaaaaaaagatactgatttcagttatgtctggccatgtcagtgaaaacacaacttttctgaaatccactcccgtaccag

SEQ ID NO: 621335 - DNA, 1700 bp, Homo sapiens
  misc_feature (1336)..(1336): n is a, c, g, or t
  misc_feature (1379)..(1379): n is a, c, g, or t
tctgcgccacgaggagtaggtttgagcgcacctcactttgtatgaagaaatatgtctgtgtgttggttagaaagcctctcgtctgaatttttcgggtgcggccccgctcattccttcatcgtgatcgatgttgctgactctcgttgtgtccccgccccctcgtttttttaagccacccacgcagagttggtggggttgtgcgcacgcagaaatgtgaagaactgagggttggtcccccccgagaagaaattttagttgattgtggggaggtcccccctcgtggatagagttgtgttgtggaaccctctgtgctcagagagatgtttttgtccccccaggagccccaacaagcaccttcgtgggggtcgcaccccttagtatacacctcccgcaggcgttagatggaacccaacaggtgtgtgcctccactgtatttttggggccgcccacatcataaataagattgggcgctccccctcggtgtattatatgtattgttctggctgttgttagaggagtaagcgtctcttctttccccctcctgtggggacccacgccttttgttttgtgtgtatgactccaccgggggggtggttttctcccccctcataatgcgtgttggcgtttttggagggtcccccacccccgcccatcacccaccagagatggggtgggtgacaaatttggtgggagaccgccctcctcgccccccccactgggggggagaaaaacacacactggggcggtcttttccgtgctcccccctgctgtgtggggcacccccccgggtgggtgaaacacgcggggtttctcccacacaacagagagtgggtcatcacagtaggcgcgtggcgccaacacgtgtggcgccaccacccactctctcacgaacaccccacacagtcggcaacagacacactccacactggttttgtgtggagtatttgtggtgcgccccccactgcgggggtttacacaaagagtgtgtgcgtcgactctcacacactttgtaccctaccccccctctccctcacactctgtgggtgtgtgccctctgtgtgtggagagacacactctgcgcgccccacagcgtgacacacagagagagagtctctgtttgtggacacacaggctggagagtcacacacaccctccacacactcccctctttggtgatgagaggccctcgggcgtttctctcctctggagaccacacacacagtgttggagaccctctgagatagtgagatggcccacagggtgtgcctcttgttgttacctggggtataaccgtgggtggagaggggagatgtgagaggagaagggcgagagtttntctcagagagggccccgctgagaagaatatatgggctcgcgcncctctgagagagaaggagattatatgagagagagaggtgtgtgtggtggagatattcttgttgaaaggagagagagggtggagaggagaagaaaggagagagaggagataaactaattatccaccttcctctttgggccctcgcacgcactgtgtcactggttcccacgagattttcacaggtttcacagctttactgaccacacgagacgtgttaaactttttgggtagattgttttcacttggggatcaagttttttcccaggggacccggaataatttttcccgcaaatttccaagttaagtcctttaccatcccaaa

SEQ ID NO: 621336 - DNA, 292 bp, Homo sapiens
  misc_feature (7)..(7): n is a, c, g, or t
  misc_feature (32)..(32): n is a, c, g, or t
  misc_feature (79)..(79): n is a, c, g, or t
  misc_feature (118)..(118): n is a, c, g, or t
  misc_feature (130)..(130): n is a, c, g, or t
  misc_feature (282)..(282): n is a, c, g, or t
gccccantctagctgggtgcaggggtctactncttgtctagctcagggccctgtgcccgcttgccttgttcccctacanctgtgcctgcacatccagaactgcctccttgccgctgcntccaggaagccnacctttgagccagagtcaagggcttgcagcactgccctgatagaacacgcccgcccttcactgctgttcttgccttacagccaccatgggaaagcttgcaaccttttcttgttttatttaaagaaagcccaacattaaagggttttcattgnaaaaaaaaaa

SEQ ID NO: 621337 - DNA, 224 bp, Homo sapiens
gtctgagcctcgccagtgtatcctcaccctcgttgccctgcagctggaatgaccgaggactctggcgcctcctggtgagtctgtagtagtgtggttcctgagaatgctccagtttcctgtcactcgcattccttagggacgggccacagaagctgctcccgtaagtgtgcatctgcgtcttcctaccgttgtcacttggctgaggcataggggtacgcgagctc

SEQ ID NO: 621338 - DNA, 289 bp, Homo sapiens
  misc_feature (123)..(123): n is a, c, g, or t
  misc_feature (141)..(141): n is a, c, g, or t
  misc_feature (145)..(145): n is a, c, g, or t
  misc_feature (149)..(149): n is a, c, g, or t
  misc_feature (152)..(152): n is a, c, g, or t
  misc_feature (200)..(201): n is a, c, g, or t
  misc_feature (277)..(277): n is a, c, g, or t
caaattcctcttgtgatctcctcacctctcccactccattgataccaactctttcccttcattcccccaacatcctgttgctctaactggagcacattcacttacgaacaccagaaccaccgngtccttgtcgccccttcngctntccnctngagtttgaggacgcccttgtaactctcgcccagagttctatcgcattnncatgcctcttgtagtgttgaatgccacttcttggaagaagatgaggcaatgagtagggctcttttccccttccctnccgcaccagatt

SEQ ID NO: 621339 - DNA, 124 bp, Homo sapiens
cgaatggacagccaggaacagattatctatcaagcatctgccctctgcttgtggttatgcattttaaacgctggatttcccagacagtaagagatacagttgattgggccctaactgccttagg

SEQ ID NO: 621340 - DNA, 761 bp, Homo sapiens
gacacgatacaaatgggccacagctcaggacctcaggatttcaggattctgccgttggagctcagctatgtgagctcagggactctgccgaggacagtgggactcttgagggctatggggacaccaagtgtggctgatccaggcaggtagccgggagcctggtctggcatagtacctctgagcacactggattaattcccagggcggccgtcacagctgtgacgttggctctgaccacccacggaaaggacagaatttaaagaggctgagttttgcatctcgtcgtctgctgttttcgtctcgttggtttcccttgttaccatttatgacatagtcaccaccgatactgcagttccagcctggtgacacacacttgtgatagctaacggtgtggacaatgttgcactgttgccatgattgtagcttgctgtacaccaatagggcaaaagcccaggtcctggccccaggttagtgccctacatcatgcctgggctgtcccatctcggggactccctggtcagagctgaatagtcttcgggctctgtctccctcgctggggagtgtgtccagccctgtcctctagcactgggccccgtgtctccccagacgacggtccccagggcggaggggaccactagacattctgaggtgaactctcctccgtgttggaaatatgacaccctacatgagggaagggctggggcgaagagacggggcattgtttacttcctcataattccatgttaacgagttccccgctg

SEQ ID NO: 621341 - DNA, 589 bp, Homo sapiens
agcgggagacgagatcttgctctgttgctcagtctagggtgcagtgacgtgatcatggctcactgcagcctcaaccttgaagactcaagtagctcagactataagcacacaccaccacacccagctaatttttttatttttttgtagtgatgggatttttttattggccaggttattctcgaactcctgagctcaagtgatccttccagccctggtcccgctgaagagtgctgggattacagggtgtgagccagtgctgccaagcggatacatgtaaatgaatataaatcctctaatcgcttcggacaactagatctcagagtaccatcatgtattcatggagcgcgcctgtgtttgggaaggggatgaggagagggcgtgctatcagagggatgtgggtgtggtgacaagatctaggggacgtgcactcgtgcatcggcctggaattgatctggagagtaccgtgatgtgtccgccgtaatatgttcgccctggcactactgatgcaagaccctctggcccatatcagaaatacacgacgagagtgatgctccgaggataccgtcaggctcctggatctcaccccggt

SEQ ID NO: 621342 - DNA, 499 bp, Homo sapiens
ccctgcgccgtagttaggcctgttgactcataaagaacttagtactcatatacataaactaatacgaactaaagaagttcatcatacatctactccattgttgagcttgaccttctagtcgatcctttgctgtccatcgatgttggctgctatatcaggagatcctcctttgtcaggatgctttacaaagcttgattcgtcgatgagcatctcttatgttccctttataggcagtagggcttacacctagtattaatgctgcttcccgtatggtcatttggggttcaaacccacctctataatagccaccactgaaggcagattttggtaggctttgaaaaacttgtactacttgaggctccatatgcttcatggcttgcaaagcgtaccggcctgcaaatcctgcagcatgcagtggtcagttccaactgctaccactgtactggccatggttccggttgggctcccttgcttccaccgggagcacggctcatcccag

SEQ ID NO: 621343 - DNA, 833 bp, Homo sapiens
  misc_feature (104)..(104): n is a, c, g, or t
  misc_feature (108)..(108): n is a, c, g, or t
  misc_feature (136)..(136): n is a, c, g, or t
  misc_feature (183)..(183): n is a, c, g, or t
  misc_feature (213)..(213): n is a, c, g, or t
  misc_feature (223)..(223): n is a, c, g, or t
  misc_feature (297)..(297): n is a, c, g, or t
  misc_feature (317)..(317): n is a, c, g, or t
  misc_feature (348)..(349): n is a, c, g, or t
  misc_feature (369)..(369): n is a, c, g, or t
  misc_feature (372)..(372): n is a, c, g, or t
  misc_feature (397)..(397): n is a, c, g, or t
  misc_feature (439)..(439): n is a, c, g, or t
ccaacacggactctctcttccatcccagtttccccccactctcgctccattcggcgggacacccattcctttacgccaaggaacttttccttggggcaccattntttnggcggcacccccaacctcctcatccttntttttcttctcctggggtcttttccttctaccgacgcccgctctttnccccttaaggccacgttcctggaggatttngcgggtattngggaaaccgagggctcttcggcctcctccccgaacctcccgccaccctggaccccggccctcaaccccacatcnatggggccccagcccacaancctggggggcccatcaccccccaccaacttnnttgatgggatattggacttnttncgccattacgtgatgctgattgctntggtgggctccctggcctttctgctgattttcatcgtctgtnccgcggtcatcacccggcaaaagcagaaggcctcggcctattacccatcgtccttccccaagaagaagtacgtggaccagagtgaccgggccgggggccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggacaggaagtccagggacatggggtccagtggagacacagaggcgcaggaggagccgtgctcaggggtcttgagggggctgtggtggcgg

SEQ ID NO: 621344 - DNA, 124 bp, Homo sapiens
atgtgttgtgagggtgttccagagcagattagcatttgagtcagtggactgagtaaggaagatcgcccctcagtgtgagcaccatccaattggctgagtaagataaataaaaataaactgtcca

SEQ ID NO: 621345 - DNA, 763 bp, Homo sapiens
tgttgttgagacaggctcttgctctgtcacccaggctggaatgcagctgtgcatgattgtcagtctcactgccggtctcggcctcccgggctcaggtgatcctcacccacctcagatctccagagtagtctaggactatcaggcagtgtgccatgcacatccagctagatttattctaacacgttgttctcagttagagacaggtgacatcatctatgtttgtccgaaaggcgtgggtctctagaactaccattgggttcgaggctcatctcgtccacaccctcaagcactcgctcgaaatatggctggtgacttacaggctagttgagcgcagcatggtaccgccaggcgcaatacattctcgttattcattctattctcaatgtgatacttacatagcaagtcttgctgtagagttggcgtcgttatgcggatgaacacttgtgctagaggtgttaggacgaaatccaaatgctgaccaagatagtatggtcccgcaccttttggtgagcttacgagatctgttctggggaaccagagattcacgcgcaaaagatcaagaaaaccaattggaatagccgagcgtagaaattatcgtggtttccgtggttggcgttcggggtgggtcattgatcacaagtctcaccgggattcaattggttgggggcattgatttggggggcttctccgaagtttttgtgtaattctcccctttaaatagaaacttttaagttaacccggaaagaaacccaaggccaatttc

SEQ ID NO: 621346 - DNA, 278 bp, Homo sapiens
aggaaaaagtatttacttttaaaacttgaatgtatatcttttccgtatgcctagtacagtagtgcttggaaaaaacagattagtaagacaaaatatatgttttcaagaacccttacgttttgagaaagaattttgaatgcagattttaatgtctggtaaaatgctttacagtgtaaaaaatgcatatatgatttttattttatggcattttaaactttcccccccccggttttaaagtgttaatatatgttaaaaatatatgccatttataaaggaga

SEQ ID NO: 621347 - DNA, 548 bp, Homo sapiens
taagagtcttactatgagtctatagttctatactattaactcttttaagtttctgctacaaacacttatcttagaagtaattgctttttgaatatatgtctagagaactcacaggctggctaaagaccatctctgcaccttctggaaaattctcttggtatctccctttgcacatacaacagaggagcagccctgaaatcaagttgctacgctacaacagaaaaacaaatcccccttgctccctgaccaccaaatgaaaccaaagacagcttcttggatttatgctacccttttctctaaatgacacactggaaaatctgactcagtaaataagtgagtgtgtgtttaaagaagccctcctcacaatccttctaatcttatatgtagaaatgcactttaattctgaaaacaactggttcattctaaaccaaacagacaatcaggtagagcaaaattgtgtttaagagcagtagctggggctaccttatttggaagaatttggagtgtcgtttgggctgtctgcagctctttggagaacatctgatacc

SEQ ID NO: 621348 - DNA, 433 bp, Homo sapiens
  misc_feature (368)..(368): n is a, c, g, or t
aaatccgaaaatcacaatcccaaaagatctaaatcctggaaatataattctgggaaaatttttttttaattttttaaaagatacttacattttaaaaggatttatttgagaaacataaaaacacaacagaacacatcagccacttcacacaataaaataggcaataatacatatttttggaagcataaacaggtatacagacagttacaccggtgtgagttattagcagacaaactatattcatgaagaaataggtcaaaatgggaaatgtatacatgcatgtcactatgcttggtaattgtgtgcacctcgctttatacttgcagtcatatcatgaccaacaacctaagtcttttgacgaagcaatnctatgatgcgtcaccaccacacacacagttgcccaaagaggcgggggatgggcaaggaactttcc

SEQ ID NO: 621349 - DNA, 402 bp, Homo sapiens
ggtcgaccagggagccaaggagcttaaacacaactggcaaaaccagggttatgttttgtcagcactcattccatcgtcatgtaggaaaatgtgggtcatgtcaacatggtgatatcaagaggtgatttcattcttaccccttgacatagttacttacacttgttttcgtggtattgttccggaactctgctctgattaaatcattcagatttcaacattcccaacaaccattttcagtttcagttatttttccacaaacgtgaatgttattgtgttatttagggccgttgtgtatttcacacataggtgtcctttgtccaaacactgtgtgcaacatttctaaggttgattaattacaatcaaactcctgctagggcttggttttgcaagtgtcgtcaggct

SEQ ID NO: 621350 - DNA, 161 bp, Homo sapiens
agaaacggaatggagcctacagatgagaggatgttgcatgtggggtatgcatcggggatagatccgagtaacgtcgggggcagttccggataggccgacgaaagtgtcgcgggaagaaacgttagcatttacggccagcaagcaccacgagattcgccggt

SEQ ID NO: 621351 - DNA, 111 bp, Homo sapiens
gagctcggtccaacacaaagacaattttgtaagtttgctgcttcagtactgacagttatgtttacttggacatatgtcttttgggcaactatgatagatgcccaaagcatg

SEQ ID NO: 621352 - DNA, 372 bp, Homo sapiens
aactgattttcgacgatcctgagccctttgtcactgcctaactctagctgtgcgtgtttgtgttgctaatttttaatttaaaaacgctagccctatgcacgcttggcacatgcctattatcccagtactttgcgtggctgatgtgggaggatcacagcctaggagtttgagaccagcctgggcaacttggcgttaccctcatcaacaaagtaatacacaaaattagctgggtgtggcaatgcacacccgtagtcctagctgtttcctgtttttgaagtgagacaattgattgagactgggaagttgaggctgaagtgagctatgtgccactgcactccagcctgggtgactgagtgagaccttgtcacacaa

SEQ ID NO: 621353 - DNA, 558 bp, Homo sapiens
gctaccctagaggatcccttgagcacgaattaccttgacttgccgctgacgaaaccgcccaggcttgtaccggaatacgcagggtggtgcgctggcttgcttgagttcaccgattgcgcgtcgctgttgaccagttccaacggcccttgcgtcgttaattgcacatcgagtttctgcgccttgcccgacaggtttgagagggtccagggccagggtggtctggtcgcctcctgccaggaagcgcgtggccgaacaactcggcaatcagcggggcggcaatcaccgtcttgccttccgccatagcgtagcgatcaatcgctccaggcttgggccatcaggcgcagttcgccgttgaagtcggggatattgacgctgacttcgccctcgcctttttgtcgttcagcgtcaccgggacgcattgcagggcgacgatggttacgctggtgtccgggcgtttgccggctatggccaacgccgcgtagacaacaaatagcagactgtgcaggagcccttggccggcttcaatcaactggccgtagatgtcgaatggggcgacgc

SEQ ID NO: 621354 - DNA, 151 bp, Homo sapiens
agcatcctaaccaggtactgagatgttatatggcagtcaccaggtgtattcttgataatttttatttatttatttgagacaggcgtttgacagccacgtccggatgtggcttcgtctgaagagaatcttacctgcagacagatgagagcaa

SEQ ID NO: 621355 - DNA, 729 bp, Homo sapiens
  misc_feature (265)..(265): n is a, c, g, or t
  misc_feature (285)..(285): n is a, c, g, or t
  misc_feature (328)..(329): n is a, c, g, or t
  misc_feature (342)..(342): n is a, c, g, or t
  misc_feature (369)..(369): n is a, c, g, or t
agttacaacagctagcgtcaagtgctgggagttggaataagggaggctattttttaaagtttcaggaagaagcatcttaactcaagaaataaagtagttgccctaagttgaaggcagattcataattaaatgaactgaactatttgttactccactcctttggtactgtcacatagcccacaagcatggaaatggtctgaaccaatgcaaagaaatagtctcaccttgcttatacctaaaagcccactacaataagtgcaaaaanaacttaaaggtttactgtgnggataagaactcaatgagaaaagcccaagtcactaattcattnnttagtcaagcttngagcaaatgtaaatataattatgaccncacactcaaataaaattcatttagaatgattttcacatgtaaatatttcatttttcttagatgtctaacttcaacagaaattccacttcagaaaacagagcaataatggaaacttctaagtttcactgcaaacatgcaaaaataggcatcacaacacccaatgtacactcagcagtatttaaccgctcagctcaatatacggatatattaaaaaccaaacttgattcttgctgacggcatgtcaaagtcgctgatgcacgacaaatacatgctgattgtacttgagccaacacacatgcatctttaagtaccatatgccttcatcaaagtctccgcctatggtcctatgacctcccagtg

SEQ ID NO: 621356 - DNA, 745 bp, Homo sapiens
  misc_feature (745)..(745): n is a, c, g, or t
gtgtgcagctggtggtggtgccctggggtgccctgtgtggccctgtggatggggaacctgcggtgtgcttcctgcgtgatgtgtttctgtgcatgtgtgcatccgtgggccgtgggtctgctgtgcctgtggactggtgtggcctgtgtggcctgatgtgcctgctagagctctgctggagtgcaatggcctgatgtgataatgtgatgttggattgccctgtcaccaatgtttggtgcctgcttggtcaaggacattgaatgatcaagtccctgtgatgtgagatctatctcttctccctgcctattaatgtgaatcatgagatcattgatttcttccttggtggtgcctctctcaagtgattgatgtgtttttgaatgattattgccatgtgcatgaatgcatgaccctgtgcctgtgccatgctgcaccagtgttcaatgtgcattttgtttgctatctggtggactacaattgtgccactgtctgtgtcttgggtgttaatgttgctccaatgtgaggtggccacctgccatcctgtggtgtgccatcatcctgtgccaagctctccatctgtcccccgtgctgcagaggctacttggtgggacacaatgactctggcaatgccccacacttgtccctatgcaagggtgacatgtgcctgctgctgtggtctgtgcttggtacgccctcatcccttgcacccagtggtgcactggcatcggtctcccgcaccttgtgcctn

SEQ ID NO: 621357 - DNA, 839 bp, Homo sapiens
ctggataaaattgctttcaacctccccattattcctccccgcgttataaccccccttttgtttccaccttacccccctggtttttttacccccgcgtcagaagtcactatattgattttgggcccccccctagaattaaacctctcctccgttgaatattgcgtttctccacaactacgttaccacaggaattgacttgcctacactcaacttaacgcctccttcgcgattaataccctcctctcacctacaaaagttttactacatactttctttttttcgcgccacacatacaattgctccatctgttgtggtaagtctaattattcacactcaaacactcgcgttcctgattacactctctctctcaagcaactctccccacgctcattgttttttcacgcactccatggtgacgagtcacctcctgcactgggcgcaattattgtcactctcgcgtatgtatctctgcacgagcgtcaccgtacatataactattcatgtctccatcccttcctcgcagtgccgccacgcacacagcaccatataggtctctcacgccaccgcacaaattcacgccccctctcataatttgtcttctcccccccaccgcggtggtgctgactcctcttacccaccacccacgcggtataacatcagcaactaagccactacgtatctcactccccttctaccccactccctagggagttactactcgagtgtgctcgcccgattactatcctagtaactcccctagcccctgagacctcgcttaccactcgcctagttatcttctcctttaataaaaatagaaaaacaacacaacaccacattca

SEQ ID NO: 621358 - DNA, 147 bp, Homo sapiens
ggctcaccacgagctttacgtttcgacggaagcagtgacgatgtacttgtgagtcccctcgagaaggcgcagcctcatatacagccgcgggaggactccccggggttgccgctcttgactgctcagtccgtcatcagggagacagtt

SEQ ID NO: 621359 - DNA, 476 bp, Homo sapiens
tgcctcccccattggggagggcccattccatccattttaggcccctttgggtgggcttgcgcctcagttgatgctgctaaattccctgggagccagcatggatttggctggacccgattctgtccaaaactgggaaggccccaggggtggggcagccatcccggccatttttaggtatgacattcctccccggccccactcctcaaaacacatccaaagactgttgctgtttgtgggcaaagttctgtgttttggcccatgtacccgtagtgccggggactgggggaggtgggttggatgtgctttccccccccccgggtaagctcccccttttgttgaaccatgatcccccccccctcccccggtcagtttcccataccttatttattggagtggagggggaagcccatgggaaaattttggggatgttttggtttttttttccttttgtaataaaaattatttaagttgttaga

SEQ ID NO: 621360 - DNA, 246 bp, Homo sapiens
caagagattccgctggctcatggctcgtactggaaggtaacaggcccacggtttaataccatggatccctccggtctcccgttccatggtcacacacacctggaagggcacccacacggtttgtccatctcctgtaaaaacacaagcataccctcgtccccacgtcagcaaatccaccggacctttccattgtccttcttctggggatttccataacacttttggataaacttgcctcttttcctc

SEQ ID NO: 621361 - DNA, 286 bp, Homo sapiens
tatggagcttgatacctgcacgtatggagggcatgatcttgatgtcacagttcacagggaatactgcccacagattacactgcatttgtatccctgtggatgtagagtatagggaaggcattctgtatatctttcatgccttccaaaagccatgcattgtctgtgatgtatctgcccagtcttctcagaactcaatgttgtacatttttccctctaggacctgaattggtctcggaggcagcttttagaaatcctctatgtagttcctgtccacatgcactatata

SEQ ID NO: 621362 - DNA, 224 bp, Homo sapiens
gcttattctgatcgctcatggcgatccaagtggtaatcctaaggaagacactcccaattctgttagggtgctgcgaagcaatctatgtctttaacgatgtggtgcagataacctgtctggatgggtttgaagttgtggcagggacgtgttgctgcaacatctttctattcgacttgtccacagcaatggaacgtggagtaattccacacctgaaatgtcaacct

SEQ ID NO: 621363 - DNA, 155 bp, Homo sapiens
ggctgttgcataactagaagtgcttttgatgtccacgactcttacggttcttatggagagccttgtgaggaagcaggattgttataccactgtgcagtcaagggaatcaaggcccacacatggttttaggatccacccacaagccacagacttca

SEQ ID NO: 621364 - DNA, 1679 bp, Homo sapiens
  misc_feature (6)..(6): n is a, c, g, or t
  misc_feature (1331)..(1331): n is a, c, g, or t
ttgttnatgtacgattgttgcaacttactgtttgtgtttagtatgcctgctgtgtcttcgtcttagtgttgtttgccgtgcgttcacactctcgtaatgggtcgtgttttttactctcacctagctggttcgtggttcatatatctttccgtgtctctcatcacacagtgtgtgtgttgtcgttcttctatctctgggtgtgtgtctctctccgcctttgtttggggctgctgtggtgtcacctctttgttgtgtccggtccccgtcctcttcttttaggcacgggttgtgtgtttgctttctttctttcttcaagatactgtttcttcttttgtcgctcttggttgtcctctatggtttggtctctctctagctgaagcactttcttcgtttgtgttgtcgtcctggtggttgttgtttcacgctccacctttggttgttgttctaatggcggggttatttctcacttgtgtttgtgtggaacccctcctcttttggttggtgaattccttatcggcctcctctgttatgcgggtgcacctgggtggttgttctttcacctgatgtgttcgtgcacggggcggtcgcgcttgtaggtgttctatgccgatgtggtttgctcttctttgggggggggccctcaacacgctcactggtttggcaactagagtgattctgtttgttgctgttgtgtgtgtggcaccaaccacctagcctctcccagggtggatataggtttgctattattattgttgggatgcactatcaaccagaggggtttgtctcttaccgcatttattggtcgggggtgggcgttcccacctccctcctcccctgtgtcttctgcatttgtgtgtgtgtagtcacacagtgcgcttatttttgggtgtagagcgagagccattgttccgcatatatgaccatccttcctctttttgtatacaacactgtggtcccatcgtcgttttttttctacagaggtcactcacagtacacgcctcactttgtcgcgctctgatggttgtctcaacaaagcggggtggtttatacactccatctgctccgccccaaaaattctctctttgggggagagacatcttcctctctctctcgtgtcttttgacgacgggcagctctttctccgcggagaacttcttggctgagacacctctttttatgaggcgaggtgtcgtctctatacatatctctcttggggtcactcttatacccctcgccctctctgtgaggtctcttttcgcggtttgttctctctctgtgcggtgtcgttccctcacgctcctgtgacaccaccactttccataagcggtgtnccccaagagaagagaagaggtgtgttttctcccccacacacttccccccttgtgggtgttttccattgccacagaatttttcatctaggggagaaaccccgcctctcttggaggtggacctcctggacccacggattcctcgagggggagatgagatctccccacgaggactttgttgtccacactgttcacatatttttcccacggccacacacggcggggggggggacacacacacgtggggccacaccccccccacacacacacacggggccccccaacctcctcgcccccacacggggcgccccccccccctttacaataataaaccttttgtaaaatttttta

SEQ ID NO: 621365 - DNA, 311 bp, Homo sapiens
ctgaaggtcagaccacacccggcttaattttgtattattaatgtatagtgggattaccccatcttggccaggctggtcttgaactcctgacatcaagtgatccgaccacctgtaatcccagctactcgggaggctgagtccggaggatcacttgaacccaggaggcggaggttgcagtgagtcgagatcgcaccactgcactcctgccctgagctacagagcaagacttctgtctacacatcatactcacattaataaatcaaatcatgcagaccgcttccccgggcaggcagtctgaaatggtctcagga

SEQ ID NO: 621366 - DNA, 373 bp, Homo sapiens
  misc_feature (1)..(1): n is a, c, g, or t
  misc_feature (123)..(123): n is a, c, g, or t
ngcatggttattcttgcaagtaactatgtttcttcttaagggagggaagcataagttagaacaaaggcatctgaagagaactgagacagctaagaaggagagggtgtggagtgcactgggcanaaccatcagcaccaaacacagacctcaaattaccctggatctgggcgggtctggtcccggtgctgaactgagcctcggaatctcttcaccttcagactgtcaacaacttcactctcgtcatctcccttcacaaagccttacttggtgtaggtttcaaccgtgagtcaacagtatgacaagagtggaatgtggggaaggctgccctgggagaaaacacgcaccacgaatgcaacctaaagcacagcctgag

SEQ ID NO: 621367 - DNA, 169 bp, Homo sapiens
catacatgcataaataaaatatggcatatctatacaatcgcaatataattcatccataaagaaagtaatgaaatctgtccacttgcagcaacatggaatgagccctagaggctattatgtataagtgaaatacaccgaggcacagcaaagacagcacattacactggac

SEQ ID NO: 621368 - DNA, 281 bp, Homo sapiens
ggtgcatgttgctgttagaaggtccgatctcagcaggctaccccggcccacctattggcgggcccttcactgtcagtccccagctcacttgggcaagccagcagcgctggcaggcatccatttccagccccaggcaggttgttggcatcccagtgcagttcatgcacatgccccattccactcacagccatggcatgcacaagccacagcccctggtgtcactgcagactcgcaattctgtcaatccatgtgtccatcaagcgtgtttcccttgttgtgca

SEQ ID NO: 621369 - DNA, 310 bp, Homo sapiens
ctagccgatcgctttaaccctaatcgcagagtacacgggcatgtttaggacttcacagctgggtgtggagacggcggagccacctgcactggtccgtctagctccctcatccctctctctggcagagagggtcacatttccaacgatgcacgtaagaacatatgagtgcttcaaatcccagagctctagttgcaggacaaaacattgagggggacaatgggcagaagccagcatgccaggaaaggcttagtggctgcctgtttaaatcaacgtttagagatccgtgggtttgttcttaattggtgcgggt

SEQ ID NO: 621370 - DNA, 359 bp, Homo sapiens
gacgtgtgttttttttggtatgaagctgagaactctaacgaatagacagtgagttttctttgacatagagatgtcgcagcctgagacatcgcagtctgcggagaaagttacttgtaggcgagtgtatttactattgtaccacgcaggcattgaacattctcattaacatgataatacaatttgctggtaaacatttaaacacacagacattagtttcagtatctcaacatatttttggtcataaccaaggaaatacatcaaaataatgacaacattggctaatattttacaagcaaatatttaactctgcatagtttatacaataggctgtggcaataaataatgtcaccaatctcatc

SEQ ID NO: 621371 - DNA, 391 bp, Homo sapiens
aaattctagatcctctccatttgttcaaccataataaccctaatctatgcaggtcccaggtccctgaaattgatgaggaaaccagaagaaaatttgagataccctttcaccagtgcgcaacgaaaaacataaggaatgggatcctgattgcaaagaaccattctaaattctaaaaccactctctgaaaaaacctcatcaagagatggctaggctctttgaagttccccacagctaagaaggaataaaaaggaagagagacttagctgtctcagtcattccttagaggccttggataaccagactattctgggcaatcagtataatttagtcttccaaactgtgtttttcccatctcctgtggtccaaaaaccttgtaacagaaagcgattg

SEQ ID NO: 621372 - DNA, 250 bp, Homo sapiens
ggcggcggcggcgcctgttgcgcaaaggctttggaaaagggattgaggatgggatcgtgcgtgttgcgctggcgcatcttcacgagcggcaagctctgcgtgctgatttccatgcgatcgatcaacgccttcgaggtcagtgggtcgggtagaccttgcaacgcgaacatctgaaaggccagggaccagtccagggcctctttccccttctctctcacaatgaagcgcgcgtccggtgaaggcgcaccaa

SEQ ID NO: 621373 - DNA, 1662 bp, Homo sapiens
  misc_feature (1259)..(1259): n is a, c, g, or t
  misc_feature (1306)..(1306): n is a, c, g, or t
  misc_feature (1378)..(1378): n is a, c, g, or t
gcggcgctgggcggaacctaccactggcggccgagcagacacgacaaagttgtccaatgaactctgctgcgcatgaacgtccatgcaaacggcgactggactcagaaaccccacgaacaccaactagaacgcaccgcaagcaacccgaccaacctcactagctgaccgacgcacctgggtaccctgcggccttccgccccgacgccttccaccgacgacaccgacgccgcttccgtacacgaacgacacgcagccagcaccgcttctccgttacttactggctgacacggatctccttctccctccttacctgggcacccgaacactggttacaactttccacgcaccggactctctaaatctcccttcgagcgcttccgacgcaaacgccctcggcactggcctccccacgcctctgaacactggccctaacaggcacaccgagacgacggccaacgaacccgcaaaccgccctctcggaacggcaccttggcaccccacccaacggtcaaggcaccgccccttcgtgcacgcgagcatggacccaccgcagcttggcacacccgaccggaaccgggggcccaacgccacccgcaccctagcttggcaccaaaacccccctgggcgcgtccgcccctcgcggactcccacaaacccctcccgcggcgcgccacccaccccacacaactggctgtggagcgcgctcgccccagcaacatgcacacgctacaccgcacacggcactccgcacaccctgtgccgtccacaaaccagcccctcgtgttcggcaccaccgaaacccctcgacaccgtcggcacaccaacgtcctggcgtgccccgcacccccacttagagacgcgcacccgccgccaacaccgcgtgacacgcacacggcccccgactacgcgcaaccaccgggaccttgcgccttcctcccttatttgaagaccacgctgatctaccgcgctaactggcgagaacacttttcactccaggcaccttcgagcgacctttggcccctctcctaacagctgccgcagaaccttggcggcgcccctcccacggcgtgcctcgtttctgcccactctggcgacagtcgtgaccgaacctccgcgcttccaagccggtcactgtcgccgggcacccactcttcttgcggggctcacgtgctcgttactacatttgctccccaacacaattggaggcctctgagttcctctcccttgaatttcacggcctgttagtactcttaaagctntcacactcttggtgttttacaaacccggctcttcacaacaacttttnagggactccaacgcaggcgccaaggacaatttttgcacttcccagccttcgtcctctcgccgcacacgaacnccgactgtagctctggtgtcgtccacctcacttgggaacacaccacgtccggccatcctggtcttgtcttgcccctctgcgcccactgtggttctggcgcttcaccagtctccccgttctagtgtccctccgacgtggcgcgcctaaacttgtgcagcttcccgagaaaaggtcggtggctgcactcctctactcttgaggctccccgctctgagcacttctcatccgcaactcggtttcacagctttggtccccccccgcgccggctcgcggcactgcctcga

SEQ ID NO: 621374 - DNA, 198 bp, Homo sapiens
  misc_feature (15)..(15): n is a, c, g, or t
  misc_feature (76)..(76): n is a, c, g, or t
  misc_feature (148)..(148): n is a, c, g, or t
  misc_feature (159)..(159): n is a, c, g, or t
  misc_feature (166)..(166): n is a, c, g, or t
tcggggccaagcgancctcctgcctcagccttctgagtagctgggaccacaggcgtgcaccaccatgcccacctanttttttatttcttgtagagatgaggtctcctgcctcagcctcccaaagtgctggaatttacaggtaggaccnccacacttggnccacttncttataataaacattgatttggtcgttcagga

SEQ ID NO: 621375 - DNA, 1811 bp, Homo sapiens
  misc_feature (924)..(924): n is a, c, g, or t
cctagtcttattcccgcgtgggtgatgactacgcagtgtggcttgtcgttactttcgacttctcttcccctcccccctgtcgtgttgtctgtacgcgagtgtgtgttatatatctagagcgcggtgtggctcccacacgacatgtgtttttgtgtgttcggtcgtcaccgccctgtgagtggtgtggctttgtggggggccccatatcactcaccgtgggtgttcggttaactaggaggggaccctccttcgtttgttggggcgccgtaataaccccctccttttatatggggagaataggtttcccctgcggtttgtccgcgcccgggtgtgactctctgcgtaggggagtgagcatccaccatcgggggggtgatataagcacaccatggctgttttgttgccgtcgcgtgttgggggggggctcacccacccaccgtagtgctctcccctgtcctcccgctgggatggttatattgtggtgtaaatctcgcgggggggtgtttctctcttttttgccccttgttggtgaatagtttgcgccaccactacggggggatccccactccccttggtccctcacgggagttgttgctctcctctgtctggttgggggccgtctcttcccccccgaatattttgattcgcccactaagtgggtgtagactctgtggtggggaggagccagccctttttgtggtctcccacccaacagggccgcttacgtggtctcctctctgtactcgcgcgtgctttggtgttatcaccacagacgccccccctccgggggggggcgccacagcagagttgttctccctccaccacacagagggttgttccctcctcacctcttcatcatcatagtactgttgtttgttgtgcccctcctgagtagtgctcacacagttgattaccacagcgcgngtgttgagccaacatcatagttgtctctcctctcacaccctcccacgcctacacacacttctctgctctctgctcacttcgagcgcacaaccgcagggtgtgctctctgggcgcctctctggcgccacaactctgtgttgtgtggcgcgcgagagtagtgtgtgtcccctctctcttatagaggaccgacacacttctcacagcctccctctcatcagggtcctcggggagacacacagctgtctgctctctcccacagcaggcgcggcacacacacagctgtttcacactcctctccacacacacactcatgggagactaccccccagcgtgtcactctctctctcgcggggccggagttttgagacacacagcgtgtgtgtcactcgcgcgtcttgtgttctctctctgcgtccgtgctcacaggctgtgtgtgtgtgtgttgtggagagagcgcctcatagagtgtgtctgtggcgcccctcactatacgcacactccctacacacagggccccttctgtctttgtattgtggtgagataggagacacacacacggggcctctctcacgcccccaggcagagagagactactgtgtgccgcaccactcgtttctttgggcccttccacacctgtgttcctctctcccctctctaagcacccaccccactacactctttccctcgggcactcggaccaacaaaaaacacacagaagaaggaacttatacaccacaaggctttttataaaaccaccaaggctatgctttatatcgtttgtttaaccgttatttcacagctcccagggcgggtgaaattaaacactccattggaactaagctaattataggaaagagaaaaaaaacctggttttttttacccaccca

SEQ ID NO: 621376 - DNA, 521 bp, Homo sapiens
  misc_feature (86)..(86): n is a, c, g, or t
tgactagaggatcccaggcaaagctcctacctgatagatcaggtgtggctgctggaggctgtgttgaggatctgaggttggtctgngctcagtgggagatggcagtgcaatcctgatgagtgatgtctgcaggcaccgtaagtttgattagtgatgtctgccacgggcaggcatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaagc

SEQ ID NO: 621377 - DNA, 262 bp, Homo sapiens
  misc_feature (61)..(61): n is a, c, g, or t
tattgataaccctggaatattagatatatccttcccctatacagttttaaaaatttccttncagcattttaaataattttcactgtaaagtatgtgtacttgcttttaaaaatatgttcccaaatggtttttccaatgttattattaaattttttcttgacttaatttttagtatgtcgattactgttatataaaagtattatttcatcttgtatattaatctcgtattttgtgacattaataaactttattagttcaagta

SEQ ID NO: 621378 - DNA, 1972 bp, Homo sapiens
  misc_feature (1674)..(1674): n is a, c, g, or t
tataccagctgtgtacagcgccatctctctgccttctgttgcccctcactcaccaaacacgtgtatttataggcaaaaaaacacacacaaacaacaaaaaaaaaacaaaacaaacaccaaacagcaacaaacaaaaaacacaacaaacacccaaacaacacaacaaaacaaacaaacaaaccaaaagaaaaaccaaaaaagaaaagaaaaacaacaaaatacaacacacacaacacaaaagccacaaacaaaagagaaaacaggagacgaggacgacgggcggcgggagcgcagcaccagacccgagagagcacgacgtctggcaacacacacaccgagacccgaggagcggacaggggcggcggccgaacgcacgagcacaacaagaggcagcgcgccgagtgcgagtgggccggagcatgcggcacaagcgtgacggcgccggagcggaccgacaaagaggagggaggggaacggcaaacaaaacaaacagcaccgaacaccagaccgcagagcagggaggcagcacgcgccgcccgccgcccgacagcaaacagaaagagacaagacgggagacggacgacggagcgaggagagagaggagagagcaagagggaaagaaaacagagagagagaggcaaagaaagacaacgcgcggcccgcaggcgcgaagaggacgagaaaacacaagaaggcaagcaacaggcacacagaccgagagaggtagaaaagacagagaagaagatcgctaccgcgcggtggcgcggggcgggcgtcgggtgcgggcgaggcaggtgtcggcagggcacaggacgtgagcagcaaagtagcgggcgtcggaggagatgagataggaggatgggcggagcgagagagccgacgcgcacggggaaaaaggaaggggaatggctaatctttacacatctatcaagatcacatagacaaaagcataaaacaactcacctataacacaataaagacagtcctctttattaataaatctatatctcccaccaccactccaacgcattaatataatccatgtaccatagtacgtatatatagataccaccatctcgtaccacgatcacacgcacagcccatacaacctacataatctaacacaacacctcctcaccaccactcacaccaactcaccaatacacaacacaaacccaccgagaccgcgagatgatacagccgagcgacgcacgaagcgggcacggagcgctcaccacagccacagagtaggagcgacactgcgcaagaacagacacagaaagtcgattagacgctgcggactagcgcggggaggcagcgaggatggcgaggcaccggagcagacgtcagcagagtaagctgcgcagagagaagacgagaggcgaccgacagtagggagacagcaagctgcggaggctaggtgagagagcggcaggtgcaggcgaggagaggcagacgaccggaagcggcgcgaggaggcgagccaggcatagtgggagagatctaacgcaggtcgacgatagggaacgcaaggagtgggaggagcagctggacgaggggggccgatcgcgccagaccgatgcaccagacacaggcggaagtgcgggcgaaacacaggagcatagcgtatgtcagcgcagcgaacacgagccgcaccacaaacaacatacatcnaaatgaacaaaaaaactagaagctcaacagatactcaaaccacaaccatctacttacatgagcaattatagaatatactcattccaaagcagcaccatctcacaccacgactagattataatacatacaataataatcatgctacatactcgaacatcacattacgtagtactaaagacaataactcattttactttaactcaatattatacatatctaagaaaagatgaagtaataacactcagcaactaaaaattacctatacaacacaaactacattatacacaactaccaaaac

SEQ ID NO: 621379 - DNA, 214 bp, Homo sapiens
tatggaaggcacactcgagaaggcttcatcaccaagatttggggagcgtaaagctaagtatagttgatgtaacattgtagaagcagcaaggacctactgaaggctgctaggctgaaaaatgatcaccacattctcatcgatgctttaagctaattaatctggtagcatacatgaaggatgggtcagatagggaaaagggtacctgagctcgaat

SEQ ID NO: 621380 - DNA, 371 bp, Homo sapiens
  misc_feature (7)..(7): n is a, c, g, or t
  misc_feature (164)..(164): n is a, c, g, or t
  misc_feature (197)..(197): n is a, c, g, or t
  misc_feature (212)..(212): n is a, c, g, or t
  misc_feature (220)..(220): n is a, c, g, or t
  misc_feature (223)..(223): n is a, c, g, or t
  misc_feature (326)..(326): n is a, c, g, or t
acgtggncagccttcgggggtgaccccacatcagtgaacgctgtttggggagagcgcgggagccgccttcggtgggcatgcacctgctgttccccgcccagccggggcctgttccacagggtccgtgctgtcagagcggtgcccccaatggaccctggggccancggtgggcatgggagaggcccgtcgcagggcancggcagctggcccanccttgtgntgnttcctccagggcggcactggtgggaatgacacagagctggtagcctgccttcggacaacgaccagcgcaggtcctggtgaaccaacgaattgcaacgtgctgnctcaagaaagcgtcttccggttcttcttcgtgcctgttgtagatt

SEQ ID NO: 621381 - DNA, 156 bp, Homo sapiens
aggatccccgaccgctctctctgtggggggcgtgatcttcatatcaggccatcgggaggagcaccagatttccctctggtgaaacaaccccccacaggggggatttaatggtcaccacacaagccccaaaaaaaccaggccccacagagagagcgt

SEQ ID NO: 621382 - DNA, 542 bp, Homo sapiens
cgccgtacccacgaaagatgccgcaaacccttgcatggctacgcctatgcatcaaatggcctttactttcacctaaggatattaaagacctcatggatcttgaagctgtccacacggcttggatctttacttgaggctcacctaccgatctatggatatgttacccatacgccagccttattctagatctccagaacgaactagatggtatcatccaatatggtgtgcacaatattactaaattgatcaaaatcgttgagacacataaactgttgaatttggacaggctgttctatcacggagccagctacgattgtcaggaaccttacagagccaagcttgaaggacacgctgcaccaaagctctaaggagtaaagctactgatccacccatccccgatgcacgagagctgtcccttgcttccacattggtgcactaaggactcctgactccacacatgctgaaacagctacaagaagagtggatgacacatcacactgaacacaacaaagaaacaacagagtctggggcatatttcctgt

SEQ ID NO: 621383 - DNA, 435 bp, Homo sapiens
tcagagttctgaatctgacaaaaactggacgagcctggacagaaacctgagcccagagtgagaaatgcagcccagccaacacctggatttcagcctgatgagaccctgaggagagaatccagtcatgttgcatctggaattctgacctagagaactgtgagtttgtaaatttgtgttgttttaagttgctaagtttgtgaaaatttgtgatgcagcaatagaaaactgatatcctgtgcctggcgtggtgggtcatgcctgtaatcccagcactttgtggggccgaggcgggcagatcacaaggtcagacgttcgagaacagcctggacaacatggcgaaaccccatctccactaaaaatacaaaaattagccgggcatggtggcacgcacctgcaatcccaaccactcaggaggccgcagcaggagaatcaatt

SEQ ID NO: 621384 - DNA, 349 bp, Homo sapiens
  misc_feature (1)..(1): n is a, c, g, or t
ngctacagtggaagaattgcttgagccagaaagacagagattgcattgatctgagattgtacctctgcactccagcgtggggcagcaagcaccaactcagtgaatgactatgacacctactgttaagatctctgaatgacttaatatgcctcagactaaacctccatctaagattatactagttaatcccataaattggtcaaaatggcttaaggacacagtctaagggtgtggctttcccacttaagcttaaaacgcctcagttacacagaaattaagttcagagaggcatgggcacaaagaggcaaaggaacacagcactctttagagagtacacattatctagatg

SEQ ID NO: 621385 - DNA, 102 bp, Homo sapiens
tgggactgactatggatgatgtcaactttagtaaaggagcatatagtatggctgattcaggcaaggagacgtgtacattctagcccaagcaagcaatcggca

SEQ ID NO: 621386 - DNA, 425 bp, Homo sapiens
taaattaggttttcggccagcgtggtagttcatgcctgtaatcccagcactttgcggggcagaggtgggtggatcactggaagccaggagtttgagaccagcctggccaacatggtgaaaccccgtctctactaaaaatacaaaaattagctgggcatggtggtgcacgctataattccagctactcgaagagctgaggcatgagaatcgcttgaaccttggaaggcagaggttgcagtaaactgaggtcatgccactgcactctagcctgggtcacagagtgagactgtctcagaaaaataaaaatataaataaataaataaataaataaataataaataaataaataaggtaggcattggcttaagggaatgctgtggctggttagatctgtccagcccaataaaatttttcccacactgaaa

SEQ ID NO: 621387 - DNA, 727 bp, Homo sapiens
atcttgacctggaaagtctgctttctttgcctagtccagaagacttcttctcttaacactgacacaagatcctctcaagcactgctttgccttcggactccataacttcgcttatccgtgctagatcttcttttacaactctgctgcactggactgaccagtatcttacccaaggcaacatgaacaatatcttccagcactaaaacacatatacaaactcgctgacgcgaactatctgcctggcctctacctgacactaaacaaccttctgcgactctctccacaagcacccttctcacacacgtgcaccctagaccctctaccctaaccaaaactggcaagcaacgttacacccagactggcacacaagcctaacagagcaaacagccatacgctggcagcgacgaaaggactctcctgacgaccgctcacatactgcatgatagcaatggctcatactttcatcatatcctcaaatccctagccacacacgagcccccgtaacatcaactcccacggaaaccgctcggactaaccacggcctctaacacctggcccgtccgaaccactgggccaaacacaccacgacaggaagcgactcaacagggacttaccatcgccaagccttttccaaatttcgccatcatgctacccggaacgggcgaccaacaactattcactttctcctacctgggaacgttcccattgggcccccgggcgactctag

SEQ ID NO: 621388 - DNA, 947 bp, Homo sapiens
gctgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaaggagaggcgggagaagcgggaacgaaggatgaggaacggagcaaggcggcagacagcagcggctcacggaggagcggcgcaaggagagacaggaagccctggaagccaaagcaaagagtcggctgaaatgtcatttgctgtctcacagggctaaacttgacggacacaaacaggacaacggaagaagagaacacggttaagacgaacgacgagaagcgcattacccacgcacgagacaggccgacaatcacgaggttcttccacgaaaccaaaggactccaccaggcccacaagcaccctggacggctcctgtgggacagtcatgccccctttgacacattcaaagagcacatggtcctggaccctcggaagtcggacccgacttttcccataccagacctctgcagctcagcatggaccaagcctcctccagcagcacgagcggcgaggtcactccttcttgacaagacctcaacaggccggcagccccatgagcgatacgggaaccaaagcacgtaaccgacccgggaaatgcagatactaccaaacagtgaatgtcgataaatcgacggaagcgtgggaaagggagcgaccgggagtttcacccaacagaagtgaagtgaaagcattaggcaaacagaaatacaacacagcaaagcagaatcatagatagagaaaccaaccaacacccatgacctaagcagacgacaacatcgaacaccaaaaacacacacacctcaaaacacctacaccagcagacaccccaccacgcccaccagaaaagcaacgcacacccacacta

SEQ ID NO: 621389 - DNA, 1146 bp, Homo sapiens
  misc_feature (482)..(482): n is a, c, g, or t
gagtatgcggcgtgatggtgtcgagagtagtctaaagaagtgatggacgatagcaagagatgcacgacgctacatggtgaaccacatgcgagcacacatgtgcaagtacgattcacttcactgtgaagacgtgcctgtaccacgatgaccccactgcgtctgcatggcatgatgtcaccttgtcacactcacggtgttctgcttctgcgagagggggctgggaccatggtatgatgagtgctagctccagattgtagccctcaccaagtgtcacgtcttctcatgaccagctgagtttctcacttgcaaatactcacctccatgcacgtaggtaaaatcgtgtgccccactcttgcaatgccttggggctgctctctctatctgtctcaattcgatcccccaaccgtgtgttgagacatcgtgacgtgacgggtagttcccgtcgcgatgcacagggacggtcccccgggtgaggaagttcncttcgagagacaccgttgcattggtcccaatgagtgtcgcctttgtgcgattgatgcgtcgaaagcgtttcgaaagctcgatagcgaagtgggatccaatggagaccctatgagtggattcagaatttccacgcgaaagatcctctcagctagcagaatagtaggtgcggatccctcccaaaaggagggtccaagccataaaggaggcgtggaaacgactggatagacagggggagcgccagcgattttggacccccgccgcgaattatgtttaggtttaggccttgtaagtggtgagcggcaaccccgaaaggtcggttatatttggccgcaggtgtgtggagtcacattggcaagggggcggagagaaccccttaaaaaggtgggcacgaccatctccccattgttgtgataagttctttcccccctacaggtatttaaatcgatacaaacagtggcgttggatctaaatctaccaagagaagttatagttccgcagacaccaagccgcggcgtccgctttgcgcaccacacgcgttggacgcaccggtaatacccatttatgtccgcccggtgagtgactcagtgcccctcaagtggagaagcgaaagtatgactttcgcacccgcgtcaaaagtctaggataaggagcacagagttcacc

SEQ ID NO: 621390 - DNA, 882 bp, Homo sapiens
  misc_feature (846)..(847): n is a, c, g, or t
  misc_feature (849)..(849): n is a, c, g, or t
  misc_feature (858)..(858): n is a, c, g, or t
ggcgtttacgcgttaaagcgttaccgattcaacttaacgtctgacatagattcgttttaccgttaagtaatatagatttcacttggacttagttcattcggcatgtccctttgtcatattgtatactctatcaattttccttaacgcttgtatgtacccggagcgttgcgtatggcttttcattttcctttccggttcctttgcgaaacctttgcatttgatctacatttccttcatataacgaacaggtaggcgttttaatctttgtagagtaaagaaactgaagagtgtgacttgttatgatgttagaataacttttagatcccgctcttttaaattttgcattgggtttacctaaaatcatccctgtgctataatctacttgttgttaactgggtttttttgacgcagtgcatcatgtaaggccgtcctttcatatttttgcccgccttttagtagttgactgtatatttgcacatttcgtaaacttctttaaagacatttctggatactctatgcatttagggccatctgaggatttttgtgtcaagtaacggtaatatattgattagagacttttccttgctgatatgaactcgcaccataatttctgtctattccgtgaaaagtaggtgagcttgtacgattctttttcttcatggacttccgtgctgaatgcttgtattttaattttcacatcacattgtgatgctactggtcatacactacgtgtgttccaagctccagtaggatgaagctttctgggatgggggtctatatcattttctttttatccttccccatattcttcaggtaaactgtattcattaaaaaaaacttgtgaanngngacgtaagnttagatggaaggggcagtcggtgg

SEQ ID NO: 621391 - DNA, 1538 bp, Homo sapiens
  misc_feature (10)..(10): n is a, c, g, or t
  misc_feature (12)..(12): n is a, c, g, or t
  misc_feature (14)..(15): n is a, c, g, or t
  misc_feature (18)..(18): n is a, c, g, or t
  misc_feature (32)..(32): n is a, c, g, or t
  misc_feature (41)..(41): n is a, c, g, or t
  misc_feature (44)..(45): n is a, c, g, or t
  misc_feature (188)..(188): n is a, c, g, or t
  misc_feature (891)..(891): n is a, c, g, or t
  misc_feature (989)..(989): n is a, c, g, or t
  misc_feature (1206)..(1206): n is a, c, g, or t
  misc_feature (1225)..(1225): n is a, c, g, or t
  misc_feature (1275)..(1275): n is a, c, g, or t
  misc_feature (1314)..(1315): n is a, c, g, or t
  misc_feature (1333)..(1333): n is a, c, g, or t
  misc_feature (1348)..(1348): n is a, c, g, or t
  misc_feature (1350)..(1350): n is a, c, g, or t
  misc_feature (1354)..(1354): n is a, c, g, or t
  misc_feature (1356)..(1356): n is a, c, g, or t
  misc_feature (1358)..(1358): n is a, c, g, or t
agggacacangngnnaancggcatagcacttntttgcatantannacttgagactcataaatggtgctgggggaagggtgcagcaacgatttctcaccaaatcactacacaggacagcaaaggggtgagaaggggctgagggaggaaaagccaggaaactgagatcagcaagagggagcccagcatcnaaaaacaggagatgctgaagctgcgatgaccagcatcattttcttaagagaacattcaaggatttgtcatgatggctgggctttcactgggtgttaagtctacaaacagcaccttcaattgaaactgtcaattaaagttcttaagatttaggaagtggtggagcttggaaagttatgagattacaaaattcctgaaagtccattagaaaaaccacaggatgaaaaaaaaaaaaggccacaaagaaggcttcagaggtccctgctggcccagggacagatacctgtagtgtccagcattgcagtgaacatgatctactttcaaaggcagagggtttaaggggagggtgggtgggaatggtggaggcaaaggctctccccatccccacctcagttttaggtagggcttttaatttaacccaaagacatctctcaacttggagagtaattcagtcctcaacagcgcctcaaatctgctatggctttgcagcgcagcagcaagaatgtttaatatataatagataaaaatttcatccaaaaaattaaaataaaatattcttgcaaacccccccccaacaccaattcctattctaatgttaacctaccacttgtgctgttaatacttgaccatgtacttaattggaaacctatatccaaaagactgaaactgaatcttcaccccaaaatgaaaacaaaataaaatgantaacttgaggtttatggcatatagtttaggtaaacacacatacgaggagaaaggggaagaggaaacagaggttgtcggaagcaaagctgagtgacagnacacattcagtcagggcagatgtctatacacaagtggagtggaacatcaggaaaagctccatatggactcatgtgcacatgtctggaggcaccagatccctccatggcagatccaagaacagggagctaagggaggaggccattcctgtcattccagttttagaagctccacatcgaacgacgagagtggcatgtggtgggatgatgcctgggtgcnccagtggcaccataggcantaatctggagatatagtcagtttggctctctgacccacactcatctggcnaaccccttcttcccagcctcaggatcacctcctgcttgnnctagcaataaacttaaangggcattgtttctgncncacngngnggaatcaaaatttctttccatcttcaagcatccacggtgtagtgcaccacagcaggtctggccgcagcattggggaaggtgcgcccagtctctctggggagatggtttcacacactgcactcccatggcggcggcgtacgctgagcagggcaggcggcgcgacggcaggcgtggaccaac

SEQ ID NO: 621392 - DNA, 706 bp, Homo sapiens
  misc_feature (157)..(157): n is a, c, g, or t
  misc_feature (374)..(374): n is a, c, g, or t
  misc_feature (393)..(393): n is a, c, g, or t
  misc_feature (443)..(443): n is a, c, g, or t
  misc_feature (482)..(483): n is a, c, g, or t
  misc_feature (501)..(501): n is a, c, g, or t
  misc_feature (516)..(516): n is a, c, g, or t
  misc_feature (518)..(518): n is a, c, g, or t
  misc_feature (522)..(522): n is a, c, g, or t
  misc_feature (524)..(524): n is a, c, g, or t
  misc_feature (526)..(526): n is a, c, g, or t
tgcctccatgtctcacttataattcaggttctgctgtggcttcagaacatgagcagaagaatcgttttatgctagttatggcattcatggttgaaactcaccttagggaaaggggaagaggaaacagaggttgtcggaagcaaagctgagtgacagnacacattcagtcagggcagatgtctatacacaagtggagtggaacatcaggaaaagctccatatggactcatgtgcacatgtctggaggcaccagatccctccatggcagatccaagaacagggagctaagggaggaggccattcctgtcattccagttttagaagctccacatcgaacgacgagagtggcatgtggtgggatgatgcctgggtgcnccagtggcaccataggcantaatctggagatatagtcagtttggctctctgacccacactcatctggcnaaccccttcttcccagcctcaggatcacctcctgcttgnnctagcaataaacttaaangggcattgtttctgncncacngngnggaatcaaaatttctttccatcttcaagcatccacggtgtagtgcaccacagcaggtctggccgcagcattggggaaggtgcgcccagtctctctggggagatggtttcacacactgcactcccatggcggcggcgtacgctgagcagggcaggcggcgcgacggcaggcgtggaccaac

SEQ ID NO: 621393 - DNA, 2838 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621394 - DNA, 958 bp, Homo sapiens
gtcacatggtctgatgtccttgtaagatcagcacactgcatggatatgtgttataatctaacgtgaagtggccaggacatgttactgaatgagaaacgggtaccgtatccagaagtgccaagccctttttgttgggcctgaccctagctcatcaagagctaggatgttcacctgtcaaccgcacgtctatgcaggtatggaacctggctaactgcaagctgaagaccaaccacattggccacacaggctatctgaacacggtgactgtctctccagatggatccctctgtgcttctggaggcaaggtattgggggacaaggcgtctcctactcagtggaagacagcgtcatggaaggagcacttagccagcgtctctaacgtaaaatggggaaacattagccaagatggttttaggaggataatgagataatggcaatcagagaatatgtttccaaagattactttcagcaaatgacagttaaggcatactatctggaagaaaaagatgattttctataagcctgtggggttattagttagagtgtagttaagtgatggttgagaacggagtctcacctcggttgccaaggctggagtgcgggggcgatctcggtcatgaacatctcccgggttcaagcaattctcccatctcaggctcccgagtaggtaggaatacaggcacccgccatgactcctgggtactctggtatggtagaacggaaggattaccagtggcagggggctgaactccgaaccacagggatcgccaccgggtccacaggggggttcaggcggagcaccgaccagcgagtggctgaagagggaaacgggaacggtctcaagaggggaatgagagagggaagagggaggaagcaacgaagaggaaaagcgagaacaagggaggagaagaaaagacggaaggcacaagacgagaaaaagacgcgatccaagaaaaca

SEQ ID NO: 621395 - DNA, 3069 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaaaaaaaaaaaacaaag

SEQ ID NO: 621396 - DNA, 374 bp, Homo sapiens
agatgctttcctagagcagtatactattgatcagaactcataccgcagaacctggatgacttataacacgatgcttttaagaaacgtcaatgtatatccttttacaacgtcatcgatggggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattg

SEQ ID NO: 621397 - DNA, 2799 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621398 - DNA, 1123 bp, Homo sapiens
  misc_feature (1039)..(1039): n is a, c, g, or t
  misc_feature (1043)..(1043): n is a, c, g, or t
  misc_feature (1053)..(1054): n is a, c, g, or t
  misc_feature (1063)..(1063): n is a, c, g, or t
  misc_feature (1078)..(1078): n is a, c, g, or t
  misc_feature (1084)..(1084): n is a, c, g, or t
  misc_feature (1087)..(1087): n is a, c, g, or t
  misc_feature (1092)..(1092): n is a, c, g, or t
  misc_feature (1106)..(1106): n is a, c, g, or t
  misc_feature (1111)..(1111): n is a, c, g, or t
ggggggggctttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 621399 - DNA, 749 bp, Homo sapiens
ttaaactacctgttttaaacgtgctcatcttattcagggtttataataacgtaatcctatgtcttttcctttcatttaacaaaaattgagtctatgtggggggttggcggaatcaataattggtacaactatctttacacaggtcgtcttcatctgggctaccttctcatgataatcattccccagtatgggactgaagactgaccttcatgttccattcgcattcagatgtcaaacatcccggttgccttcttatcccaaatgcttgctgtgcagtgtgtgtgtgtgagatcgcaggcgaccctcttagctactggagcgtcttgaggagccaacgttttcccagtcaagcgattactttgacttctgttcatgacctcattccatagtttgcagatgagcatggcatctttgcctggagatactatgctaggggcagcttctccaggggcaaagcgaagccctcgtgttacacggctctcctccagctcacacgactatgtgaggagatgaccaaatgtgaaaacaggttccccctgatgttgcccgtcatcctttggcccgtgcacaggaatggagtactgtataatttcaggcttttcattcccagcagttgtttactagaggacctggtgtttcttagaacaggtgtagtcctgtacctctatccatgttccctgttgggctggtcgagctcccaagtagatgggtggcagagcttgtgtacaggatgaactgactagagaccc

SEQ ID NO: 621400 - DNA, 866 bp, Homo sapiens
  misc_feature (38)..(39): n is a, c, g, or t
  misc_feature (44)..(44): n is a, c, g, or t
accaacggacgcgcaacactattgggctagtcgaggcnngtgtngccaaatgcgcttgaagtacgagccgtgctgaacccgggggttccgagaatggctaccagacgctgtacaagcacctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621401 - DNA, 1045 bp, Homo sapiens
ggggggggctttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcttgggaatcaagctggcgaaaagtgtttattgccagcgggagggggaacccaccccggggcccctcccttgactgggttggataatgggcaacatttgtgtggtgcgtacccgaacacctgggg

SEQ ID NO: 621402 - DNA, 474 bp, Homo sapiens
accccccaccaacggtgagcgggcccccccggtccttcttagtaaacatagtggtgatccccccggggctgcaggaattcggcacgagcggcacgagtgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621403 - DNA, 1114 bp, Homo sapiens
  misc_feature (11)..(11): n is a, c, g, or t
  misc_feature (1030)..(1030): n is a, c, g, or t
  misc_feature (1034)..(1034): n is a, c, g, or t
  misc_feature (1044)..(1045): n is a, c, g, or t
  misc_feature (1054)..(1054): n is a, c, g, or t
  misc_feature (1069)..(1069): n is a, c, g, or t
  misc_feature (1075)..(1075): n is a, c, g, or t
  misc_feature (1078)..(1078): n is a, c, g, or t
  misc_feature (1083)..(1083): n is a, c, g, or t
  misc_feature (1097)..(1097): n is a, c, g, or t
  misc_feature (1102)..(1102): n is a, c, g, or t
cggctggtacnggccggagtcttaggatcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 621404 - DNA, 3048 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621405 - DNA, 703 bp, Homo sapiens
ggggggggctttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgaacatttcttgccaccaggatcgaccgtttatcgaatcatgtggcctgggcctggtaagagatgggcgctggcttactgttaactgaagacccctatatgggacccacaggttatttgtcc

SEQ ID NO: 621406 - DNA, 3110 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgaccgagtcttggcccagctgcggggacctcagccgcgccaagactcggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621407 - DNA, 880 bp, Homo sapiens
  misc_feature (796)..(796): n is a, c, g, or t
  misc_feature (800)..(800): n is a, c, g, or t
  misc_feature (810)..(811): n is a, c, g, or t
  misc_feature (820)..(820): n is a, c, g, or t
  misc_feature (835)..(835): n is a, c, g, or t
  misc_feature (841)..(841): n is a, c, g, or t
  misc_feature (844)..(844): n is a, c, g, or t
  misc_feature (849)..(849): n is a, c, g, or t
  misc_feature (863)..(863): n is a, c, g, or t
  misc_feature (868)..(868): n is a, c, g, or t
ggggggggctttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagatgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 621408 - DNA, 292 bp, Homo sapiens
ctcatcacggccgtcgtattcgatcacaccgaaccgggcggtgagcggcaggttttccggccagacttcacgcaccgaagccagggtttcgaggaggaagcggctgcggttgtcgaagctgccaccgtaggcatcggtacgctggttggaatgctcagagaaaaagctctgtgccaggtagccgtgggcaaaagtgcaggtttctgatccattcaaagccggcatcgcgagcgctgggggcccgctatcgaccgaaagttctttgtttgcacggcgggggcaatggtctttc

SEQ ID NO: 621409 - DNA, 327 bp, Homo sapiens
tgagatggagccttgctctgtcgcctaggttggagtgcagtgacacaatctcagctcactgcaacctctgccttccgggttcaagtgattctcctgcctcagcctcccgagtagctgggactacaggcactcaccaccatgcctgtcgaattttttggtatttttagtagaaacggggtttcattgtgttggccaggatggtctcgatctcctgacttcattatccgccctcttcggcctcccaaagtcctgggattacaggcgtgagccaccgtgcccggccagacaaaaccaaatgtcaatggataagtgcatggaaagtaagaa

SEQ ID NO: 621410 - DNA, 3422 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaaggttgcctagtgatggagctcacatggacaactctgataatactggagaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaaaaaaaaaaaacaaag

SEQ ID NO: 621411 - DNA, 691 bp, Homo sapiens
ggggggggctttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaccactcagctatgcgatcccctgtgtggctgccacaccctttcccccataactggccccccacctcggttgcctggtccgcctccccacccccaccaaccttcttatcgccccccacgcccagacccacacgcgcccggccacgctccccgcttaccccccccctaaccggcctcccatcactccccct

SEQ ID NO: 621412 - DNA, 418 bp, Homo sapiens
tagcaggtagtatagcttctactttctgtctcactattgctcggtgacaggatgagccagggcagaagtttatgcgtcagatagctcagctttacaaccattgtcggggtctaacacatgaatcctcagcactcgggttggccattcctcttctcaaacgttgtactccctctgctggttttgagacaactgatatttccttaagaagtgtgaggctctgccttcaaaacggcacagtctcttttccccagatctgcaactgtgtgtgttgcacacccacaaagaagacagttctttctggctgtggggaaatgatttcagttcttgggcaaggatggcaaggaataaatgtagaagaaattcctttctgataccattctcctacctcacatcctacccccaaatcattgcaggaatg

SEQ ID NO: 621413 - DNA, 3223 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaaaaaaaaaaaacaaag

SEQ ID NO: 621414 - DNA, 1017 bp, Homo sapiens
  misc_feature (933)..(933): n is a, c, g, or t
  misc_feature (937)..(937): n is a, c, g, or t
  misc_feature (947)..(948): n is a, c, g, or t
  misc_feature (957)..(957): n is a, c, g, or t
  misc_feature (972)..(972): n is a, c, g, or t
  misc_feature (978)..(978): n is a, c, g, or t
  misc_feature (981)..(981): n is a, c, g, or t
  misc_feature (986)..(986): n is a, c, g, or t
  misc_feature (1000)..(1000): n is a, c, g, or t
  misc_feature (1005)..(1005): n is a, c, g, or t
tcatcgaaaccctcatcggaacctgtcatcgaaaccctacgcaccgcacgttcgtgtcatcgaaaccctaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 621415 - DNA, 543 bp, Homo sapiens
  misc_feature (5)..(5): n is a, c, g, or t
gtatngggatatgggtgcagtgagctgggagcatgctatttcattccagcctgggggacggagcaaaactgtctcaaaaaaggaaaaacaaaaacaagcaaaaacaccctggtcatagcatgataaaaattgaaaaccaaaggcaaaaataaaatcttagaaaagcagattcaaactagaaaaaaaatgttaagagcacattaaagtcagagaaaaaagtcacatgatttttaaagggacaagactgacacctgactttcttagaagaaacgatggaatccagaagacagtggaaatgtgccttcaaaacgcatgagaaaaataactaatctccagctgcaccttggggaagacatgcttcagaaataaaggtgatgtgaaaacagttttagaggcacaaaaatgagagaactcctcatcaacagaaccccctccacgtggaaaaggagtgatctcagagggaagcgtgtcccggaggagggagtaagggacaatggaaacagttgatgtggcatacgcccaggtaagcaggggatcctctag

SEQ ID NO: 621416 - DNA, 2924 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 621417 - DNA, 379 bp, Homo sapiens
  misc_feature (1)..(1): n is a, c, g, or t
naaaataacagtgcagttcatgttcaatgagtacagctgatactatgcaaggttataagcttctggacttagtgtaacctttcagagctgtgtctggtggtcaagtctttagatgacatatcatgctgagagtagatgtgctctggcttgcataaatgacagctgtactacggcgtttctcctttaagtcgcgaaagtttactgtgattctagagagaggttatgatatccaagctatagcacacttgtcataacattgaaaggtaagcacacaattctgagagtcagctagcatgtagggcagaatatctctgtaggagcccgcaggtccactcacccagcgttcatatgcactccagatgttgaatctagaaaagcc

SEQ ID NO: 621418 - DNA, 126 bp, Homo sapiens
aaagacaagcccacatataaaaactcacataacgatcaacactacagatgacatacatctaaggaagtacataaaccaggacatctcacagtatctgtatgtatttccatttactgagaactttag

SEQ ID NO: 621419 - DNA, 154 bp, Homo sapiens
ggtatcaagatccatcccggttctgggtagtgtctgtacgtgtgtgtgtgtgtgtgtgtaagtgtctgtgtgtacgtgtaagtgtgtgtacgtgtgtgtgtgtgtgtgtgcgcacgcacgcgtcccctttacgtagaccaggctggttgtaaac

SEQ ID NO: 621420 - DNA, 897 bp, Homo sapiens
  misc_feature (151)..(151): n is a, c, g, or t
  misc_feature (202)..(202): n is a, c, g, or t
  misc_feature (225)..(225): n is a, c, g, or t
  misc_feature (324)..(324): n is a, c, g, or t
  misc_feature (518)..(518): n is a, c, g, or t
  misc_feature (546)..(546): n is a, c, g, or t
  misc_feature (555)..(555): n is a, c, g, or t
  misc_feature (650)..(650): n is a, c, g, or t
  misc_feature (660)..(660): n is a, c, g, or t
  misc_feature (724)..(724): n is a, c, g, or t
  misc_feature (749)..(749): n is a, c, g, or t
  misc_feature (752)..(752): n is a, c, g, or t
  misc_feature (770)..(770): n is a, c, g, or t
  misc_feature (773)..(773): n is a, c, g, or t
  misc_feature (777)..(777): n is a, c, g, or t
  misc_feature (788)..(788): n is a, c, g, or t
  misc_feature (794)..(794): n is a, c, g, or t
  misc_feature (828)..(828): n is a, c, g, or t
  misc_feature (854)..(854): n is a, c, g, or t
tacggagcccgcaagtcccggcccgaggtccgaggaggcgtcctccgcccggtggcccagagggaagcggggcacggcgtcatcatgcacagttgtatcgcgcccgccgcgcgtccccggagccgcccctgagcccgaccgcgagttcgancccagggcccgcccggccgcaccatgagccacgggcccagcccccggctgnccgagtccccgcagctgtccaanggcagcctcctgaccatcctgggcagcccgtcgccggagcgcatggggcctgccgactccttgccgcccacgccgcccagcggcacgccctcgcccggnccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgctggtggtcggactgcactgccaattggcgcgagaaatggagcaaggtgcgcgctgagcnaaaccgcgcgcgcgaggaggtgcgccantggcgccangccttggacgcgctcaccaaggagctggcgggcgcacggcgcgagcgccaaagaggcgcaggggcgagttgcgagggcacgggggccgcgagctnggcgcggctngagggggcgcccgggggggttcgccgaccagacgcgccgacggcccccgagccggaagcgggancctgagcccagttgcgttgacgtcnggntccgaagaggccgccagnagnccanggaattggagnttggtnggagagcctgcttgaagagcatgccagaggagtnttgagggactgctggggaggcgcgcnccttgggggggctggggggcccgcggggcagctcaggccgcca

SEQ ID NO: 621421 - DNA, 338 bp, Homo sapiens
  misc_feature (26)..(26): n is a, c, g, or t
  misc_feature (82)..(82): n is a, c, g, or t
  misc_feature (100)..(100): n is a, c, g, or t
  misc_feature (112)..(112): n is a, c, g, or t
  misc_feature (158)..(158): n is a, c, g, or t
  misc_feature (248)..(248): n is a, c, g, or t
  misc_feature (289)..(289): n is a, c, g, or t
  misc_feature (307)..(307): n is a, c, g, or t
gactgcaataggaaatcatgtctggncgcggcaaggacggaaaaggcttggggaagggtggtgctaagcgccatcgtaaggngctccgggataacatccnggcttacaaaancggctatccgccgtttggatcggcgcggtggcgtcaagcgcatttncggtcttatctatgaggagactcgaggtgtgcttaaggttttcttagagaacgttattcgagacgccgtcacctatacgggccacgccangcgcactgtcaccgccatggatgtagtatatgccctcgtcngggcgcactctgtatggntcggcggctgaatctaggtcgcggtctcctg

SEQ ID NO: 621422 - DNA, 371 bp, Homo sapiens
cacgagacctgataaacacacaatacataataccagcaaaccaaattcaacagcacatcaaaaggttaatttaccatgatcaagtaggcttcattctggcatgcaaatttggtccaacatgagcaaatacaaatgtgattcaccacataaataggatttttaaaaagccttagaatcatctcactagatgtagaaaaagcttttgctataatccaacatcccttcatgataaaaaacttcaagaaagtaggcactgaagaacatacctctaaataataagagccatctatgataaaaccacagccaatatcatactgaatgggcactgaaagcattacccttgcgaactggaacgacgatgcccactcttc

SEQ ID NO: 621423 - DNA, 136 bp, Homo sapiens
ggtaccgcttctggtttagaaaagcttttgttcttcagttctaaatgagccaggagcaatggctcatgcctgtaatcccagcgctttgagaggacgaagcaagaggatgcttgggcccaggatgtcgaagctgcaa

SEQ ID NO: 621424 - DNA, 193 bp, Homo sapiens
caacccaaatattacatacaaatagtacagcaatatgaatggatattgctgctatgtttgccacttaatttgcttcataatatggctgtctgtgtgttgcatttagtgaagatagtcccatagcaactatcatggggtaccccacgagactatgacggaatcactttagcatcatccaatggtcattcatagc

SEQ ID NO: 621425 - DNA, 88 bp, Homo sapiens
ttccatcattgctataaactgaacattggtgtctggtgaaggcctgcttactggttcatagacagggccttctcgctctgtcctcata

SEQ ID NO: 621426 - DNA, 129 bp, Homo sapiens
cactagaagcggcgtaaagagtgttttagatcacccactccccaataaagctaaaactcacctgagattgtaaaaaactccagattgacacaaaactagactacgaaagtggctttcaacatatcgtga

SEQ ID NO: 621427 - DNA, 109 bp, Homo sapiens
cggagcccttctccttttcccaaaggtcaacattttagggtgtgggctgagttcttctgtaaagagatgatcgcaatgccaataaaattgatcaagaacaataaaaaaa

SEQ ID NO: 621428 - DNA, 406 bp, Homo sapiens
ctgtagcctcaggaacctgtccaggccagggccagttccccgtgatggttggggaatgctgtccagttatttacagcaggtggctcccttcctgactgccagtggaagtttgtcccattgaagaccttgaatagggagggtggttggtgataggaagacagcctcagtttgtttagaattgtgaggtattcagtggaccttagtcaagtccagttacccatccttaggttcaggttctatagagagccctgtccactgcctgctgcctggagcataaatgtctctgccacagctgactgtccaagattgtgtgagaggcagctagccagggtgtcttcctggattctcccaccatttccttctgctacttttgagatgagactgttgaataaaacattagctttta

SEQ ID NO: 621429 - DNA, 127 bp, Homo sapiens
  misc_feature (18)..(18): n is a, c, g, or t
ccataacaagctggtgcncccagcagctggccacactgaagccccgcactaatattagtcccaatgcgcggtaaaatttcttttttcccattaaaaatcaaacatgccttggatacatatacccaaa

SEQ ID NO: 621430 - DNA, 209 bp, Homo sapiens
tcttagataggtgtatgcgatttgtctggtttattccgatgacgaccactacgaattccggcgacgatcacgaggaattccggcacgacgacgacgagttccggcacgaggacgacgaattccagcacgacgacgacgaattcgtcgtggtggtgcatggccgttcttagttggtggagcgatttgtctggttcattccgataacgacg

SEQ ID NO: 621431 - DNA, 559 bp, Homo sapiens
  misc_feature (491)..(491): n is a, c, g, or t
tagatcccctgcctcgctgtcgctagtgtcgcagctgttaccttcgtctactgatgcaagttcggcaggacctcctgatcatattgattcctgaggtactgtggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacanatgataatttcagagaatttgtgaatgagtcagtctcttggagagaaattattacaaaaaggctgctg

SEQ ID NO: 621432 - DNA, 101 bp, Homo sapiens
gcggccgcctactactactactgctgctcgaattcaagcttctaacgatgtacggggacatgttaatccaataatgcaaaaaaaaaaagttgtactgcacc

SEQ ID NO: 621433 - DNA, 561 bp, Homo sapiens
  misc_feature (54)..(54): n is a, c, g, or t
  misc_feature (561)..(561): n is a, c, g, or t
cgactcgaatgacagaatatacacacagaactctcttcactcgtgactctgccnttccatattcgattgagactgagcagtaggctctgagtcgctatcactgtacataaatagcttactcaccaaaactgtcattatctgccttaacatggtctgaattgcaacagatgtagtctcatttacaccagtatttaagattctacgaatgggaattctgatggtactgacataggttctcacacctgcccgctcagaacgtgaaaatgtacgcctaaaacctcctcgttcactttcataggtgacagtgttgtttggtgtctgagacctagaccgagttctgctggctatgctctctctgccgatattctccaggacgaactcttcttacttgaagatcaaggactatggttggaggtctctgtcccgatcctgtagattcaccactggcagctgtgtctgaagaacctgctccttgagaagcatttcttgttccagaagctgcaaaaagaactctacttagcaactcaggcccagatatgtgctgcctcaatgtcacatggn

SEQ ID NO: 621434 - DNA, 601 bp, Homo sapiens
gagtttgtaaaagggaggtgctggagtctgaggagttttcaggcttccgtctcgaagaaagtctggcaggctcggaatgtgtcactctttccctcaggcaaatagtttttcaccttagagccagcaaggccaaaccgcccagtcacccgtattcccacagtctcagcagggaggaataagtttttttcatctgtaattggggaagccaagtcagtaaacaaaaagtggaaaaacccaaggttaaaagcatcgtgtgtgacccaccagtaacaaatcgggcaaatgttccagcattaactactaaaaaaggactaccataatttaccattatcacctgagctaagaggacaaaacacataatgggcaaacacttcaaactttttcccaaattttttgggggcacacacacttttaaaaaaacaatttggaaccaatggtcctaagatctccaccaacaggagaatccattttacggtatgcttgtgcccattccatcgagtaagacaaagaattactaccagaagatgacacatgatcggaaacaacattatcaaacatctgaagatgggtggttttccactttggggagcaacctattggc

SEQ ID NO: 621435 - DNA, 250 bp, Homo sapiens
tgatttggttggagtctcgctccttggtatgtcgcctgcactttatgactacattttcgttttaacttctttcatggacttccttagttatacataatcattaatgtagaaatttatgaaatacttttatgaattaagataatttttaaatatcgttaaaatttattgaactaaaaagtaatgtacataaaataattcatgttaaagatggaacaaaataattaacttaacatgttaggtgatacagatg

SEQ ID NO: 621436 - DNA, 133 bp, Homo sapiens
cagttcctagaagattccagtacgtagagatctgactgtcctacactacttaccctccactgtctcatgacacttgtacaattacctggagactcaggagccatctcagaacatcatgtcggaacacgtaact

SEQ ID NO: 621437 - DNA, 186 bp, Homo sapiens
ttatcgcatctagtcattctttaggcatgcatggattagctgcccactgtatagaaggcttgtctctaactctgtgtacagatagacctcttccccatgatagacgagatgtatgcttttgacctgctattgcatagaagaagagctattaagatttataacccaagtatattaacaagatgattg

SEQ ID NO: 621438 - DNA, 421 bp, Homo sapiens
ctttcaaaggaatattcctcaactggaaggtaaagacttaattgttttgtattctcaccgctttctaacatatttaacattcttagggtaagtgtatatgtcttgtgtaacttcataatgcaatcttgattcattaatagctgtaaatatctcatgtaggctacttgacatctagtaagcttagacaacctctctctgttttattttgtaatgtttccactgtctttctttgcttcgtgtgctgttgactgacctgcagtttcagttacatgactatcacaaatgtagtccctggttagttctgagtggtcattcctttctcttgcccagggacccaaaaggaaaaaacacatgagttcaggatacataagttaacaaaataacattcacattctaactggtcgacgcgcccgcgaattta

SEQ ID NO: 621439 - DNA, 145 bp, Homo sapiens
taaaagcccccaaaaaaaagggttttttttttttccccttttttttaaaaaggggggggtttttttttttggccccgtttggggggggggggacccaattttccccccccaacccccgggttttttttttttgggggttttttta

SEQ ID NO: 621440 - DNA, 919 bp, Homo sapiens
gggagaaggccgagggcagcttagacacgggcggttcccgtgtccctccaggacgcgagggtcgcctcttggtcggggaagccgatgcaacgggtgaggacctattcccggctgttggggcttccccgaatttcgaatacgaaattgcctcgctgtacccccgcatcagagcttcagaccaaggcgacaatgttagttttgagaaggccattcgggagggcgccgaggggctgagcgaggtcgtgtcaggcaggtgctagggtacggggcgacagccagtgtgatatccacgaagtcagccgtggtgcctctctatgatggtttccgctgatacgaatggggagcagaaggcgaagtgtgagagcacagaatgcggggcaaaggcggggctctgaggcgtgggagccctttagagcattcgaggggctaggcttcgctaggaatgccagccccggcgttgtgtgtatacttccgggcttctagtacaataggtattgtcttggggcagggtgtaccgtgcgggacttcctaggcaatccatccgatcccgcaataagggggttgcagcggcgctggctgagggcagaaagtcccattggtgcttatgtcgcgatggggcacttggtcccctaagtgactgacagagtaggggtccgctggctaatgtggggcacgggcctgcgtgggctcttcagtggacccccaaagggggggacgagaatgcacaatgcgcccgaaggactctccctgccaagtcttaatccccattcggggataaggcccaatcacgggcaagcgtccccgggatcgcaggggcactggggtggtccggggctgggaggcgaaaacaggaacgtcataaggaaggagggttcccgcgcgacactggggaaacaacgattgggacttacttcttaaa

SEQ ID NO: 621441 - DNA, 954 bp, Homo sapiens
gcccttgatctcgtgcacccagctccagagaaagatggatggagcctgcctggctgcgtgctccaggtaggccgcaatcaggagtgtttgtgcacgtcaagtcgccctgaacccggaggaacgggagcagcgggccctttacgccgacatcctggactacgaagcaggaccagtgactggccgtaagcactggcaaggcccagctcaagaggacatcctgggggacctgtcactcgtaaccggcctggtctctacaccttgcttcagctctccccgaccaaccctgatcgctgcagctccgtgaggctggctgcgacgtgctccgttgtcagcgccctgtagtcccgcctgatgaggacagagcgagacgcgctgtccagggcgccatgaggctgctgggggaagcgaacagagagacaacctggagacgagctgcgacgtggggaacgtgtggtcgatgaaagatatcagacctggtaatgctgggccgaaatcggtcttatggcatggtggaaagggagcaaacttggacttgcgaatgccaagacagtaggaagggcttaataggcggacatcctcaattgacgtagccatgttccttcggagattatgggatcctgtatacccaatctggattcagcatgaccgtctacagcagcaagctagccaagtgcaatcgtgagtagtacgttgagtggggacacaacgggacttgacccttgaaacggtgcaaccaagagctccaggagggagaaacaaacattgggaatgaacgttgtcagcaccacagggacaaggacaggccaagagagaacgacttgggtgaaacccttgacatgggactccttagagtaaagcgctaccctgaatagattcacctatgtatgtaacggattgaccccgggaattacagacctaggaaaatatacatacaaaccacacaaggccacacaa

SEQ ID NO: 621442 - DNA, 460 bp, Homo sapiens
atcctcctgaaccacaccttcaacgagacccagatcgagtggttccgtgcaggcagtgccctcaacaggatgaaggagctgcagcagtgaggagccaggctggctgtcctgacccactctggaccctgctggatgtcacttttgtcacaggtccatgtgcatcatcagagcctaatctggtctgtgcagcatgacctcctgctctaatatggtgaccagacctgcttcctgcctagcctcagcccagtgaaccaccattgagggcgtttaagataatgttccagccccgccttcctgttcagtttggtttctctttgagcagcccatgcaactgtatttatttttgatgacagcactccctctacagaagtttttattctgcctgatcatttcactggtggctgaaggattttagagaaacttgttcttaaaagaaaaaaaaaaagatccatatctatta

SEQ ID NO: 621443 - DNA, 266 bp, Homo sapiens
  misc_feature (97)..(97): n is a, c, g, or t
  misc_feature (157)..(157): n is a, c, g, or t
gtggtcacccgtcggtagcggttcaactgcgtggattcggcaggacctaccgtgcgctggttggtcaaagaacagtggccatccaccagtcccaagncttggaactacttctagaaagcagaccaggtagtgcatttgttctagttgagctgcgacntgttagtcctcacagccatcttgtgggctgctctgaaccagcggttgtaggctgtaccgcataccgacgggatccgtgcacgttaacgattactaggactatgcagaaa

SEQ ID NO: 621444 - DNA, 1864 bp, Homo sapiens
  misc_feature (1745)..(1745): n is a, c, g, or t
agtcgaaagtgagtgcaagagtgacgtggagcatgttgtaccgtgctctctgaactatgaactcgacaatcctagtgagaccttcctgtcttgttgctcctattgcctggtgttggtcgccacctcgcgtacgcccaggaaggcacatctccgaatactatggcggacgccgcagggcgcggtcgtggccagtcgctgtactcccgcagcgaggctggttggcttgtgttgcttcggatgtctcggtgctggagcggctagtatccatcgtcttgctcccttgtctcctaggcgttgtgcgacgtagccttgcttagctagtaggtgtcgcctagtctttggttccatcattgcccttctcgcgggcccgtcccgtaggtgatcttctctttgatcttaatctttttttatgactattctcttccgcgatgggccttgtttgtaattctactaccaactatttcaaagtattgcttgagctatagccatgtgtgttcctctcggctgtaaagacatagggtatagttatatttatcactcatagcctcgccctaatgccaaattgttctgtgcaccatggtattaagatgccaaatttagttagagtaaattcgacgtctatcattatccagttttgcgctgcggccgtgcatattatagtttcccgtgggccatgcggtggtcttttataagccattttgaaagcgttacgcactacattctcttttccccattgttgagcggctacgggcaacttgccgtgttccctatgcggcgtttgtgtcacaattatgcggcgtatgttgtatgggagttccctcttgtggaaaccgccgcaggggaagtaccttgaagtgagcgcccccaaaattagcggcgaacctcgcgtctaatcgttgccgcctctttacattgaggaaccccccaaactttccgtttctttcgaagcaggccaacaatttaacacgagaaatagggaaatcccctttggtatactccttacactagacctctttttcccaattttggggctgggaacattcgcgcaggcccatttttggccctctggtgaggccccacagcgccaaatttgtggccgcccttagaattattcccccacggtagaagccccctttattgtgcttttggtattgaaaccggaaaatctcccccgtgccctaatggtcctccttcatcaaaaagggcgttgtgtcacggaacagcggaaagggctaaatataccgcgtaggatgacccccaagtttcacacactttagagaaggcacgccggagagttattatctgtaaccctcgcagggaaaggttcccctttgggagagctgtaactcagcgacgcgaaaacactcttgggtgtaagttattgggccgcccccacagcataagggcgtctcccccctggatttttgcgcgccccgattattgtaatttttcctcttatggccacagggcgattataaaggaaaaacggggagagctgcactttgctagcatatatcactaatccttttgttgaggaaatagtcccctcccttgttgaaacccgcttttaaaaggggaaaaactttttctccccacaaccatgttggttatttgtgtaaatacacaggggcaggggaacaactatagagtgttacacaccaggagggaaagacaacattatgaacgcacactcatctacagcgaagagcagcaggtgtttgtcttaaaccagaacatgcacaagngccccaactatcatccgtactatcaagggggaagtactaatctagtggtgtgcgacagcaacacaagcacgcacttgttgtcggctgcatcagatagggtctgctctctgttgactaaa

SEQ ID NO: 621445 - DNA, 552 bp, Homo sapiens
ttatcgagatccctgttgattcttcaccacggactaaagttgtgtcgctttcaggaaagtgccttgtttgatgttagagcccgggactggtgtggtaggtcaaaattcttcaacgaggcctgaggtagtggagcgggcagaaatgtgtgttgttggaattgagctcgggctgccgtgggaggttgtagatggctcaacaaaggctgatgtggtagtaggaggtgcaggcctagtgtcctttgagcttggacagctatggaatgtggtagattctccctgacgggttgtagagccggcagtggacagtgttgtgtgtggcgatctgctgctgctgtggacgggcgtagatccttcaaggagtcctgaggctgtggtgtttgtcacggtaagagtgttgtttcagtggagcctgggctgctgtggaaggtagtatattctggaccaagggatggtgctgtggtactgccaggggacaatgtcgtgtctgtggggcctgggctgctgtgggaagctggtagattcctgactgaggcctggcatggtggtactgcc

SEQ ID NO: 621446 - DNA, 427 bp, Homo sapiens
  misc_feature (108)..(108): n is a, c, g, or t
ggaaagggggggggcctgggagaaaaggcccaggggcgggaacttgtgaaggtcggtgtcaggggatgtccggtacgggcccgagtccctcagcgagttcacccagtnggcgggtgcggatgatctctgaggagcttggtggtctcagtaggagccagtgcagacggttgagagggtagtgtgaatctctgatgaaggggagattgattgacaagtctgtgtgtgtctgatctggctgcctttggcagagcaggaccgaactaccgatgtcaagagttttgcttgtgacagaagggtgtcgtgtgtcctccaccgtcagaggtcgtgtgctatgttgctcttcctggtgggtgatgcgtgtcgagattagatgaggactggcacgtgaaggtatgtagaaagacgtgtggagatggcacctcctggt

SEQ ID NO: 621447 - DNA, 127 bp, Homo sapiens
tctggtcgtactctacaggtatccccgccacccaggcgcacttctcctccaggctggctgtccgtgcctggtactttccagccaacctcgtgagccaggcgcccccagatctggcaaactttcttgg

SEQ ID NO: 621448 - DNA, 949 bp, Homo sapiens
cgttgggtcaaccacggtgcttcatctatgaccctccgtgtaccgcttcctgtggttgctccagggggatgtcttctctatgcaggcttctccctccctcttcaggggtctccccggggttccccggctgttcgcgctcccattatgtgccaccggtgggaattttttccccgggccgtttcttattatcaaaggccgtgccttttctagaccaattggggcgcgatactgcccctgcgtattctacaagacacttggctggctccgccccaacccgggatctgcgggaggatctcacaccgcgtgtggccaagagttgacaccccgtgggcccctgtgggcgccctgtcccaacatgggggcgaacaaaatcggtcctttgagacgcctccaaagaagtcggtctgagaaacctcacaagtgtgggccggccccttctgggagacattccactaaaggttcccctgtccttaaacaggtaatctcatattcaaagaccccccgggcaatggccatacttcgtagcaaccaccagggagttcttttctttctgaaaagcaaccactcgataagcgagtgttcgctgcccccccccgtggtgagtcgttcgaaagcaccgcggccccccccccattgtaagagcaccccttcgcctccccatatatgtttctatgcggcgaccctattattggtatgcagtctttttggttgggaggagagagacccacacttcgaagcaccatattagggggaggcacggtaacacaccgcctggtcatgttactgagggaggagaaaattttcaggtgggagtttttcttctcgccccaagacatccaatgatagagaacagacagtggataatattggcgggattcaaatacataggagaggcagagatttaacaaaaacaaggaaggatcaaaaaaaaacacccacaacaagacaa

SEQ ID NO: 621449 - DNA, 1234 bp, Homo sapiens
tctgttttggggcccgtcggtgtgtcttgtcttcggcggcggtagtgtcgtgggcatcgcgttgtgcggtgcctaggtgcgtgtgtggggttcttgttggttgtggcgctggctgtgcgtgttgcgtgtggggcctggccctgcgcgctttggtcacggttgtcgcgtctggtcgggtgttctcgtggtctggggtcgtgtcgaggctctcgcctcgggtgtctgctgcgtggtttttcttgtgatggggcctcttgttctcgttttccgctttgtcttgtgggcttggtgcggtctcgctgctcttctcgtgaggggccgctttgtatgtgttgcggggtccgcggggggggctctttgggttggggtccttgggggttgtgtcggtggggtggtgcgtgcgctgccgtcggtgttcatggtggtccggttcctctgcggtggttccttgggctctgctctagcttggttatctttgtggctagcgtgtctccgtgtggcggctgtttagtattgtaagagttagatgtccttggtattagatcaggcgtttgtttaactgactgtcatttcctcgtcgtgtgataggtcacttatgggactttgtggatagcaggctgctggtggcttgggagcatcagctggggccaatggcgttctctgtgcgctgggttcatcctgtgatttggctgttcccgtgtctttcctgctgactgccttgtttggggttctgtgggtttgggtgggaagagggtctcatctgcctgaatgtaacctggctagtctctcctgaatggtccctgcgggcctggctgtgtgtgagcgtgtggtcagatggtggccgcgctgtgcctgctcgtcgttgcctacatgtgccctgtgctgttgatgggcggctggcttgcagcgcgtgcacccctctccttgtgctcatatgagtgctgccttttgaccttttcaaagaaactatggactggcgagctcctaggtcctctggcttcctggtagagggcggcactgccgaacgggtctgctgggtgtggattggatgtctggggtgtgggaggttggaagctctctgtggcccacttgggcaacccacgcttcatgtccacttctggttgccacggagagtagcaaggcaaagtccagcaggacatgaagttgctattaaatggacttcgtgattatttgttttgcagttaactcctcttgtgatttaactcatatcgcc

SEQ ID NO: 621450 - DNA, 317 bp, Homo sapiens
cctttactgctatcctccgcctcccgagttcaagtgattctcctgcctcagcctcccaagtagctgggattacagatgtgcaccaccaggcgttggtaatttattgtatttttaagtagagacagggttttcccatgataggtcaggccggtctggaactccgtgacctcaaagtgatccaactcacctacagacctacccaaagtgctagggattacggggtgtgactcgagcacgcccagcctagaagcttaattttcaaagacccaatctagagggtctgggcagggaccctaagcaatgtgttcacttggtta

SEQ ID NO: 621451 - DNA, 290 bp, Homo sapiens
tgtacaagagaaggtgactaaagaatcaggatagggctgggaacagatggctcacgcctgtaatcccagcacttcgggaggccaaggcaaggcagatcacatgagaccagaagtttgagaccagcctggccaacatggtggaaccctgtctctactgaaaatacaaaaattagtcgggcttggaggcgcgcaccattactatctagctaatcgggtggctgaggcgtgagactcacttgaacccgagaggcagaggtagccgtgaggccgagaatgcgccattgaacccc

SEQ ID NO: 621452 - DNA, 396 bp, Homo sapiens
cctagttgcaccccagggcctggggccgccccacgctctgtcacacccatggcgccccgggagaggggccatgcctccagccccccagctcgcccgacccatcctgtttgttaataggtttcaggggttgggggaggggctgccaaatttggcccctatatttttttttaaattcaacttgaagatggggatttcccctgcccttcaaaaaaatgttccaaggtaagcctggtaaaggtcatccccccctccccaaagcccccgtttttaacaacctccaacccgatccatttaaaggccaaatgtccttttgcaggggccttccccatggattaaaggggcttatgtttttgtgagttttaagtaaaaatttgtattgttttgttataaatgtta

SEQ ID NO: 621453 - DNA, 1215 bp, Homo sapiens
ttttttttttattttagagacggagtctacgcttggtcacccaggtctgacagtggtgctacgaccatgcggctacactggcaaggctccacctcccggggttcacgccaattctacctggcctcgagcctctgccgagtaagctggggactaacaaggctgcccgccaaccacagcccgggctaaattttgttggtagattatttgatagtaagagacaggtgtttcaccggtgggtctcaagaactcctggaccatcgtggatccggcccggcctcgggcctccgcaaatgtggctggggatatcacaagctgtgagccaccgtgggcccgggccatggaatataatttatatgggacaaagaattcacgtttaccctaaggtgttctccacaagagttctagctaatgagggttgttgaacaataagtttaagctatgctgggtagatccacacacagaaagaacttatcctgtgggctctcgagaagagcattgtgtttcacaaacaccgatggggctttccgcttcagattcagacgaaaagcgcccgtgtccaaggtggcacagggcacatcatacaatcatccatgagtcaaagccacctgtcctttataaggcattatctcgggcgtcatttacagcagttcaccatagacacaaatgtgttggtatctgaaaaaagacatagaacgggaagctgcaacagatccttttacaataaaaaacgctttctaaaacaaggatgggtctaaataaccttggggaatggggcatgggcttctatccacagaccattcaccaagtcctacagtccataaaattcagcccttccagaggaaaggttccaggcatccaaggggccatcggacatatcacaccttaacgtgccttgaatggattgctcccgacacacactgtggaacaatatacggcgggaaccccggggggcgccacggactggcggcacaaacatggaatacctcaaacggcacttgcaccagtcccagaaaatacggcgcaagtctccccgggtagggccactaggtgccgagaggagccaaactaaggaagccacaacagaacagtaccacaaacaaaacagcgcacaagacaggaatacaaatatcaggagaagagcgataacgaaaacaaatacctcttctcgccccctccccttctcctaagatagagggggaagagacgaagaagacc

SEQ ID NO: 621454 - DNA, 396 bp, Homo sapiens
gctatgtgttagatgctcaatatacctgatgctctcatgttgtccagtacatataccagtgggcgaaacgttgcgcagtcttaacagacagagtccctcattgtgtggacctatacacacgcttacgcgatacagatgagtgctagctagcccacgctagtcgtagattactttccttgaatgacattagcagaggagctccctacgtatgccagctctggaatcgatcagagctggtccaggttcctgccagcgcccacatcattcaagttattagcctagcctgagtcatcgagcgtcgacgtaccgagctggatgatactttatacgacagatcgtgtatgacagacaagtaccattgaatgcacgcagatgcgtcatacaccttgctacctg

SEQ ID NO: 621455 - DNA, 331 bp, Homo sapiens
acggacgacgagtccttacaaggttgtgatcaagttgtcggctggaattagtgtctcatatgaggcttgcggtcttctcccaacctcacatggttgttggcagaatttatttccatgcaactgtggatctcatgtggctggcttcttcaaaaccagccgggcatggtggctcacgactgtagtcccagcactttcggaggccgaggcaggtggatcacctgaggtcaggagttcgagacgagcctggcaatatggtgaaaccccgtctccactaaaaatacaatacttagccgggcatgatggcgcacgcctgtaatcccagctacttggg

SEQ ID NO: 621456 - DNA, 108 bp, Homo sapiens
cacaatgtgactgtcacgcccacaatggactgtcactgcccacaatggacttgtcactgcccacaatggactgtcactgcccacagatggacttgtcactgcccacaa

SEQ ID NO: 621457 - DNA, 414 bp, Homo sapiens
ggcagcgcgagagcacgccagcatagccacttggcctggcaatccaccgtggagcagtgcaggacaaaacgcagcaagccagcaaaagagcagagagcagactcctggagaaagggttgataagcggcaaggaaagagctggaaaaagctaccaaagacgagctgaccatacacgttcgcaggcccctgaatcctatgaggaacagagatctctgttgttaggaagatcgatggaagagcagactttatggtggtggagaagaattcagaagtgcaaccacccgagtctcgcagaaggaaacaaagcaacattagcaaaactgtttggctttcttttggaatacgttggcgatttggctactgatgacccaccagacctcacagtcattgataagttggttgtgcacttatatc

SEQ ID NO: 621458 - DNA, 409 bp, Homo sapiens
  misc_feature (30)..(30): n is a, c, g, or t
  misc_feature (57)..(57): n is a, c, g, or t
cacgaaggcggcgcgagagacgacgagggntgaaatggagatcaagctataaagcanagatccatggtggagattaagattagagaagggaaggagaaaagaattaaatggagaaaacgatggaactaggttacgaggagcagagaaaatcggctaggaaatttaaggattctaggattgagaagaggcttgcaatagatgactaatggctataaaaatggagatcccaaagaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagct

SEQ ID NO: 621459 - DNA, 313 bp, Homo sapiens
  misc_feature (188)..(188): n is a, c, g, or t
  misc_feature (192)..(192): n is a, c, g, or t
  misc_feature (199)..(199): n is a, c, g, or t
  misc_feature (210)..(210): n is a, c, g, or t
  misc_feature (288)..(288): n is a, c, g, or t
gcatgatatgttcacggcatacatggagtaacagaccccaggaaggaaattgcaatgccagtggacacccacccaatccgcattctctcgcaacgccttagcattgcgcccttctgcgagcaggacgctgttgagtctttctcttgtatctcaccgtctctgactcgctacatgtcctggggagccgnctgnctcactnggaagagtaangcgcaagtctgggggccggtggcttgcctgcgatagggattggggagcgacatcgtgtttcaagggtcagaggagttnggtcggttgttcgtttttatttggt

SEQ ID NO: 621460 - DNA, 291 bp, Homo sapiens
ggatcctccctgcctcagcctcccaagtagctgggattacaggcgcctgccaccatggctggctaacttttgtatttttagtaaagatgagattttgccatgttggccaaggtggtcttgaactcctgacctcaggtgattcacccgcctcagcctcccaaagtgctaggattacaggcgtgaaccaccgtgcccagcctcattggagcattttggatttcagatttttggcttagcgatggctcagccagaagtataatgcaaagggggggggggggggggggggaattc

SEQ ID NO: 621461 - DNA, 153 bp, Homo sapiens
agctgaagctcctagacacatctgtgagaaagtgctccaccaaagatatcgatgtacattgcgtggcaggaaaggtggagtgacaaaggcaccttgtttcgtagaagacttcttatgcacatccttctttgctttctggcgttgcagcagact

SEQ ID NO: 621462 - DNA, 311 bp, Homo sapiens
gccggtcatttcctttataatcctcttttggaaattcaagttagtccttttaacccaaataaaagaggacccacctctggggatatgtgactctccctctttataaggtgactggaatttgttaaaaaccgtgtttccacttctaacccctgttaccattccccctcacaaatccccacccaacacctggtttttaaagatcctccagtgtcaagggaagccacagagtctattaaagaggcagttttgaaccaattaattttggtccttataatttagagcattaaatagctaatatatttaagggcact

SEQ ID NO: 621463 - DNA, 139 bp, Homo sapiens
tgtgactggacaccttactgacatcttcagtacttatcactgtcctccaagctactgtctccagacactgggcatgtcaatccctggtaatgacgtacaaccaacaaaaatcttacctgatctaacaagttcaatattc

SEQ ID NO: 621464 - DNA, 432 bp, Homo sapiens
tctgcaaagcaatcgcaacgatttagtaaatgtactgtgtaatcatcatgcaatctcgtgtatcaccactcttgatctacactggacatagtttagactctgattgagtaaagagttgaatgcctggcaatagaggatgtctatggtacgaccatgtatagctgttaccattgtcgtcagaaatgacagcttctaaacctaatatgacatgacttagtcggttcacacatactgcttgtagacattcaaggtcacagggtccgcatatgcggagtccctgtcttacgagcccagatgctcgactgtggtacatgtcatcagtgacccaggctatcaggtggtgggtcccaagatccacagtagtgataatcatggcagtggatatggtgtccatgcgaatagagttcatgtggctggtgtgcatgtgtatag

SEQ ID NO: 621465 - DNA, 406 bp, Homo sapiens
cccacgcgtccggttattgttagcttgatgaaagctatgtggtatctttccctaatcatcaaagtaaataaaaaatcatttctaaaaaaaaaaaaaaaaaaaaaaaaaaaaaaaaaaaaaaaaaaaaaaaaaaaaaaggggagaaaaaaagagagaaaaacaaaaagaaagacagtaacaacaagcaagacaatatgtgtagaaacaaaaagagggcgaccaccacataagaggcagggccggactcataacacaatacgagacagatctaaaagcacgcttgttgataacaacacaggaccagcagaccggcgaaacaaccgcgacgacaacgcggagaaaaaacgaagagagaagaaaaacaacaataccagtaagagggagaccacacacaaaacgggggaga

SEQ ID NO: 621466 - DNA, 112 bp, Homo sapiens
tctcagaaaacgctagtgccccttcccctctacgaggccaggtactgtgtgtaccatgcagacttcacatccctgggtaagggctcacagtctcaggttcctggggacatct

SEQ ID NO: 621467 - DNA, 356 bp, Homo sapiens
gattccctaagggcgttgaagtaatgcctacccaccttcatgttctaatataggtttcccactttcaaaaaccccttcctcaacctgtaataacctaagtaggcaaaaaaggtgtttattcacaatgacccgccctgtaggacaaaacaggagggaggttcgtgtgtaaaacctccagatggcctgtgatgtcactcagatgtgtaccaatgcagccatggctaagtagcttggctttatgcttttgttttttcccaggagattaacgagaccagaaggatgcatgtaaccgcgcttggtagaggcggattctgggcgcaaatcgagtatgaggtccagcctggcgcacccttcat

SEQ ID NO: 621468 - DNA, 623 bp, Homo sapiens
tactctgtgtgtatatatatatatatatatagatagatagattttttttttttgtggagacagagtctctaatgtcacccaggctgggagtacagtgggcacaatctgggctcactggcaacctccacctccggggttcaagtgattttccttgcctcagcctcccaagtagctgggggttagaggcacatgccaccatgccgtgggctaattttgggtagttctagtagagatgggggtcttcaccatgtgggccaggcgggtctcaaactccgtgacctcaagtgatccacccacctcggcctcccaaagtgcggggattacaggcgtgagccactgcgcctggctgagtacaatattagtgtagacaaaccatgaagtttattatttcatataagaacatacaggtgggtttttctggcgtgtcgtgtccacctaaggttaagtagttcgggtagctcttcctattctttattctatggatcccatttctggattcttttataaccactgatgtttgtgatagtaactatgataaattaatgatcatgatttatcttctagagtattcaacatatgtttggtgaccacccaattccaacattaaaagtgtaatgtgcgcc

SEQ ID NO: 621469 - DNA, 335 bp, Homo sapiens
cttcgccactttatgtttttgtttgctttgtcgaagatcagttgagctgtaattacttttgggtttatttctgcattctctattctgttctattgatacatgtgcctattttacaccagtaccatgctgttttggtgactatcgccttatagtacagtttgaaatcatgtaaagtgatacttccagatttattatttttgcttagtcttggtttggctatgtgggctcttttttggttctatatgaattttagaatttttttttttctaattctgtgaagaatgatggtggtattttgatgggaattgcactgaatttgtagattgcggtgtttg

SEQ ID NO: 621470 - DNA, 545 bp, Homo sapiens
  misc_feature (402)..(402): n is a, c, g, or t
taccaggaacgttactcaggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctaccttggacggaaacaggtgaaccctgagaaggagacggccgtggaggggctgccgggcctggtggtggctgggtactcctactggacgctggcctatgccctgcgtctggcgggtgcccgcaagctgctggcctcacagcatatgcgacgcatgctgcccgtcgccgagtttttgtttcttatgtttgantgagaaaaaaaacagagcagtacaaggcacacttctggccacgggacctggtggccttctccgcccagcccctgctcgctgcccctacccactatgcaagggacgccgagtggctcagtgacacggagacatcctctccatgg

SEQ ID NO: 621471 - DNA, 417 bp, Homo sapiens
gtgacatctccattccagaagcatatccaatttgctccgtaaccttgtggagaagaccccggcactgatgaacgctgctgtgacttagtcgtaagccttcgcattggccacaattttggtactacgccaaggtcgagctggttcctcctacccctgctgagatccctagagctattcagacgcctgcaaaaaatattcaatagtgctcagactggtagcttcaaacagctcacagttaaggaagctgtgctgaatggtttggtgggcactgaggtgtacaatgtggttttatgtcggagagattataggcaagcggggccatcattggctatgatgtttgaagaccaatctttaacatctgattatattcgatttattatttgagtgttgtaggaccatgtgtgatcagactgctat

SEQ ID NO: 621472 - DNA, 153 bp, Homo sapiens
gggaaatgtgtaataggttacctgttgaatccggtttataccatgtgttgggcaactcagctaatatggtaaattggatttataccaatcccttccaaatttaacctaaaaattaaggcaggcccaaaattaaaattaaggaaggtacaataa

SEQ ID NO: 621473 - DNA, 129 bp, Homo sapiens
cacgatggctcgcccctacgtatcatcagtgctgcaagtgtgtggccgctacataagtcggtggaccgctgttcgtgctggagaagagctgccattgacacgcagaatacctggagcagcagttggcaa

SEQ ID NO: 621474 - DNA, 915 bp, Homo sapiens
gggggctgctgggactcgcgtcggtgtggcgatcccggacgtaggtagttagtgggccgggtctgaggccttgtttcctctttacttttccactctaggccacgatgccgcagtaccagacctgggaggagttcagccgctgcttgccgagaagctttacctcgctgaccctatgaaggcacggtgtggtttctcaaatatcggcattctgatgggaccttgtggtgtacacgtacacagatgatttagttggtagggtgtataaaacagaccaggctcaagatgtaacaaagacgatgcgagaaattccacagtcaataaatgcgatttatggtagccaaggaagcccgcacatgttaccatggaaaactgagtgaattggttgtgaactgacagactttgtcggtgtacttagggaagttaaatatcttggacatagagaaagtgtgggggacagaacgtactttatgtaactaagtgggctgtcagaagcttcgaggtcatgtgtaatatccttttaattacttagagagctagggatgcattgtttcagtacagaagggcttaattacttttgcacatgacagaattgcttctgtcttaggagccgtggagacttattttgatggtccggtaccacaacgtacattggttctactgggacaatcggtttccgtcattcgaaacctggcatatcgggaagaccaatctctaaattagtcactttctaaacaggcacttattgcccttttgccgaccagctttggggctatgtgggggggccacaattaactggactggataccagcacagtggtgtgacatcatgccatttacggggcaaattagaatggacatgtgcttcacacaaccgaggggacgcggaccgtctaggaggctcgctttagtgcgacac

SEQ ID NO: 621475 - DNA, 278 bp, Homo sapiens
aacatgtcttaataatttattgtgccatccatctgcgatgtatctctcaatcccacatcagtgattttcacgtttactcaggactttctacataacatgatttccatatggctcacacatatccacatatacctaacttcattcttgtttgttttacagtgatccggtctcactctgttgcctagactctgtagcatacttgtgcactcatgtctcactgcagcctcatatttctgggcttaagcactcctcctgtctcactctcccatgtcgctggc

SEQ ID NO: 621476 - DNA, 350 bp, Homo sapiens
taattcttgaatatgagactatacagtgcttcctggatggtgtcctctttgctcactgtgctctgaaagcacgaaggaataacttcgagatccttcagatcatgtcgctcggtggtagacacttccttagctatgaagtacgcttaatcagttgggaatctcttcctccggccctcatcctcatcgaccgtccgggggcaggccttggtcattcagcagcgaggttaatcaagggagaggcctgctatggtgtcgggggcccaagttgggagacaaggtcacgttggcagggggcaaatcccccctgtggagttccacagagcaggttggaaagggtaggactggccagt

SEQ ID NO: 621477 - DNA, 107 bp, Homo sapiens
agccttccccgcgagctggacgcggcagcgcctctgtctcgctttttcttatttatccaccaaaaaaaaaggtgaaatggggttttttccccccccccccccgcccc

SEQ ID NO: 621478 - DNA, 682 bp, Homo sapiens
tgttcactgtgacatatagaaatgctactgatttggtacatgatttggtatcctataaatatactgaattggtttatcagttttaatagtttctggggatatctataggtttttccaaatataagattatatcatcagcaaacaaggacaattggacttcttcctttccaattgggattctcttcatatctttctctggtctgattactctagctaggacttacagtacaatgttgaataatagtaatgacagtgggcatcctgtgtgttccagattttaaaggaaagtcttttagtttttccccattcagtatgatactcactgtggatctgtgtatataaattttattatattgaggtatgcttttatctatattcagtatttgagggttttaaaaatgatggatgtttaattttatcaaatgcttggtcagtatcaattgaaatgatatggcttttatccttcattttcttgatgtgatgtatcatgtgattgatgtgcaattgtggaaacattctgtggtcccagaattaaaatcccactgtggatcataatgaataatcctgttaatatatgtgtagaacttagttgtgtactatttggtgatgattttgcttactatgtggtcttagtctgttctcacatgctaataaagactactgagatgggtatttattaacc

SEQ ID NO: 621479 - DNA, 228 bp, Homo sapiens
  misc_feature (116)..(116): n is a, c, g, or t
  misc_feature (156)..(156): n is a, c, g, or t
gaagcgggatattaagtggggcaaggaggaggcctcaaggttacatgctcatccatagcagcagatacctcttgagtagctgaaccacaccaagctggacctgggacttgagaagnccccttcaacctctgtcaggacgcacgctggattagcatntgctagggctgccgtaagaaagtaccaaaaaataagtggcttaaccaataaaatattgtctcccaaaaaaaa

SEQ ID NO: 621480 - DNA, 1408 bp, Homo sapiens
gaagatacactccgcctcaattctccattgtcatggagtactgtgaactcttgaccctgagggagctgttggatagggggaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagatttgggtacctggctgagtttggggctggcagccttcagcacaccaatggtgtcaatggcaggtgtgcgtgggacaagaacatatgctgtcatgattgtgctacagtttctttaagaacaccagcttgcaggatttgagttgaggaaaacacagattccatgagtttgggaactacgagagaaaagacagacagagtcaaatctacagcatatctctcacctcaggaactggaagatgtattttatcaatatgatgtaaagtctgaaatatacagctttggaatcgtcctctgggaaatcgccactggagatatcccgtttcaaggtgaagaatgtgaagactggctcagccagtggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggagcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaaaaaaaaaa

SEQ ID NO: 621481 - DNA, 510 bp, Homo sapiens
  misc_feature (61)..(61): n is a, c, g, or t
  misc_feature (106)..(106): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (141)..(141): n is a, c, g, or t
  misc_feature (147)..(147): n is a, c, g, or t
  misc_feature (410)..(410): n is a, c, g, or t
  misc_feature (423)..(423): n is a, c, g, or t
  misc_feature (426)..(426): n is a, c, g, or t
  misc_feature (428)..(428): n is a, c, g, or t
  misc_feature (430)..(430): n is a, c, g, or t
  misc_feature (445)..(445): n is a, c, g, or t
  misc_feature (457)..(457): n is a, c, g, or t
tggttgtataaaattgcagcagcaagaaacccaaaggagaatagctctaggggagggaggnggatgagtatgcatgggggagaggctcttttgtgaccagtgttgngtctngancnctctcccactgtccagaacacctcnaagccnctacatctttttccatataccaacgccttggagatatatatgcagaagtgaagtgagcaggctgaggattagggcaggtgtctggaatatggtcaggagtgggaggggagttacatagctcacaggcaatggcagaacagcacaaaggctataggtttcattcccagccctcaacttaaaagacctcaggggcagacactgactccagcctggctgtgcccttaccctaacgccattcacacttttttttttaaacacaggtnataccctagtttnttntngnaacctcgcccccttnctctttattgantacgagcgccagccccggcccctttctctccaagcacaggggcacgcaggcaa

SEQ ID NO: 621482 - DNA, 561 bp, Homo sapiens
  misc_feature (149)..(150): n is a, c, g, or t
tatggccgggggtcctctgctgaaacgttcttctttgacggcaacttgtgtatctccctgaacggatttgggctctgtcgactgtgtctaactggaatcaatggagcgcactgtcgtactaaaatccccgttgaccgtaaatggattcnnaattacgttatgcagaacggtttccacggcttttagggggtatcgatcgattgcgcactactcgggttgtgtcatagaatccgttaaacctcgttaaggggactgaacggttacgcaactgatatagagggagcgctgatcattttcggagttaccactttatttagaatgacggaaatgttgggggtctgcggccccatatgtatgccttctaaatgagggattgagataatgggtgtgtatgcgaacggccccaacccgggtaccttaagtttggggactttatacagttcaatcttttcctaattgcgagcgccgagggcggggtaatatctggaagaccgggcacttattcctttttttctatatactaaaccctcctttttcaggatttgtggaagagcccaagcg

SEQ ID NO: 621483 - DNA, 669 bp, Homo sapiens
ggtaccatataggttggacgaaagctgtccctgacacagaaacaattggctgtatcaggctgctgatgtcggcccaaacagaggcagggccggatgagattatatgataacttgcttgtgggaaggaatgaaaaagcctgtactaagacctgttaaattttctaaattacaagaagtcacccaggagccgtctgagaacctcacccttttccaagctagattggtggaggccatgcgtaaatatgtaaatttagaccctgaaagccctgaaggccaatccattctcgctgtacattttgtaagtcaggcttacccagacataagacaaaaactccaaaaattagagcaaggcccacaaactccctttcctattttattaaatacagcctttgaggttttcaataaccaggagaaaacatcaaaaataaaaaaggctgaattggaggaggaagaatgccatcactaagctaattacatggcaacagccttggcacattctttttcttcatctaataaccccaaggctcatccctacactactaacagaatgggggcctgtcattgctgcagaatccaggacactggagtagagaatgttccaaccgccggttacaagccacttcaggacctgtctcatggcaacagaggtctgggagagcaggtctctct

SEQ ID NO: 621484 - DNA, 1377 bp, Homo sapiens
gaagatacactccgcctcaattctccattgtcatggagtactgtgaactcttgaccctgagggagctgttggatagggggaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagatttgggtacctggctgagtttggggctggcagccttcagcacaccaatggtgtcaatggcaggtgtgcgtgggacaagaacatatgctgtcatgattgtgctacagtttctttaagaacaccagcttgcaggatttgagttgaggaaaacacagattccatgagtttgggaactacgagagaaaagacagacagagtcaaatctacagcatatctctcacctcaggaactggaagatgtattttatcaatatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggagcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaaaaaaaaaa

SEQ ID NO: 621485 - DNA, 497 bp, Homo sapiens
gatctcttccatgagacactctacgcagaaggcggatgatgggcgctccttccccgcaagttatcgaaatccaatgtgcggtgttgtgggcatcaaaggtagacaagggcgtggtccccctggcacgggacaacttggcgagactagcaaccaagggttggatgggctgtctgagcgctgtgcccagtacaaggaaggacggagctgacttcggcaagtggcgttgtgtgctagaagattggggaacacagccctctcagacccatcgacatcatggaaaatgccaatgttcgtggacccgttgtgccagtatctgccagcagaatggcattgtgcccagtcgtggagcactgaggatccgtccctgatggggaccatgacttgaagcgctgtccagtactgtgaccgagaaggtgctggtctgctgtctaggaggctctgatatgaccatcacgatctacctggaaggcaccttgctgaagtccaacatggtcacc

SEQ ID NO: 621486 - DNA, 216 bp, Homo sapiens
  misc_feature (182)..(182): n is a, c, g, or t
tggccagcgccagtgggcaggacctgatcgggctcatctgctggcagatatacaagcgaaggacgggagccgaagctcaatgacaatgtcagtgcctactgcctgcatattgctgagagatgatggggacggtggacacctgatttcccccctgctggattccaagtgagcccattcataangtttggcttcaggtactttgtgccctggttgaaa

SEQ ID NO: 621487 - DNA, 1132 bp, Homo sapiens
gaagatacactccgcctcaattctccattgtcatggagtactgtgaactcttgaccctgagggagctgttggatagggggaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagctttggaatcgtcctctgggaaatcgccactggagatatcccgtttcaaggtgaagaatgtgaagactggctcagccagtggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggagcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaaaaaaaaaa

SEQ ID NO: 621488 - DNA, 1457 bp, Homo sapiens
cgtgacgcgtgggtccggacggcgtggtgtcgatccacgcgtacggagaaaaagtgcagttaaacaggacttgtactacctctgatatctattccttacatcatttatacactgttgactatccattatacatcatatacatatatctctatcatacaatttcttcaacttttggttcattattccatgtacagtgtgttttagcaggaggcccattaaactattgaacttatgactacattagccatgatacaattatctgattatcatttatacaaggatagacaccagatcattattaaattgtatatacataccgtatatacagatctaacatggatttacaaacagagagtaaaatgatactccaatagcaccaacagatagaccatagacatatttaacctcatgaccagacaccatgagaagcaacgagagcattagaatgacctaaaaccatattctagggcaacataatatacagagaaagcaatgctacagcatgatatcatacaagcacaatatgcagcctggattcataatacataaaagacctgtcacactagcacgtccaagctagatcacaatatcagaaactacaaaactacataaaccaagagaaaagcaaacagggaggacacgcaaatgcaccacactacgacaaggaaacacccataataacacaacactgagacataacaaacaggacgaccaggaactcaaagaccataactctgccgacacaccaacataccgacacagatcaaagaccacaagcgcaagagataccggacagtcaaagaaacacccgcacataacactaagatgcacgacatacactcataaggacgcaggaaggacgcaggagagtcaacacggactacacagagccagagaaaacaacaagagcgcgagaaacgcaggaagagaagagagaggaaacagacaaagaaggagaaactacaagctagagtaacaagagagagagagagaaaggagaagagaagaggaacagaaagaaagagaggaggacgagagacacaagagagtaacgaagaaagaataaatcccccaggcaaagaggaggaagaacgagagacatagaagagataagacacacaataaatcagaagcggcgaacaagaaaggacagccacggcgcgcagcaccggccccaacaccgcaagcgaagcagcggggagcccaagcgcccagcaccgacgcgtaagcggccacgcctgcgcccagacgagcactagcgcccgcgccgagagactaggagcacccgcgcaccaacgccggcagaagcagggcataacacgaagacgaagacaagagcgacgcagaaacaacccagtagcgagcagccacaccacctggaacgagacagcggctccagcacgccgagcaacaagactgaacagcaccgacacgactcacacgcgcgacaccagccg

SEQ ID NO: 621489 - DNA, 394 bp, Homo sapiens
gctatctactagaacaaatacaaacgttggctgggatgtggtcccagctactcaacaggctgaggcaggaggctcacttggaggggaggtacaggctgcagtgagccgtgatcatgccactacacttcagcctgggggacatagcaagactcagtctcaaaaaaacgaaaagaaataaagaaaagaaaccagtatgagaccgggcacggtggctcacgcctgtaatcccagcagtttgggaggccaaggcgggcggatcacctgaggtcaggagttcaagaccagcctgaccaatatggagaaaccccgtctctactaaaaatacaaaattagccaagcgtggtggtgcatgcctgtaatcccagctactagggaggctcagtcgaacggactg

SEQ ID NO: 621490 - DNA, 196 bp, Homo sapiens
gcgtcgacgaatttcaacacaaagcatacaaaatatgttaattttactactttgtcatacactggcaacctctagatgttaaaaaattaagactatttgtccattatatacactatatacagagcaaaacaaaatgcacaaaacatacagaaaaatggtgtctgaaaatgtccaagtatgaacacactagcatatt

SEQ ID NO: 621491 - DNA, 748 bp, Homo sapiens
ggactgagactgatttgattaaagcaccagagtgtaatggccctcagatcagtgctggtcctggggttccacaccctgatgaccctcctgagacccgcaggaggcatgggccaccaaagatgaccacatgggctcctacggacccgccttctatcagtcttacggcgcctcgggccagttctcccatgaattcgcatgagggaatcagctgttctctgtggacctgaagagccgcgaggccgtgtggtcgtctgcctgagtttggtgactttgcccgctttgacccgcagggcgggctggccggtatcggcgtaatcaaagcgccatctggactatcctggttggagcgctccgaaccgcagctagagccgatctaatcgtgcgctccactgggtgacctgtgtcatcccacaagatctcggggtggagactgggccagccgcaagcatcgctcatctgcatcagtggacgaacatcttgcccccctagtgatcacatatcacctggactgcgcagatggacaaactgtcactgagggatgtggcccagagcagcttctattcccagcctgaccatttgttccgcaagttccacttacctgcccttcgtgccctcaggcgaggacgtctatgactgacaggtggagcactggtggcctggatgcgccactcctcaggcattgggagctccaggtgcctattccatcagcagatgccatggagagccctgatctgtgccctgaggcctg

SEQ ID NO: 621492 - DNA, 345 bp, Homo sapiens
cagcactttgggaagccgaggagggaggatcacttgaatccatgagatcaagaccagcctgagcagcacactgagaccctgtctctacaaaagaataaataaataaaatcatttgtattatgtaacggcatcaaataattattaaaaattaatttacaatagtgctaaagaacatggaatgcttaggaaaaaacttaacaaaagatgttaaaatttttaatgctgaaaactacaaaatgttgctgagagaaattaaagatttcaattaatataccacatttctgaattggcaaaaatatatctcatgaattggaaggctcagtatgattgtcttaatctgtttgg

SEQ ID NO: 621493 - DNA, 796 bp, Homo sapiens
atacacgtgggcgatggcatcgtcaaaccgaaccactcatcgctcatacagcatgatgaatgttataagtggcattaaacggataagatcgtatggtgcggaccgtaattctataggtactgtatctataacactgaatcaatcgctaggatggattgcttgtcatccactcgaccccattcattgcagctacaaataaatggatttacctgtatcctctttgatgccgcccaatgatagatgacatagtcgccgtctctcgtctggagaaattggggaacacctttgttcactccatggagagccattcgcaattacgatccttgcatgagacgcatatcctttcataatttgactgtggtgcgcatgctggatgcatgaatagcgtaatctgagctccactagtcgtattatccagaataggatcaatgatgatggctcattggctgggggggatccgcatggggttatcatctgtgtccacttctgctgaatagcccctcacagtttccttcatgcgtgatgatgaaaatcaccggaaaaagtatgaaataagcatctgtccagcatcatacatttacatgacacttccttgtttatactatacttactgactttagtcacgcactggctcacgtcgtccatgcaacgacttaggtgctcggggtaagaactcatgaacaactgtaccatgtcgattacctggcactcaagacagaatgtgcgtgtggtccctctgccaaaagtgggatgaaggggcgacctgccccccgcacggtctaacctggtccaatgg

SEQ ID NO: 621494 - DNA, 828 bp, Homo sapiens
ggtctgtactaaaaatacacaaaattcgccatgggcatggtggccccatttcctgtaatcccagctactcagtgaggctgaggcagaatcgctgtgaacctgtggaggcggaggtttgcacgggagcgtgacgatggtcggccacctgcttcgtccatggcctgatggcggacatgagtgatgactcgcgctctcagaacaaagaaagaagaaaagatggcaaaaatattagcactggaggtcgagggacgcaggatgtacgtagtaaatcccgaagcttgcatcgaaacgcgtgagatgtggggagcaagggtctaagaattggatgcccacaaggaggacaggagagttgacatatagaccatttgagaaatcatgtgagcgtcctgagacagcaatatcaatgcgaggggaagcaaattgctgcagaacgcatgcggttcttctaaaactagacataaagagacagaatctccacctgggatactaaacgttggagcacaggcaagtagcacgcatagagaagggtgagataaatcacccgatggaatagggggcagatggaaaaggcacccggaggacctggagagtgggcacgcgccacactcagctgtgatatacaccccaatgaggcaagagatctggaggtggccccataggggaaaaaagagggagatgcggactgagtacacaacagagcaaatagcatgtgaaacgaacaacacacgaggtttgagcacattttgcctttgtcaacggcattgtgatgccaccccattaaaagagaaaagagatactgcgaatccctttagggttaagctttcctta

SEQ ID NO: 621495 - DNA, 370 bp, Homo sapiens
  misc_feature (21)..(21): n is a, c, g, or t
  misc_feature (78)..(78): n is a, c, g, or t
  misc_feature (85)..(85): n is a, c, g, or t
acttggccctcctccatgtcnaaattttaccccaatttaaagaataacattactttttttttggaagacagagtcacnctatcgnccccaggctggagtgcaagtggtgtgatctcagcctcactgtaatgtcctgtcctcccgggttcaagtgattcctcatgccctcagcttccccaagtagctgggactacaggcgtgtgcccacccatgcccagcctaatttttgtatttttagtagagacggggtttgccatgttggtcaggctgggcttgaactcctggcctcaaatgatccacccgcctcaacctcctaaagtgctgggattacaggcatgagccactgcatctggcctgtgagttacttttt

SEQ ID NO: 621496 - DNA, 668 bp, Homo sapiens
  misc_feature (6)..(7): n is a, c, g, or t
ggaganngcccgggaaaggggctagatggcgggccaagctttagggtacagaaattttgcatttggccaacagtgcgttccctgctacaggccaatctccagccccagaactggacagtgaggggcactaacataaagcccaacaatggagggaaaagaatggagctaccttttgtggcaacaaagtttcaagagtggcagctaaataatagtctaggtccaactcttggggggcttccaaacaaggtccctttaaaaacagaactgacggacttaagcgaacattcatattcaggatgaggcctccaaaagggtcggaaaggtttggttttaaaaaaaaaggggcgaccaattatttttgaaacaccagtggtgcgttaagctcaagccgaaatagaaaatcaggcttataaaaaccggtggacgttgaagattatttttttttttttttaaaaacctttccattttttattaatttgaagcccagagaaaaaaagggaaaacgattaaagaaatttatgttttttaaaaaagggggtttggcttttcacccaccgaaaaaaaaaaacaggtgaataaagctttggacctcaaatttctttctcttaatacaaaagggagagctgagaaggcttttaaaaagcgagggatacaaaccctaaagccct

SEQ ID NO: 621497 - DNA, 194 bp, Homo sapiens
ggtacctcgatgcgttaatcggttaccattggccatgatcatgctcagtttccgatgcggattgcgagccagacggacacacggcctcgaactggcgcgcgtcgacctgcgccttgtcgaactcgaaccagggtatctggagctcgccctcgagcgataactgcaaccgagagcagagcgccttgagtttgtcg

SEQ ID NO: 621498 - DNA, 288 bp, Homo sapiens
acagaggcaggacaggtacaggacgtgagagtggaaacgggagtggtatctagatgaggcagaggccaatctagactatggcacgaaaacttggatttcactcgttgccactagaagctgaagaagtgattacagatctacgccaacattttagaacagatcatcctgagctacatttggagaagtggacagacggcaggaccaagacaagagagacaatattgcactgtgtgcacgctgtttggagtaagacaaaggtggtggacttggacctggacgtggcaatag

SEQ ID NO: 621499 - DNA, 285 bp, Homo sapiens
ccagcaaatcgagaaaaactcagcgactgatcgactggtccccagtctactgtgaggatctccatgatcttcgtgttgaccacgccactgacacatcgccagagaacaaggtggtagggaaaggattaccatttcgtagtgactacaactagagatggggactcctcataggtcaccactggagtaacaacgtatgacccatcacttgagaggactggggccattgccgtcagcatcggactgagaaacgctggacggcccgcgcggagggactcctctacgagt

SEQ ID NO: 621500 - DNA, 155 bp, Homo sapiens
  misc_feature (27)..(27): n is a, c, g, or t
  misc_feature (71)..(71): n is a, c, g, or t
  misc_feature (101)..(101): n is a, c, g, or t
  misc_feature (118)..(118): n is a, c, g, or t
gccaagcattggggccgccatccctgncctggtcactggctgtatgggtcacctctgttggttccatcagnccagagcttctgtccaaaggccccgtcagntccctctcccaggaggnaccctagaggcaattaaatgatgtcctgttccattgg

SEQ ID NO: 621501 - DNA, 1005 bp, Homo sapiens
aatatatgtgagaaatacttggtgtttaccttatgaaaataaaggattgtaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaacaaaacgaaaaaacacaagaagaaacaaacaaacgaaaaggaaagacatagagaaacgcacgcacaaaaccgacgagaagaagagcaagaagaacacgagagacacatacacaaacaacaacgacagcacgaagacaacaggacaacaacgaccaacacagccgacagaaccacagccaacccgcgacaggaacacgaaacgcacaaagaagacacacacgagacaaggaccaagacaaaaaacacaaaaacacaaggaccaaaccaaaaaacaatacgacgaacgacgcaggagagcacgcgaaacacgacagaacagacgacgagagcagaagaacgagacagcagcaaccgagacacaccacaagaagcaacgggaaggaaacaagaaaacaagaatgagcaaacgccaaaagcaacaacaaacaaacacaaagcgaaaggacgaaacacaacaaaacgagcagcaagcagcagcaaaaaaagaaagaacgaaagaacgaggaagaaacaacaccacaagaaaacaaacaacagagagggaagagagagagaaaaaagggggacagagagaacacacaaagggaaaaaaaacgcaacaaaacgaacaaaataagacaacaaacgaaaaccgaagcagccggacagcaaaaaaacagaggaagacaaaaagaaccgaaaaagaaacacgagaacaccggcaagaagaaaaccaagcaaacaaacaacgagacaaaaagacacaggaaaacaagaaagacgcaacaaaaaccaaaaaacgacaagacaaaagcaaaagaacacgacgcacaagcaaacgaggacagcgacagcgacg

SEQ ID NO: 621502 - DNA, 314 bp, Homo sapiens
aaggatcccccctggcttgctcaggtctgcaaacggtcatactaagtggtctagggaccagcaataaataataattccaccccctataaacagacacatacacaaagtagattttgttaccgcagtttacaagcatgttcccatcacacagtcaacaccaggacaggtgattcaggggtagtcccattacgggaagacaccataatcacaggaattgactaggcaagacccccgtccactcaggggaggcgagggaattagagtatggatgaaccactctctgccgtcccaacagaacgaagcggggagcacga

SEQ ID NO: 621503 - DNA, 240 bp, Homo sapiens
gcccataatgatgattgacagacactatacaagatagacaaagacttgagaaaaaaaccacagaatgatccatcacatgatagaccagaatacagaaaatgtggcacctatacaccatgaaataatatgatagtcataacaaagatgagttcatgtcctttgcagggagacataggatgaagctggacaccatcattctcagaaaactatcacaaagacagaaaaccaaataaccgcatt

SEQ ID NO: 621504 - DNA, 146 bp, Homo sapiens
aacgattgtcctcagcttgcagcaggagctcaggtcaaaactgtgagcatggaggtgaacatcttgaagaagaccctggatggagtgagtgccaatgacccactgatgtgcccagattccatgtgagcatgatgtgcatgaatgca

SEQ ID NO: 621505 - DNA, 379 bp, Homo sapiens
ggttcaccgcaacccacatgtcacacccacttgtcagggagcagaaggtacaccagagacaggacagaggatgaggacagcagtggcaaacagttaaaaataccgacattgtagtcctggaaccatctagccaccttggaactcccatgtctgcctccctcaggcagcccatccaggagcctgtgggaggtagatatagaagagtgccaaaagtgcactctactatatctaccattatgttgttttctgtaagatccctgttttccattgctgtatcttctttccttattaccttccctcctatctctccttctccctatacacacacacacacacccccaacacacacacatagtgattgtactaaggattctaatac

SEQ ID NO: 621506 - DNA, 1447 bp, Homo sapiens
gcccagtgactgatggatcactgatctgagaagtccgggcattcccgtaattcactgatgacaagtggtgcccgcatgggtctggcagtgccgcataagtgcagtccatctgatgaggtccctgggattcgtaggacttggtagagacgtcgtattcgactaaacgagtgacaccgtgcatcgtactatcgcactatcgtttcgcttgagcggatgtgaactgcacattattcgagagttgtcgatcgatagagctcgcctcgtgcgctattctcaaagctacgcccgagtcctacagtcttacctcggtgatgctgactcatagggagcttagtggagttagtggacttggcatcgagaatgcactcgagcattcgttgcgagaccttgggagaaagatagtgagatggcgactatctctatttgcgctagtatgtcgagatttggctcgccctcaaagactccgagaaatttatcgagtcggtacaaatcgactcaggctctggcgcgcacctattgtagtccgcatcacgccaaactcaaaaatcctaacgcacattaacgcgcattctcacgagttaacgcacataagcaccgacagtggggatcgttatccagcttagggccacctttagagagaccaacataactaaattgtgggcccgccctttccctttggttgcaacattccttgtcgtttacctcagcggtggggttggctcctagttcatggtggtcggctttctctcgatggggtgtggcccgttcaaattccctggacagcgtgtgtgcttcgtgtctcccttctctaacttggtctattttcgttatggtgcgtttaccacccccccgttgtgttcccggtgtggttgtggttcgtgaacccaagtggcctcttaaatcccgcggtttgcatttaccaccgttgttttccctcacctccaaattggtgtgtctagttccaaacggtaatggaatcatggggctatccctgtggaggtttgagacggtcttcgatcccgataaatggagtggttgtaagcagcgcacgttggggacacttgccaggcatgtggatgccgcaaccatcttccgaattgcagctgagttagtatttcccacatataagaggggcctcccaataagatggcaagagactgccccgcaaggagtatagagagacatatctcaggctgctacgtttcgtacagcccctatttatattttgccaccctcttgctgtagaagtgggtctgccatgagagacccggcttcgataccccgagaaggaagtaggtttcgcacactgttaggtggagacccactcccatatacacagttagagtttggtactccggtgtgagccaacatagggacagggaagcgttggaatttcctcttggagacagcgaggctcacttccgtggttccaggcgggtacgtttac

SEQ ID NO: 621507 - DNA, 418 bp, Homo sapiens
aacgatggtcctcagctactcgggaagctgaggcaggagaatggcgtgaacccgggaggcggagcctgtagtgagccgagaccgcgccactgcactccagcctgggtgacagagtgagactctgtctcaaaaaaaaaaaaaaaaaaaaaaaaaaaaaatataaaattcataccttttaaaaggataagtggagtgtttgttaaaattgtttccccctaattggaggtccacacctcagcatggaggtatagcagaaagcatttgagtgaaagaggaacagaagcaatatcaggagtgactcttctggattgtacctaggatcccacaaagagctgcttcagggccccccgaggtattaattaccctttggagaaagggcagccctgaagtgtctctaattcataactgtggttaagct

SEQ ID NO: 621508 - DNA, 683 bp, Homo sapiens
cttttccaagagggcgcacggagcgtacaaggaatcttactcctctactaaaggtgaaggctatgcgggggctttaaaggccaagaagggggggtcgcagggtgtccacggccacgatacgaagatgatccacatttcacccaccttacgcagtgcgaatactctgagagtccaaatacagtccaaagatccttgccagagcgctcccagtagaaccatgttctaccactatgctatcattaagctctgggtgtccactgaggctgccatgaggcagcatcgaaccagcaacacacttgggtgcattgggcatgatgcagccaacaagccccactttaaacaggctgtgtggaatctgtgtgaccttggtgagcacaatgtcaacaccctgattcgagctgatggagtagtagaaggcttatgttcgactgcctcctgattactatgctcagcatgtttgcaacaatatagggtgcatccaaactgctaacagctgacttattctgaatatatatatatttatcacctatcttttcaccatataataaaaaaataaaaaaaaaggcttacgaatgcgggctcaattggagcttacttgctcaattggccttatgagagtcgatgacattcattggcagggtttactggaaaccctgggaaaccctgttatcccatttaatccc

SEQ ID NO: 621509 - DNA, 379 bp, Homo sapiens
  misc_feature (368)..(368): n is a, c, g, or t
  misc_feature (375)..(375): n is a, c, g, or t
tttttcaggaaacctccgtagtgttttccataatggcaccactaatttacattcccaccagccgtgtgctaggatttctacatttccacatccttatcaccacttaccttttgtgttttgatagtagccattccaacaggtgccagctgtcatcttactgtggctttgatttgcatttccctgatgattagtgacactgaacattttttcatatctctgttggccatttgtatatctccttttgagaaatgtctattcggggctggctgcaggggctcatgcctgtaaattgtagtgctttgagagtgcaagggaaggaggatcgtttgagcccagggagttcaaggaccagccgggggcaacaaagncaagatncctg

SEQ ID NO: 621510 - DNA, 659 bp, Homo sapiens
cccccgggctgcaggaattggcaccaggaatgactgattttcaattggatgtgactcatatgcagagtgaacattgaggcccagctgccaagtgaaagatgacaccatgtttgagaactctagccctccctctcatatccatgcttactggtactgcagtcaaccaaagatggaatgacttacctgtgcagatttggaagcattgaacttaaagtgctggctctgctatatggtacaactaatgctagacctacagtttatgtatacagttgctactgatgtaaatataaacgctaacttgtctagatttgccagttatctgaatcattacactgcatttctacatgattgctcagtattgcattactttgcacatattatgggcttgagcacctaaacttgcaggcacggttagctgctatagtaagtagaatatagcggtcatgttcgacgtgacatgagaccaagccttgataattatgaatgttttatacattactaacctataatttaatcaatcatgcactatagattaatgcatcatgatcctgtagctgatgataatgtgtattaagacattacgtaattaggacaacatggctgatagctttactatatggagttctgagtttttgtagtcacattacccagagtgatcg

SEQ ID NO: 621511 - DNA, 841 bp, Homo sapiens
gattgtcagctgcgtttccgcggtcgcggttgaggagctcaagctggggaaatactggtgtggattcctttgtcatcgtcaattccaagttctgcgtctggatcttacgaaaaaattcgctggagccgatatatatacccttcatggtttcccctcgttcgtctagtcgtcatatggcctcatacgaaagcaatacgaagaatccaattgatacaaacatcaggcaacagtatacactgttaacggtgtgctacgacactgacattggagtatagccaactaaaaaggaacaaaacaaggaaagttcttggtgaagtaagcacagaaaaggactacatacgtaatactgttgtcctaaagggatcccctatccattctaaaaaactggagcctaggtaattactgaaggctatctatctcttgttacattagtcgtactgaagcgcttatttaatcgtgatgaatccggtaagttacagagactcaggacgtcctagtactcatttgacctgcattactaattcacggaaattactatgactactctcggagttgaacacatggtgagttcagctttatattgtaattgaccgtcaattccgtaatgttccgtttatcccgttaagtgtagctaacgagtctcgtgatcatgggctgtttgaagtagatatgcattacactagaagggtccgtgccgagtagaccattatgttaactaaatcagcacttcgaaaatcttcggttctctaagttcatatgcagttcgctgtgtgctctagttctctgggctcttctaatttgagtggagtacagacttgtcgtgaaaccagtccacgtgacc

SEQ ID NO: 621512 - DNA, 273 bp, Homo sapiens
  misc_feature (3)..(4): n is a, c, g, or t
  misc_feature (10)..(10): n is a, c, g, or t
  misc_feature (19)..(20): n is a, c, g, or t
  misc_feature (45)..(45): n is a, c, g, or t
  misc_feature (67)..(67): n is a, c, g, or t
  misc_feature (74)..(74): n is a, c, g, or t
  misc_feature (80)..(80): n is a, c, g, or t
  misc_feature (111)..(111): n is a, c, g, or t
  misc_feature (113)..(113): n is a, c, g, or t
  misc_feature (135)..(136): n is a, c, g, or t
  misc_feature (141)..(141): n is a, c, g, or t
  misc_feature (154)..(155): n is a, c, g, or t
  misc_feature (177)..(178): n is a, c, g, or t
  misc_feature (186)..(186): n is a, c, g, or t
  misc_feature (191)..(192): n is a, c, g, or t
  misc_feature (196)..(196): n is a, c, g, or t
  misc_feature (220)..(220): n is a, c, g, or t
  misc_feature (235)..(235): n is a, c, g, or t
  misc_feature (263)..(263): n is a, c, g, or t
ggnnaatggnaaccacagnnaagaaaacaatcactatctctctgncagcaaaggtgtgttgggagcnaattacntgtggnaattgagttgtggatttccttcgaaggatcntnttggacgacgacgaactgactnngattnagatggtcttttnnatcgacgacgacttcgaccctnntacgatcnttcgnngaangacgaccgatgaagcgaggaagcnaggattggttcttgngcgagacgaccacgaaccctgacgattngccgattttt

SEQ ID NO: 621513 - DNA, 933 bp, Homo sapiens
  misc_feature (476)..(476): n is a, c, g, or t
gtttgcataaatctgccacagattttatgatcttatttgtacgcacctaagtgctctctgttcacacggtcctcataaccctacaaacttgttctgagtcgtggtcgctgctgtctctcgccactggttcatgcttgtgctcagagagaaccgtagaacggtcttagcagcttagtccgtcgttcttcagcacatgaatacacctgggtggtggaagatgaagctagtggcttccttcacgttaggcccaccagatggacccttggacttctatggttcggcgaggaggaaggtagtcttgtgagcacatcaagagttcttccatagcctgctcgttcgtctgtgcgccgtttagtcgcgcatcttcccatgcgtcactacgctagctgactgagccggtatcagtctccaggctctccggcagcctctatgttgctggccgcgggagcccagggcttctaggtgccatgtggcantgtgggacacctgagagcagcagcccgtgtcgtatgccctcttagaagttacctacaagggcagctcagctggtatgaagcagaaccaagagaaggaacttgatggctcctaccgcttcttccagaatctaccatcttgttacaagcagattacagtaaaaggcccgagagatacttgggaagcatgcatcatacgcagtttacagcacagacggaacagcaagcacttgaagtccatcctttccaaggatggggttctgatagtgttaaagctccgggcgggtcaggtctccgtacaaagaagatccaatgggatggcaaagtttcgtggctcagactgttgctagcaggaactctgaagcccgggctttcaagccagaaagcaagtctcagcgattcacttctgatccagcagttctgtccatttgctgaatatttctgcaggccaactgtgaaa

SEQ ID NO: 621514 - DNA, 165 bp, Homo sapiens
agatcaaggggcaacatgaagtaacagagtgaaatattggcactgcccgccctttacatcttacgctagaaatacgagctcaaatagaaaagatgccaagttgagtttcagacgcttagaatttgaagtgatgatagaacatctcggaagctcagatcaatgaca

SEQ ID NO: 621515 - DNA, 271 bp, Homo sapiens
tgggttttcacgagacgcgaaacggcgtctgccatcgtaagcgggcagaattcactttgataggttcatttgagatgtcgacgaactacacgcctgcccagctctctgccatgacggtcgcgcaattgaacgcgttggcagcctctcaatttgcctctttcacgtcagcccagattcaggcgctgtcgcctttgcaattgaacggtctgtccaaggccaatttggctgccgtgaatgtctcctatttcacgaaggcccaggtgaacggcct

SEQ ID NO: 621516 - DNA, 387 bp, Homo sapiens
ctgcggatgaggcatatctcctcccaccttgtacctcagaccagaagaacatcgatgggacgtgcctggcctaaggcatcctaccaacagcaccatcaaggcgacgtgggagctttcttgccagaactgatctctttgggagtgggaggacatggggtaccacctacacccaacaagtcaaggagggacttcttttaaattgggtaggattaggactggttaggcaacaataggtctataattagagtcacctatgacaaaaagtaggggtaacctagataatgccaaagtcagaataggtcctgggttcccttgtgtgatcagagaggactatgtatacttatctcctcccactatgctcagaagagttccagagggggtaccgag

SEQ ID NO: 621517 - DNA, 258 bp, Homo sapiens
  misc_feature (252)..(252): n is a, c, g, or t
gggaagaccagaaaattgaagaccattttgaagagcctgaaataaatctaaggaacatcgtcactcactctgaatacacacagtatgaacacgaggaatatgaagagaagccacctgattctaattttctcacaagtgttgaaggctacatggaaactcacactgtgaatgggccttctgagtgtgaggtatgtttaaaatcctatggactataccacctaacttacaaatggcccatcacaactatgaagnaccaag

SEQ ID NO: 621518 - DNA, 681 bp, Homo sapiens
  misc_feature (49)..(49): n is a, c, g, or t
  misc_feature (79)..(79): n is a, c, g, or t
  misc_feature (111)..(111): n is a, c, g, or t
  misc_feature (151)..(151): n is a, c, g, or t
  misc_feature (232)..(232): n is a, c, g, or t
  misc_feature (250)..(250): n is a, c, g, or t
  misc_feature (257)..(257): n is a, c, g, or t
  misc_feature (398)..(398): n is a, c, g, or t
  misc_feature (523)..(523): n is a, c, g, or t
  misc_feature (546)..(546): n is a, c, g, or t
  misc_feature (554)..(554): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (650)..(650): n is a, c, g, or t
gagctaggaccacgagcgggaggaaagaaactacttacagctgagaacngaacaaaatacacacctatctagggaaatnacaacggaggacagctggaggagaagaaggcngagctacggaacaaagaccggaagatagaagaaaccgagnagaggcaccaagtggaaatcaaggtgtacaagcaaaaagtgaaacacctgctaaatgagcaccaagaaaaacctgacaganatatatttctgattttantttattnatgaagctggcacagaaagagcaccgcatacaggagagtagtgacatgcgcaaggacatgcgaggcactgaaggtggagctcaaggagcaggagctggccaattaggtggtggtgaagaacctgcggctgaaacacaccgnggagatcacacaggatgcggaatgattttgagaggcaagttcgagaaattgaggccaagtatgataagaagatgaagatgctgagggacgagctcgacttgcggagaaagactgagctccacgangggggagaaggaagaatggccanatccacangctgatgcagcgccacgaggaggccttcaccgacattaanaantantacaacgacatcaccctcaacaacctggccctcatcaactccctcaaggngcagatggaggacatgcggaagaaggaggac

SEQ ID NO: 621519 - DNA, 116 bp, Homo sapiens
gctgccgcttgagatccaagagttgctcgtgtacaggtgagtgaggtgatctcggtcacgaactccacgtcttgggttcaaacaatgtctgcctagctcccgagtagctggggggt

SEQ ID NO: 621520 - DNA, 601 bp, Homo sapiens
  misc_feature (7)..(7): n is a, c, g, or t
  misc_feature (28)..(28): n is a, c, g, or t
  misc_feature (41)..(41): n is a, c, g, or t
  misc_feature (89)..(89): n is a, c, g, or t
  misc_feature (149)..(149): n is a, c, g, or t
  misc_feature (180)..(180): n is a, c, g, or t
  misc_feature (201)..(201): n is a, c, g, or t
aaaaaanggcgaaccctggttttgaaanttcaaaactaaantttaaaatccaaaaatctgccccctaaaccccacgttaaccctgtgcnacccttaaccctctgaacccttcgtcctccctcgtttgtaaaaccctgcctaaatccctnaagaaaactggaacaaaaatgcccgtggaanaacccttggcctcctgaagtnagctcctgctgcctggaacagttccagttggcaagtccccccaaacgtaaaggccgtaagagtttaaagaagtatccggcccaggcacagtggctcacaccctgtaatcctcaacactttgggaggcccgagacgggctgatcacctgaggttgggagcttgagaacagcctgaccaacatggagaaaccctgtctctaaaaataccaaaattagttgggcatggtggcgcgcacctgtaatcccagctactcaggaggctgaggcagaagaatcgctcgaaccccggaggcggaggttgcagtgggttgagatcgagcaattgcaatccagcctgggcaacagagcgagactccatttcaaaaaaagaatcaataaaaatgttaaaagcaaaaaaaaaa

SEQ ID NO: 621521 - DNA, 435 bp, Homo sapiens
gttgtcagcgtggcgtagtcagaacagactggtaagaggaacgaacatgtgaaagcctatcggttgcacgagccaacaagggcttggtctttgtagtccacgattaagtgagaaggaggaatcactggctgacttagaagaagtaaaaaatgtgaaataccgataaaacacaaatctcgtgagtgggaacacagaacagactaagcatggtgtgatactagatatattataaagcagtaatgtaccagtattatatatcccatatcttctagctatgaccctattgctttgtttcttgacatagacaaacattttttaaactaagagctttattgtgatacagttaaggtatgataagcctcacccttcaagtgtacagttcagtggtaaatagtatatgcagagttatgcagccattaccactgacaacggctt

SEQ ID NO: 621522 - DNA, 781 bp, Homo sapiens
  misc_feature (731)..(731): n is a, c, g, or t
tggttatgggtaattttgtaaataggaacacttcccattaaggctgtgaaaactacaaactacatttaatttaatatctggtcacaattagtgggaaaatatctatggtaaagctgtcagcacatctcaaagattacttggtcaggatccacctgctctatgcgtgcccactaataaggaaaggcaatagggtaataagaagtgtaatagagggttacttgttagtacaagttctcataaaaaaatactctggactctactgggatgctaaaggtggtgttttggcaagagatacagactggattagtgggcaatcaaatttatataactggtaagggacatcaataagaacagacgggaccagaaatggtatcgtggggtgactccacagtgccaggagttagcgcggcagaggagtggagaggtggaacttagcgatggaggcgcagctgtgagaaagctgcagttcttgcattagagattaaataagaggggtcaaaattcaaattaaattaaacccttttgttcaacgtctagggtaaccccaaatagatggttggcaactgggaagaacaactttggaaaaataaaaggatccggggtgatgcatatcggatttcaaaaactttttccttaagacctttaacgtaactcttgacaagcaaataccgtaaaaaagttaagttcctggtcttaaatttttctaccaggggaatttggaccattaagtnatctgtaaaccataaggttaagtagatggtttggacaccgggtattaagg

SEQ ID NO: 621523 - DNA, 372 bp, Homo sapiens
gcgtcgactgtaattccagttgcttagaaagctgagttaggagaattgctcaaacccaggaggcagaggttgtagtaagctgagatcgcatcattgcactccagcctgagtgacagagtgagactctgtctcaaaaaaaatcatttggatttatatatacaggttatggatccttatcccaaatgcttgggaccggaagccttttagatttcaaattttttcagattttgaaatatttgcattatacttaccagtttagtatcccaaatctgaaaatccataatctgtaatgctccaatgagcattttctttgagcctcatgttggcactcaaaaagttttggattttgaagcacttcagtttcagattgtc

SEQ ID NO: 621524 - DNA, 910 bp, Homo sapiens
ctcccaggaactgacaacacatgattgtctgagggcgacggggcaaggatgtgaggtatcaccgtaccgtgtgcggctgtgctcctggggataacatggctaacgagccgccgctgtgattccagtgctacgccttggatttcctgactcgccgtcctagcctgtatgatagttcattgtgcgtcatggtcatcaataaaggggaagtgttgttggtaggatcgccatgaaatctgtaaatcaacttatggaggagtatgacctcctataaacaatatgggctgcgttactccatgaacatcggattgcttcccatttatttagcagcgccttctttaattcttgcagcagcactttggtaggtgtttcaacgtaacaaacttatgtacttatttgtgtaaaacgtattcctatggttccatcctttctggtgtctgtgataagggcgaactccttctagtggcagtctccaaagttatggattgccacgtttagaaatacacttgatttgtgggcatattgactattatatatcctgcaagccttgctgagctcatttatcagcttcaactatgtggtatgtggtgtgtactctctaggatacctgtataccacaggcagtcctcccggcaaatagagattagttcttcctttccaaatctagatgcctcttcccttttctatcccgggcagaacatctttaggaacctatctcggtcctctaggaaaacgtgaacaacactgggtgggcattgggcacttgggaatacctatctatgcgtctcacatattccccttaactaattttggcctttgccccaggcatctggaatccaaacgcaacctaattcctaaacctcccaatgaatttccaaagggtttactggtcccaagccttctaaacaccttg

SEQ ID NO: 621525 - DNA, 825 bp, Homo sapiens
ggctctgtctcggctcgctggaacctccacctcccgggtttaagaggttctcgtgctcagcctctggaatggctgggactacaggcatgcgccgccacacctggctaattttgtattttggtagaggcaggctttcaccgtgtgggccaggctgttctcaaactcctggcctaaagtgatccacccgccttggcctcccagagcgctgggattacaggcatgagccaccgtgcctgcctcctttgcttttaaaaaccttgaaattaattgctcttgtccccagtatttagcttctctcattttcattatgagatataatttatgtgtcataaaaattccctttaaaaatgtccaattagtggctgggtgtggtggctcatgcctgtaatcccagcgctttgggaggctgaggtgggtggatcagaggtcaggagatggagaccatcctggctaacacggtgaaaccccgtctctactaaaaaacaaaaaattggccgggcgcggtggtcacgcctgtaatcccagcactttggaggccgaggcggcgatcaccgaggtcaggagatcgagaacatcctgctacacggtggaacccgtctctactagaatacaaaacaatagcgggcgtgagggcgctgtagtccagtatcggaggtgggaggaatggcgtgactggagcggacttgaggaggcaagatggcccaggatccacgggaaagaaaccggctcaaaaaaaagaaaaaaatggggccgccaaaattaaatgggggccaggaagaagaatacagctgaaggggtcaaaaggccggaacaggggtcaacccg

SEQ ID NO: 621526 - DNA, 901 bp, Homo sapiens
  misc_feature (43)..(43): n is a, c, g, or t
  misc_feature (121)..(121): n is a, c, g, or t
  misc_feature (140)..(140): n is a, c, g, or t
  misc_feature (152)..(152): n is a, c, g, or t
  misc_feature (159)..(159): n is a, c, g, or t
  misc_feature (174)..(174): n is a, c, g, or t
  misc_feature (241)..(241): n is a, c, g, or t
  misc_feature (247)..(247): n is a, c, g, or t
  misc_feature (254)..(254): n is a, c, g, or t
  misc_feature (256)..(256): n is a, c, g, or t
  misc_feature (314)..(314): n is a, c, g, or t
  misc_feature (316)..(316): n is a, c, g, or t
  misc_feature (322)..(322): n is a, c, g, or t
  misc_feature (332)..(332): n is a, c, g, or t
  misc_feature (489)..(489): n is a, c, g, or t
  misc_feature (503)..(503): n is a, c, g, or t
  misc_feature (537)..(537): n is a, c, g, or t
  misc_feature (575)..(575): n is a, c, g, or t
  misc_feature (602)..(602): n is a, c, g, or t
  misc_feature (639)..(639): n is a, c, g, or t
  misc_feature (716)..(716): n is a, c, g, or t
  misc_feature (735)..(735): n is a, c, g, or t
  misc_feature (762)..(762): n is a, c, g, or t
  misc_feature (901)..(901): n is a, c, g, or t
aactcggcccacacaccgccctgcagctcactttaacatctgntctcaggtaagcagctcagggtgaacaggaaggcctgggtttcccagttcaggccttatccgtcgccacacgtgccanacaccacaaaacaaaatcncttccccacgtnctcaggnggccaccccagtgtngtccgggggacctccagtgtttaacagctgcctgcaggggccacagcccatctgtagaaacagagcnctgttnctgaganancagccccaggagagcctccgtctccagctgtggggggtgccagaccctaagcctcggntntgccanctgtccctgntgggcaagaagcaaaatgtatgaaaatactttaatcatttatttgaaacagttaagaaataaggtcatcttgttgttcttttataatcccggtaaaaaaaaagttcacattggctcctgggcccagggaaaggccccgccggagccactcagtagangcgcttgttccgcncctgccgcttctggaacaccacggcccccaccanggggcagacaacgatgcccaggagagcgcacagcagcngcaggaacacccgccaccccgtcaggnccccgctgcggaagttccccgtggggtcgtccacgtnatctttgggcgacttgaggaagttgacgctgggctcgatcttggtccagtcgatgctctcctcgtcgggcgtgtgcnccaccatcagctggaacantgtcatggagatgatgtcatgattgtnagacaggtcgccggtgccggcggaggccccgaagtagtagccggtgggcaggcgcactcccgtgatgtcaatgcagttcttccactcgttcttgtcctccaggtcggtcatcaccgtcagacggccccggggagtagcn

SEQ ID NO: 621527 - DNA, 275 bp, Homo sapiens
taggtgcgaacgctacgtggaatgccattgctgaaaatccaccagttctccctctatcctcgactgtagtataatcctgcgtggactattcactaatggtatatgtggatattcctgtgagctatgagatttattccttaatttgccacttgtcatcggtaccattcctctacatccatttggtagcagaacctcaccgtgtaccgcacgtcacgtgtactcctgacctactgaagctggctcagtttatcaccttcttgacacaccctgaaggt

SEQ ID NO: 621528 - DNA, 826 bp, Homo sapiens
  misc_feature (142)..(142): n is a, c, g, or t
  misc_feature (153)..(154): n is a, c, g, or t
gactaaccagttcacctacaaagattttaccaaacacaccttaggaccaactaaatgtgaactgttggaccccaaatgattataagcacaccacagagactaaccagttcaggaagtgttctgattgggagtccatataccnctgcaccagcnntggcttactcagacacacatagcagaagctactggctgggtccctggctgatagaaaacgggctagaaaattctatacgactctgcatttttcagaaagtacaacgaagcaacacaaacggagactaaaacatgggacaacggcttgagacaccttttcaatgaacagtgtgtgcagcaaagttcaacgcaacaaggtacaacatcgtacaatgcaagctcgctgatgagctggtgtcacgagttcaccaattcaaataaccatttggcctgctgattcggccttactgatcagaaggaacacttaggcgacagcagtttactgatgcctttaacatgtgctactggcaatgaacactaatttcacacgcgacaaaacaccgcacctcaagtggattggcctgcctaccaattctgctcaggaatgtcagaatctggagatagaagaaagaagaggcggatagaacggactaaccgcgagaagcgggcccagttgcaagaaattctcctaccagctaatcgattccaacaaaaccctggttcagaagaaagatgacaaacatggagcaagcaaacacaaggccccgccgggctctgaacatctaacattcagctgcaaatacatacctcctcaatccaagcggacaaaccgtctactgcattgcgcacctcc

SEQ ID NO: 621529 - DNA, 313 bp, Homo sapiens
ccgggcctccggcttcccaaaaagatccaggtttttgggtttccagggggtggggaccccggccccctatgccgccacgccgccaccccgcctccccctgggttttgtggtacttggcagttccctttcattatttattttttgggctgctttttatcatgatataaattattgaaaacagatcccatgtgggcccgggtttggccccccccgccctgccccgtccctggggcccccccctaatttattgccgggggtcctgctgctgtgactgcttttgtacctttgcaataaagaattttttggtttcaga

SEQ ID NO: 621530 - DNA, 485 bp, Homo sapiens
  misc_feature (38)..(38): n is a, c, g, or t
gcatcaaaagtttaaatggtaattatggtctggggganaattgggttcccgaattaaatttagggccggtttaaatccccaagccctgtgtacaaaaaaaggttttgttgctttccaaagggtaatttaagattattctcgtgaagatccagtttaagagttttccttgggagacttaaagtagaaaccccaatgccacagctggccagtaattagtgttgtgcgcttccatgccttaatcaatttctcaatagttcttaaaattagtgagattaaaaatctaaaaattttgcctttcctgctttcagaaacagtattttcttccccaaccaaaataaaagaaatatggtcagagcttgaaccccggcttttttttaaaaaaaaaaaatttttaacctgggtttccctattgaaaaatcagggttttagtcataaaaccccctccttaagaataattggccaaaaaagtttgctttccgatgcca

SEQ ID NO: 621531 - DNA, 250 bp, Homo sapiens
aagctgcgatgagtgactctgtagtatccccctcgggggtcgtctataggtttggtcctggcctttctattagctcttagttaagattacacatgcacgctcccccttccagtgagttcaccctctaaatcaccacgatcaatgagggacaatgcatcaagcacgcagcactgcagctcacaacgcttagcctagccgcacccccacgggaaacagcagttgattcacctttagcaagtaacgaaaggga

SEQ ID NO: 621532 - DNA, 419 bp, Homo sapiens
  misc_feature (373)..(373): n is a, c, g, or t
  misc_feature (403)..(403): n is a, c, g, or t
  misc_feature (406)..(406): n is a, c, g, or t
gactgctccagccagagacagaagtcaagttcctgtaccaattcatgctacccaaatgctctggagacactgagcaaaaagattgagtcaatgtaagaaggacacatccctatctctactcaacaatttccagggcccgttcctttcactctaaaagttttcttcaactttaattataatcttattttaaatatggctcctgagctcaggagaaaaatctggagtatgaagaaaacaagactagagtcaagaccagctgaccggaagatcctggatacttgagcttttcttgaagactatccttccacccttaaatgtacatgtgctgcctgagaagttctcaattgatgatagttcaaaatttgcataactncacatatctttgatgtaactgaataaatgnttnccaaaataaaaaa

SEQ ID NO: 621533 - DNA, 796 bp, Homo sapiens
  misc_feature (328)..(328): n is a, c, g, or t
  misc_feature (480)..(480): n is a, c, g, or t
  misc_feature (492)..(492): n is a, c, g, or t
tttgcagctgtagatggtgcacaactaactgtacacacatggattgtgcatattaaattataaaattgtatatcaagaggtgtacgtgacatttgcatgtaggaatacgttaatgaatgttgtttgttattagtacattatgaatgccaatatcagttaatgccattgcttctgggtttggggaagcaacagaaatagccatataattgtactgactatgtaatgttctttttcaggacagcctaggcctgaagtgaggttgccaaagttatgttctttatagatggaatatgtttcctctagtgagaggcagtttacatgtaggctngtggttattaatgtttttaactgatgaattatgttggaattggtgtatctctgcaaagaatatttccaaatggtcttaaaggaatgtcatgtagcatttattacagtcattgcaatagggacacctcccacctgctttaatttagtgacatnacttctggttanaagccttaggtaaggccacaaacagtggccagtgatttggataattagaaggaatggcagaggcctgtctctttacaaggaagttagcagtgacatgcaattaaagcaaacctttgggggaagccaggtacctctaaggattatagtagattgggtcaaatcaaacaatatttatagaattctctcctttcacaaagaatttctgcttgcttatttttaataaattatttcagagataatgatgttatttaacataagtagagcaagaagaaaagtataacttaagctttattttctcggcagg

SEQ ID NO: 621534 - DNA, 619 bp, Homo sapiens
  misc_feature (180)..(180): n is a, c, g, or t
  misc_feature (230)..(230): n is a, c, g, or t
  misc_feature (261)..(261): n is a, c, g, or t
  misc_feature (275)..(275): n is a, c, g, or t
  misc_feature (280)..(280): n is a, c, g, or t
  misc_feature (303)..(303): n is a, c, g, or t
  misc_feature (325)..(325): n is a, c, g, or t
  misc_feature (333)..(333): n is a, c, g, or t
  misc_feature (359)..(359): n is a, c, g, or t
  misc_feature (375)..(375): n is a, c, g, or t
  misc_feature (416)..(416): n is a, c, g, or t
  misc_feature (433)..(433): n is a, c, g, or t
  misc_feature (490)..(490): n is a, c, g, or t
gctggagttaggttgttgaggatgcctagggtagacgctgctggcgcaggtgtaaatggcagttttggaaaacctggtaaacgatcgaagtgaggcggggaataggctgggcgcatgctgaggggctgagcacgagagtgaccgtgggtcatgatgtcgcctgcccagcacgcccccgangagagggctcgggcgcgctgggagccccatacccccaggacctggctcgngagtgcgtctgggtcaggaagagacctctcngtgcgtctcaggcngagangcagatttctgttttctaaaacnggaagcgaccttgacgtgtatngaaggtgngtgtgccaaatgcttccgacggaggngctggccttggttggnttctctctgccccgtgtggtcatcaagtcctgggggatgtnctctgcccagccgcccncggggagagcagcgccgcctcttattgggcttttgtttttttttttttcacagaatnggttttttcttcccgccagcctccgtgccccaccccacccagcacgcactcattcagtccattgccttaacacaagcctgatggggctgttttctcacaatataaacgaataaagtgtcttctggccta

SEQ ID NO: 621535 - DNA, 339 bp, Homo sapiens
agaggacccgagacgcgggtgtgtatcctccactatcctatctagaaacatagaatacattatgctgcacgctgacgtgtaatccacatagccggtcagcctgctcacattacaaaagcgcgaagtgaccgcaacgctgatatcctgaatgggagcgcaccatcataaatatccttctcataggccgaacgctaatttactgcatcttcatctgtttcctccatgaggtctaagtcgagcaccggatgagtgtagtcagatgtagctcctaaaattgggccgcctggtatatctttaaaactagctgaaatccttcttgtggatacacaagccgcttca

SEQ ID NO: 621536 - DNA, 451 bp, Homo sapiens
  misc_feature (58)..(58): n is a, c, g, or t
  misc_feature (62)..(62): n is a, c, g, or t
  misc_feature (64)..(64): n is a, c, g, or t
  misc_feature (76)..(76): n is a, c, g, or t
  misc_feature (82)..(82): n is a, c, g, or t
  misc_feature (94)..(94): n is a, c, g, or t
  misc_feature (107)..(107): n is a, c, g, or t
  misc_feature (112)..(112): n is a, c, g, or t
  misc_feature (172)..(172): n is a, c, g, or t
  misc_feature (174)..(174): n is a, c, g, or t
  misc_feature (221)..(221): n is a, c, g, or t
  misc_feature (228)..(228): n is a, c, g, or t
  misc_feature (230)..(230): n is a, c, g, or t
  misc_feature (258)..(259): n is a, c, g, or t
  misc_feature (267)..(267): n is a, c, g, or t
  misc_feature (275)..(275): n is a, c, g, or t
  misc_feature (289)..(289): n is a, c, g, or t
tgttttcatagagcttgctttagtgggtaaatatagttataaatgagtaaatatttantaantntttattatggtnagtgtngtgaaggaaaanaatgtgggatggnttttnggttgtattattaggaatgatttctaggttaggaagtgatgcttctgtatttagtagtantngttagtgtgaaatctggggtggagattaggttagagttttggatggntgatgananttaggaggaagaggtagcttttatatgnnggtggganagtgagcncttgctttgtggtntgtgctgagcttacccacaatgcaagccaaggcatcagctcccacccacaccccaagggacctgcaggaaaccaggctgcatttcaacaacaagcagaaagcacagagctttacacacaacctaaatacatcaaccatttgaagatgctaaactccatacaa

SEQ ID NO: 621537 - DNA, 889 bp, Homo sapiens
  misc_feature (43)..(43): n is a, c, g, or t
  misc_feature (117)..(119): n is a, c, g, or t
  misc_feature (121)..(121): n is a, c, g, or t
  misc_feature (123)..(123): n is a, c, g, or t
  misc_feature (129)..(129): n is a, c, g, or t
  misc_feature (238)..(238): n is a, c, g, or t
  misc_feature (254)..(254): n is a, c, g, or t
  misc_feature (256)..(256): n is a, c, g, or t
  misc_feature (260)..(260): n is a, c, g, or t
  misc_feature (277)..(277): n is a, c, g, or t
  misc_feature (284)..(284): n is a, c, g, or t
  misc_feature (308)..(308): n is a, c, g, or t
  misc_feature (313)..(313): n is a, c, g, or t
  misc_feature (315)..(317): n is a, c, g, or t
  misc_feature (338)..(338): n is a, c, g, or t
  misc_feature (341)..(341): n is a, c, g, or t
  misc_feature (346)..(351): n is a, c, g, or t
  misc_feature (354)..(354): n is a, c, g, or t
  misc_feature (358)..(358): n is a, c, g, or t
  misc_feature (362)..(364): n is a, c, g, or t
  misc_feature (371)..(371): n is a, c, g, or t
  misc_feature (382)..(382): n is a, c, g, or t
  misc_feature (393)..(393): n is a, c, g, or t
  misc_feature (398)..(398): n is a, c, g, or t
  misc_feature (402)..(404): n is a, c, g, or t
  misc_feature (411)..(411): n is a, c, g, or t
  misc_feature (413)..(413): n is a, c, g, or t
  misc_feature (419)..(420): n is a, c, g, or t
  misc_feature (422)..(422): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (455)..(455): n is a, c, g, or t
  misc_feature (459)..(459): n is a, c, g, or t
  misc_feature (463)..(463): n is a, c, g, or t
  misc_feature (466)..(466): n is a, c, g, or t
  misc_feature (471)..(471): n is a, c, g, or t
  misc_feature (474)..(474): n is a, c, g, or t
  misc_feature (481)..(481): n is a, c, g, or t
  misc_feature (684)..(684): n is a, c, g, or t
  misc_feature (695)..(695): n is a, c, g, or t
aggcagaacaagaagcatagtgccagcatctgcttctggagangcctcaggaagcttacaattatggcagaaggcaaagggagagctagcatatcacatggcaagagggaacaaaannnananggaggnggtgccaggctcttttaaacaactagctataggatgaactctatatccatgtggaggacaccaagccattcatgagatccaccccataatccaacacctcccactaggngccacctccaacactngnaganacaagtccgtaaaaaanttaaaanaaacaaatatccaaatcatattancacantnnnaatatccattcatccactgangancatcnnnnnngtncgtntttnnngggtatngggaatgaggnggcgaggggtnggggngttnnngatttangngcttannantcctctcagctcngcnttngcggtatccttccnattngganatnctgtngtnacttttncatatttcaaaacattttccccttatttattcaatgatctgtagatctagaagtgtgttatttaatttccatgtattgaaggactgtataggtttcttattattggtttctaatgcacattccctgtaatgtggcaatcttttgaagtttattgtgacttatggtccagccaatagtctatcatggggtctgttcaggtacangaaaagaatgnaatttttcaattgtgggtatggtgttctgtaaacaacaattaggtcatgttgactggtgtggttcatatcttctatacagttgtcccttgctatccacaggggactggttccaggacaccttgtggataccaaaacctacagatgcccaagtttgttatataaaatggtgtagtagttgcatataactatgcac

SEQ ID NO: 621538 - DNA, 828 bp, Homo sapiens
gcatcgtccaagtctcgcttcaccctgccgtcagtgtctaagtcagagtctcctagagagcccgaacagctgaggaagctcttcatgggagggttgagcttgtgaaacaactggatgagagacctgcaggagcgcactatttgagtcgaatggtggatactgctcacgggacgtcgtgtggtaatggagagatccagacactacgcacaggcgctccaaggggggcattctgcggtctagtcacgatatgccgagatgcttggcaggagggtggactgcatgctgatgcaatgctgagggcgacaccaaaggggtgactgcgatacgaatgttagtcggccgtcaagaggaggacggcctgtcttgcgcagaaagacaggatatcatcagaggcatgacactagcaggtggcgccacgtgccaccatggtcgagacacagactatcacggtgcgagataggcgactaaaaggaatgaacacatgaaggaatcaatccaccgataatggaagataactgggcgaacctgggtagctggatgaagaactccgaagatgaactcgaagagtcaatgcactgaggccgcagggccaggaggccagggaacacaggggccacgggacgcaccgggaacgcccgctgtagaacacaacgaggaccggcaggatgaaaggatctgcgatcgcgagagaataagcgatgaactggcgaaatagagcgagcaacacaggtggaagatgtccaaaaagaggagcctgcccaaagatacacgacgacgctggaagagcggttcacccaaaaccaagagaccgtcagacgggggtacggg

SEQ ID NO: 621539 - DNA, 220 bp, Homo sapiens
cctgtgtaaattgttatcgcaaggacccaatgaaatgtacaagtacaatgaggagaactacggtgtgaagactacctatgatagcagtcttacttcttatacggtgccttagaaaaggacaatcagaagagtatcgtccgcgagagctgcggtgcggccccgttggctcgagagattgaatcaagcacccagtaccgcctacgggctgccatagggcgga

SEQ ID NO: 621540 - DNA, 194 bp, Homo sapiens
  misc_feature (84)..(84): n is a, c, g, or t
  misc_feature (137)..(137): n is a, c, g, or t
aatacaaaaactagctgagcatggtggtatgtgtctacaatctcagctcactgcaacccccccaccttccgggttcaagcaagntctctcctcagcctccccaacagctgggaggctgaggcaggagaattgcttgnactcgggaggcagaggttgcaatgagatgagatcgccccattgcactacaacctggg

SEQ ID NO: 621541 - DNA, 727 bp, Homo sapiens
ggtatcctgaaaactggagggccttcaaggctctcatcgctgctcagtacagcggggctcaggtccgcgtgctctcgacaccattcattggcaacacgcacctgatttcccaattctgcggcaggtccagctttgaggtgtgatggatctggtgttgagagcacgccttgctactatgtgagcactgagggctggggaatactccagaggcagagccagtggtgcagtgggtgagcttgctgatccgattagtgccccagcagtacctgggtgtcccactgggcatatgcacaaacaaaaggcatgaatgcaaggagaaggagggaatctggggctgtggatgctatgaagagaggattctgtgggcgaacgatgacatggtgactcaagtgtctgcacctgttgtggtctataagcaggtctagagcttcttccgcaggctttcccataccaacgtggtcctcactgattactcacccagtccgggtgctgggcgaagtgcaacgttgagagatggccagttgatgcaaaaagttgaagagaccaactaaaggacacgccggaagagagggtccgggagagacgcaaagcccagtgagcggaggagagaaaaagggtgcccctgtctgagaggaaggctgatggagaggcgtggtgtgaggcaggcaaggcacctacgtcactgcaagactacctgggtggactcataaggcactcccaagaggca

SEQ ID NO: 621542 - DNA, 140 bp, Homo sapiens
cacccccccccccccccaaaccccaaggggttctttctggcttgtatgggaaatttccaaaaagcccttcccactcttcggggctccctaaggggcgtttttgcgggttttttcaataaaaagaggggctactttgttca

SEQ ID NO: 621543 - DNA, 488 bp, Homo sapiens
tacccatgacagcaacagaaatatatacacaggcaaagtcccacagcaacgtcttatgctatgtgtagcagctaaacgcttatttctttgactagaaggctgtaattcttactgcgagtctcagtcacttttgcaagagcagccattgacaggtgcccgccatctctctagccagatgctacctcatctgcctctgtccgcatgactctggagttggtctggtctcaatttagtaaaacttgatggacgccgatgtgttgctgaagtaatcagttgtaaactgcggaggtaggcaatgtattcttgtcttttctgggaggttcaggtacaaacacacttcaggttgatgatgatccaagttccttccctgttagtgtcttaaaacacaagcattgcacaagcataaacacaaacaccaacaaagttctttgatcaagggaagggcattgcaagtgttccacggatggacattggattggaccctgcat

SEQ ID NO: 621544 - DNA, 87 bp, Homo sapiens
aagaaaaaaaacctttagctctttcctgtgctgcagtcggctttcagaaatgacagaggtggcccggactgtattcacctacgtcct

SEQ ID NO: 621545 - DNA, 308 bp, Homo sapiens
tcagatgagcacaactggtttgtcccctcaaagtcgggcgtaagcgtgcagttctaagcatggtactcagttaagtctgtgtctaagtaatcgtgtattattatgggtgctgtggtcgtttgtacccccgctataaccctccctccgttgaaggctacccctgggtaagggtggtgacgcgatgccccattacaggctcacacccagttctgatcaggctgagtatggtagtgtatctatctgttactgcttgttacttattaactaatcagatctttttacagtatccatttatcatgcaagcgcta

SEQ ID NO: 621546 - DNA, 268 bp, Homo sapiens
taaagacacagggttcttgctctgttgcctaggctggaatgcaatagcatgataatagctaactacagcctcaagcttttgggctgaagcgatccttccacctcagcctcccaagcagctgggactacagacacatgccaccatgcctgcctaatttttaaattttttgggagaggtggggtctcactgtgttacccaggcttgtcttgaactcctagccttaagggattttttcaccttagcccccgcaaagcactgagattacagg

SEQ ID NO: 621547 - DNA, 188 bp, Homo sapiens
ccttgaaatgtgtttgctattgtgagtagtgctgcaatgaacatacgcgtgcatgtgtcttcatggcggaacaacttgtattcctttgggtatatagccagtaatgggattgctgggtcggatggtatttctgactttaggggttgagaattgccccactggggaagatgaaatacgaatgaaacacg

SEQ ID NO: 621548 - DNA, 123 bp, Homo sapiens
ttctgcttagccaggatgaataggtggactgcgagatggctattatatcaagcccagtgtgcatcataatgtttgatgcacatcgagagttacttacaagaatgtgcctaactggcgatagga

SEQ ID NO: 621549 - DNA, 134 bp, Homo sapiens
cggggcccaaactcgtgataaagtatcgaggtgcaaatcagccatatgaattaggaggggaaactgagccagaccacagcacggggctacagagggaggacaactaggcccagagccccttctgtcgtcttctc

SEQ ID NO: 621550 - DNA, 449 bp, Homo sapiens
ggagtcggccctgctgttctcctcctcgcacccttcctgccccttcacttccctcttgctaggtgaccaggaaggaagaagcaatttagtcaggatggctaaaggtgatcccaagaaaccagagggaaaggtgtctgcttattccttctttgtgcagacatgcagagaagaacataagagaaacccagaggtctctgtcaattttgcagaattttccaagaagtgctctgagaggtggaagacagtgtctggcaaagagaatcctaaatgtggtgaaatgacaaaggcagataaagtatgctatgcttggaaggtgcaggattgtgaaccagttaagtgaggcaggaagaaggaccttcatgtctccaaaagagacatgtctgtattcttcctgcactgttcagaatttcaccccaagatcaaatccacaaaccctggcatctttatta

SEQ ID NO: 621551 - DNA, 576 bp, Homo sapiens
ggctgaggcagagaatgctgaaccgggagatggagttgctgtgagcgagatgcaccctgcactcagcctgggtgcagagcaaggctctgtctccaaaaaaaaaaaaagcaaaagcaagtagattccagctggtgctgttattagatttgcaggtgacttgctgctgttttcattttggatgttgcctgccttcgtatcctttgttgttgtgtactctttctaagggtgtatcagtttccttggatatcttcatgggcttggctgcataaaaatttggttgagccgggagccgtggcttacgcctgtaatcccaacactttgggaggccgaggcaggcagattacctgaggtcgggagtttgaggccagcctgaccaacatggagaaaccctgtctctactaaaaatgcaaaaaaaattagcctggcgtggtggtgcatggctgtaatcctagctactttggaggctgaggcaggagaattgcttgaacccaggaggtggaggttgcagtgagcccgtatcgcaccattgcactccagcctgggcaacaagagtgaaactctgtctcaaaaaaaaaa

SEQ ID NO: 621552 - DNA, 379 bp, Homo sapiens
ggcacagcttctccggcgccacagctttctccacggtaaagtgacgctaaggatcatagtcacctctgggctacatgaaataccatgcggaaacgtctggcagcgggcagggcagggcagggcacttcactttctgtactagctgtaaaggtgagaaagaagcccttggcactggaagcctggcttttcgttgactctgcagctcctggttagccctgtgtgtgagtttgtgttaaataatcagtccgactcctccgctggggtggtggtgccagtgtggccagttcttgtgcaaatagaacattttcaagatagttctgccacttgtacagcactctacgtgctgtagagttcagccctgagagagagggacaggatc

SEQ ID NO: 621553 - DNA, 385 bp, Homo sapiens
  misc_feature (96)..(96): n is a, c, g, or t
cgtcgactcaagtgtaagttatctacttgatggcaataatgggggtattaatatatgttctatggggtgtaggggaagggggtgcctcagtgggcncaggccaaggctcccccctgcccccagagaccagccacaggacagtatagattagagtctatttcggccacgaggaggggagttaagagtgtagtagaggcagagaaaggcagagagaaggagagagtagagaagtagaggctggccatgaccacgtggagagaggggtaagggaatggggagagaggcagagcaaggggacaagaggcaagagagaggcaagacaacaagagggtaagagaataagagagacaagagaataagagagagagaggaggggggtcgacgc

SEQ ID NO: 621554 - DNA, 207 bp, Homo sapiens
gtgaaacgatctgcagcggagatataacggctcctcttttagacttagactatgacttacaacggaactattatgataggatatacagttacccagcacgtgtacctcctcctactactattgcatcgagactgtagtgccctacaaaacgtcagcgtagtatcaggaaacacttacacgaagggcaaaagtaggcttcaattctta

SEQ ID NO: 621555 - DNA, 106 bp, Homo sapiens
cgaatcgagctggtcccggctgcgacggccggtacttcgtcttcggtgtgcacgtctgtcagcaccggcacgcccagctcgcgcttgaccttggccaggatctcca

SEQ ID NO: 621556 - DNA, 151 bp, Homo sapiens
tgtgtgtcaggtagaccaccgcttcgcgggatggcttcaatcatttctgatctgagttgggggggggtaggtaaaaaagtccaagaatactttatgcaccaatgagtgcgccggtgaagcttcagggggtttgggtgagaatggctgttac

SEQ ID NO: 621557 - DNA, 379 bp, Homo sapiens
gcggagcgcgacgagagcgtagtcccccaggtcctgcgggcgcggaatatcctggaaccttcttttgtttgtcagcagccaaggtgtttccaggaagttcagagagaacaggtcagtgttggtccgggtccattgtcgggtagggcctctgaacgtctgtgtgttacaaactctgtctgaagtcaaggtctttcttgccctttaactgtgggttgggcaggatagaagaggatgctgacattttctagttgttgtgccctgactcctggctttgattttctaagctccttaaattgggctttgggggccaggcaagaatgatctcctccccactgtttctgattggtggctgatggtactcttagattctttcttggcc

SEQ ID NO: 621558 - DNA, 434 bp, Homo sapiens
aagaaacgatcagagtctgagcgacatagaagcactcagagaaaagtgcacagagcctccgggacatccagaagatactacaagcagaataactatatgaattatgggttcttcagaagaaaaagagagataaaagggctgggagattatactatacaaactaatagctagaaaactactccaatagagaggaacgaccagcttatatacctctcaaggagctcaaaaaattccagtagtaaccactcagggacactctataatcaaaccattagcaagtcagacaagagcagatctagcaatgccagcaaacaagttgtggtcacaggtaagggtgctacttacggcaagcctgtccatcgatggtagttaaccagctaaagtaagctccgaagccttccagtccgtaagcagaggagcgagctggacgccac

SEQ ID NO: 621559 - DNA, 272 bp, Homo sapiens
cgcatcgccagcgttcgagaacacatctatagggcccaaagcggccggtagtgcatattcttccagttcactgtccgttggttgacatggaagggagtggtgaagccatcaggtttcccagctaactcgacttgcagaacatccccccctagtgcaaacgcaacgtgtgttgggttgtaaaaggaggaacttttattccatggtctggagacttgcgtgtcctggaatcaccctaataataatgaatctttttttttcttcccttttcagta

SEQ ID NO: 621560 - DNA, 317 bp, Homo sapiens
  misc_feature (195)..(195): n is a, c, g, or t
gagaaccccgaggagtgtgccctggttcggtgtgcctcccacggccttccgtggaagaatgacgacgctctctctgtggggtcctcactgtaccgctgtagagggctggggtcatgtgtggggaggctttgcagccccttgtgctgccccctattcccagtgtcacctatctaaatacattcggagcctagcccncttcggtagggtgccatgtgggggacgtgggggcctccctcttcagtagggctcctagccctagtgtcaggtccccaccgccactcctggtagatgagctgcggtgcctgtggtggaccatg

SEQ ID NO: 621561 - DNA, 384 bp, Homo sapiens
tttccttaaaagtttcttcttggagaaaaagtgttcgtcattaatcgaaactatgtttggttcaccaaatgtcttgaaaaacaaaaagttaaaggaagccaggcttggcgtgcaatttatatgcaaagacctttgatcagccaaaaggcattaaattatgaatgaataactgagactagaattgtaaatataaacataatttgataatggtttgtccttgaagtcagaccttacttgttttacctggttattaatattgggacatcagggaaatgagatagaaataatatatctgcaagacatttagtcatttagaaaattgacaggatttcttatttgaatggatataatatagaaacatgttttggataatcagtggccacc

SEQ ID NO: 621562 - DNA, 1343 bp, Homo sapiens
  misc_feature (541)..(541): n is a, c, g, or t
  misc_feature (778)..(778): n is a, c, g, or t
  misc_feature (880)..(880): n is a, c, g, or t
gctcgaggccggggtgtatttctggcggctgggcgcgggtccccgaaggtattcgccatttgctagcagcgggggccgtaggcggagctaggtcggtcctctagacggccaagcaccgcacgtgtcccgagggacccggagcgcgcatccggaggcccggcggccgaagcgtcgcgcgatcgccaggcctatcacttcattccaccgtgcatcgcattagagaagtggaagatgagatgatgtcgagctcgatagtcacagacgcgaagctccttaagtggcctgcccaaatggcatgggagacacagcgatcgggcaccttggaaggacatgcctgaggggccccttgcgggtgacaggtgccccagccgtcgatagcaatggtccttccagcataagcgatgccgcacacgggaaaagttagtccatagcgatccttagagaaaaaacctttcggggggcccgaacccaaaaaaggggcgaaacggcaaattacataccaataggaggtgtagctaggcgcgaaagtatcccctggaanagaaaaaccctacgcaatcgaaattccccgacggggaagatgggaaaaaccgcaaagaggggggacaagaactccctataaccattaaacctggagaatgaatacgaggaagagaaaagaaggggacgtgggcaagtaccttccagctaaggggggaaggtccccgttgcggcggatggggaacagtggaccgccattggggggacggcccgtatgcgctttgttagccccttgtcnccttgggattaccccttaccattttggtgggaagttggaagggcgatgcatttttcccttttgccgtaggtgggagcttgggggcacccacgtgcgtgttcnggcttttcccgaggtttcccccaattggcgtgggcgccccccaagtgatacaggtttgtaggaccttttccgactttgtggaaggaactctagcgaattataaaccgcgttgaagacttagaaggccaagggctggtttgaaacagcagcggcccccaattgccacacaccaacgaacaattgggcggcgttgaaccacaaacagctagaaacccaaaaacattttggcgcgcaacaggagaacttggggggaaggggctggccccgccggcaaaatttccctagagagacagtaattggcggtcggtgaggacaatgtcattccctttcctatttgtgggaaccaaaaatggctgacaaacccccctttgtggggaaacggaccacgggtggcactacactttgaaaacacggctcaacacggcccctttccggggcggctttacacattttttcccccgcc

SEQ ID NO: 621563 - DNA, 565 bp, Homo sapiens
gagttatcaaagcctactctatagtctgcatactatcataagatatataatacattcgtgtatgtcgttagaagtctgtatctagatcacaggtatatgtacgcgcatgtgtgacctatatgttcctatatcatggtatctcctatgatgctatcccttatatcacattctatcaatacagataatacgtgcgttctgtgatcacacgcctccacgtagtgcgtggacagcgagcagttcacatcacattcatcagcctacatgctccagacacaggaggtgttccatatcctccatgattgcggatctctggatacttacgcagcgccgtagacaagctctgatgacgacgcctagaacagacggccacatgttcccatggatcgtggatcaagttcgggtcactctgatactccatcatatctctaagcaaaggcctcactcaatacagctcaacagtgccctctacggcaaccactgagtcatgcagcacagcagctcagcaggcacgcacagacctctcgcatgcagtcctcacgcggatctccgctcgtgccgaattcct

SEQ ID NO: 621564 - DNA, 229 bp, Homo sapiens
aacttcctgggcaagttcagcgtgcgccccgacgcagacaccctggttgatctgacgctgaaatacagcgatcgcagcgaagcgctgaccagcaacacggcccgcgacacgcaatacgccaacaaccatggcgcgtatggcctggccgcccgcctggaacaccgattgccggcggcgcgcctgaccctgcaggccggctgggaccatgccatgagcaaccgccggtcga

SEQ ID NO: 621565 - DNA, 334 bp, Homo sapiens
gtatcaataccatagcaagctgggtgtgatggctcatgcctgttaacccagcactattggaaggccaggcgggaggattgcttgagcccaggagttcaggaccaatctgggcaacgtagtgagacccgtctctacaaaaaataaaaattagctgggcatggctgtgaacgcctgtagtctcagctattcaggaggttgagacaggaggattgcttgagcccaggaatttgaggctgtagtgagctgtgatcacatcactccactgcagcctggacgacagagtgagaccccattaaaaaaaaaaatcaggaaaactttgcaacacggtctctca

SEQ ID NO: 621566 - DNA, 678 bp, Homo sapiens
ggtccgccgggtcctccatatccctgtaggcgctgactgatggtggaagaagcgaccaaggatggccaggaacgcacaaactgacacctcagtggcagcaacagatgcatctggtactacgcaatctgccgtcacacgagtggctaggctggccaagcaagatagtcaattacaacatagaccatgtctgggattcatgtaagacttgcctcgtcagttcgataatataccatacacaacaaaaacaatccatgcgctacgtggcgccatctactagtgtgtcgtggcgtgcagagcatatgaacagagcgtatgacgtgcagaaagtgggcaaacatggtgtgcttccgataagaccgtgtctattcgcgtaaaagcgcgcgagaacctttttctttgttgcattggcgggaatggggtgtgtcatacgaaaactctgtgtagacagagttatcctatccgctatcatttgaagattgacagtgctacagaccataataagagatactctaaacaccaataatatgaggcgcaccaggtggtgtaataacagcccggtggtcctattcatagttagtcgacattctcccaagggacaaaaccatattaccttgcgaaccaagagttgtcataaaagccgttggacggtttactaggagatccaagattaagttataa

SEQ ID NO: 621567 - DNA, 150 bp, Homo sapiens
acactaatgcttgattttcctacctcagtctccttttctattaatccctcttgtgggtggcatgcctgaggtaggaaaatcaaggcattattgtgcgcagcagtgtgtgctctgggtacaccgaccctcgaattgcgaaatcagtggtca

SEQ ID NO: 621568 - DNA, 394 bp, Homo sapiens
tatgtcgcagctcacacatctgcaggaaaaacagttgtggctgaatatcatttcctggccagaaaacatgaacgcagcatctacacttcgccatcgatgtcctgagccacagaagttcccggacttcccgaaacacattcggggatgtggggctgctcacccgtggatgtacagctgcatacggagggctcctgcctcatcatgaccacagagatccttcgctccatgctgtacagtgggtcagatgttattcgggacctggagtgggtcatctttgatggaggttcactatatcaacgatgtcgagcgtggggtcgtgtgggaggaggtgcttatcatgctacctgaccacgtttctatcatccttctgagtgccgccgtcccaaagcacagg

SEQ ID NO: 621569 - DNA, 927 bp, Homo sapiens
  misc_feature (454)..(454): n is a, c, g, or t
gatggcttccagcactggtcccggtgagcgctgcgtggctctgctatgtgaaactcccgacatataccggaagcaacgtgtgaggattgtgctctcggggcgtctcaccgcgctattgctcatctgactagtgactgactttccgtgaggcaacttgactactaacatgttgcgggactcgattgctcgcggggacgttctgggcgtgagccagtgaaaccattgtaggtagcacgatattgactcatcgcatgagccactcctccgatgccagagagagtcgtagcccgaacgtagaacgaacactggcacataccttgctcgtcttgtaaccaccggaaatgctttccgaagaaacaccgagcgctcacggaatcatgtgaacactaggccactagagactgtgcacctgtataggccagactcgaagtctaagcatttcacgagtgtgccnacatctttccgttcccacgttcccctgtccttagattgccgctgttttggtatccgttagacgtcacacggacaggaactatcgcatgtctcttggtcagacatgacacgagcttaacgcctacacagtacttgccttctaagttctgtacaagttgctgtacgatatgttcccaacgctctctgcacggggagtgaatttgtgctcccttgtctctgcatgaaataccaggtgctgttattcaaatcataacatttgtacatagtagactacctgcaacacaacagagaaggatgagatccaactcgtgagggctcccctcatcgcggcgggcgagaaacagaagtgtcttagaggctggcctagggaccatgcttgttgctggtcgcagtcctgatctgagcccgacggggtgttcgcgccgcgagccaatgcgtatgtggtcatgcctaaaaccattgttaccctgtgtg

SEQ ID NO: 621570 - DNA, 208 bp, Homo sapiens
gggagtagctgggactacaggcgcccgccaccgcgcctggctaatttttttttgtatttttttagtagagatggcgtttcaccgtggtctccatctcctcacctcgtgatccgcccgcctcggcctcccaaagtgctgggattacaggcgtgagccaccgcgcccggccagaagtcagcttttttcttaattggagacggggtttcac

SEQ ID NO: 621571 - DNA, 336 bp, Homo sapiens
tttttaaaaattttaagagggccactactcctcattgcctgccaagttcccaaaagagggatgggtttgggtgggaggttaagagggaaggttcccggcctttccagcagtgccccctataccgtttgggcttggcaaatgcgtgttgatcccagcgttttctccagggggcgctcgcttggtaggtccaagtgatcagtgagctttctccgcccgtgttttcctgagtgtcgtgaaagcagccggtttttgcccctcttgggattacaaagtcaagcccagagcttgaccctcagtagtgctcaataaaggcttagcacaagctcggaaaaaaaa

SEQ ID NO: 621572 - DNA, 939 bp, Homo sapiens
  misc_feature (58)..(58): n is a, c, g, or t
cccttaaccctagagatgtagctatgatcttaactccgccgatagtgctagagacgtnggcagaacccccatttgcagctatgctagcacagaggcggaagttccggagactatttgctcgaagagacgtgtcagcagtcggagagtaacggacggcatggccgcgcattactcactctactacgtatctactcggcgcagagatagagcatacccataaatgatttagtataacggcacatgaccgacgtacaagtttccgctagcgtaacaagcatgatgacgcaggtcctccgcttgcaacctactcagcgaacagacagtaattatgtggtaccagcacagaagagcgccatacgttttcctagggcccttcaccatgctcgcgtgtaatcggaagttccgaagaccacgactgtacgcctcccgtacatctgggctaacgaaagctaaccatcactgcactcgtgccgtatgaagaacaatcgttcgcttacccacatcgaccgacgaacgcgagtaagcttagtacctagatattcgtctgccagatacctcaattacctagtcgtccatgatattccgcctgtcatagagccataagaagatctccgcaacatcggcggtgggcaaaggaccccctggagggccaggggggactgctgcgggtgtttgcacagagtgcggtgaacacagctccctgggccatgctgacctggacgcgcctgccatgacagaagcccccagtctccctcatcttccacagtggagatgctgaaggtggagagccctggcaacgataccagcaggagccatgggccatgacagacgaagagaagggagggccgtgccattatccaccaggagggcaaaccgggtagtacccgcgaggggcatgtgaaggaggctgctgccaagtactaagaagccattgcctgc

SEQ ID NO: 621573 - DNA, 778 bp, Homo sapiens
  misc_feature (457)..(457): n is a, c, g, or t
  misc_feature (549)..(549): n is a, c, g, or t
  misc_feature (559)..(559): n is a, c, g, or t
  misc_feature (579)..(579): n is a, c, g, or t
  misc_feature (598)..(598): n is a, c, g, or t
cgcgtacatggaggaaatgtggggaagccttggaatgcccttctggttctggcacattttggtaaagcacactcagaaggcttcatcaccaagatttagggaggagtaaagctaagtatagttgatgtaacattgtacgaagcagtcataggaacaatacagaacaataggtaaagcgtatacagttgaatggcgtatatattctagaagatgactgcatttgatattttaggatatgttttctaggttatttgccttgtcattgttattctcttctagttgtttgacattcttagtgaatagatttgctctcgtagaaggaaacgtctttattgaggagggcaaaaattttggtcatagcattcacttttgctattccaatctacaactggaagatacataaaagtgctttgcatcgaattgtgggataagcttcaaaaatcccatggttgttgtnagggatagtactaagcatttcagttccaggagaataaaagaaattcctatttgaaatgaattcctcatttggaggaaaaaaagcatgcattntagcacaacnagatgaaattatggaatacnaaagtggtccttcccatgngcagtccctgtccccccccgccagtcctccacacccaggttgtttctgagtggttcttagctttttgttgttttttttttccctttcaacaatggtatttggaggctattgtgtgattttgaccagcacactctcgagtgtttaagacagtttttttccgcaagtagaacaaaaaaaaaa

SEQ ID NO: 621574 - DNA, 1057 bp, Homo sapiens
ggagtgcgctctcctcctcgcccgccgcgaggtccatcccggcccagcctgtcatgtccatccatcgttcacgtctgcccctggatatttatcatccgacgtctcaagcctggcttactctgtggccagctgagtcgcccagtgtgcgcctgtgttcctgagtcgccccgggggcctttggcatgcatgcagccgtctacggcctcggggcctcgttggctgcgcgtggccggtgcggctctgtcctattggtggggccgcggctggtgcgtcccggccctctccgcccatcgtgctccgttttagtcgggtcgccctgtgtggctctcacgtttagtgtgttcggtaccgtccgtgcccattcgtcttcgatcggggtgctccagcggaggggttagctggtcaaatcccggggaccctctaatgttctgcgtgtttgccctcccttttgttcgtgctcgggtgctcggtatcctggggggcctgtggccagcagaatctggcttgtcctgtgcactgctggggatgcgtgccttggcttcgtgtcccaggccgtcggggccatggtgctaggcggcgtcccgagaactttctttggaggctcccagattggctggggctttcgcggggcccctcttcccaggctctgcggagttggaatggtggggtccggctgggagtgcgcgtccttggtggtagcgcttgctgggattgcgggttgggtgagcgcagtcggagccaatgtaagtccccggagggcactgatggttttgggccacctgtactgccttggttcaggacatgcaagttcgtgggcgcccttgaagaccgggactggttgacttgcttgccaatgcattgacttcgcgtggtggtacacttgggtccgcccagtgggtgcatgtgcttgcactttgctggggctgcaatgttgctcctggcaatcctcctgtgttccacggcgagttggccccgtcgcctgttcgcttccccggagatctccgccctatactggcgggggtgccgcttccgcatggcccggaggcgtcggtacccg

SEQ ID NO: 621575 - DNA, 555 bp, Homo sapiens
  misc_feature (9)..(9): n is a, c, g, or t
  misc_feature (14)..(14): n is a, c, g, or t
  misc_feature (354)..(354): n is a, c, g, or t
taaacccgngccgntccataccaccccctcctcccagggaaccccctaagagccgtttggggagattttggtgctagctctatgactaggtttagaaagtcaaataagctcggtaggtaacacttcagactcaagccttttggaagtagaagaaaactaagtttgtaagtgaaggataaaaagacctgaatgatctcaattctaaaattctgattttaatggattttaagagatggaataccaggtgaattgattcaaaatattaaatatatgtgtttatatagtacttcagtgaaattaagaaaaatttttggtggagtaagtaccttaataatgttaataaatatttctacnagtgttttttaagacctttgtgaaccccaagtagatttttacaagacaatgaactttaactgttaaagattaattattataaatgaatcagcagttcatgtcaataatatgtgctggaaagtattttccccaattattggccattatatataaaaaatggattttatttgatcccaattcctttaactggcccaattcctg

SEQ ID NO: 621576 - DNA, 733 bp, Homo sapiens
  misc_feature (401)..(401): n is a, c, g, or t
  misc_feature (442)..(442): n is a, c, g, or t
  misc_feature (462)..(462): n is a, c, g, or t
  misc_feature (498)..(498): n is a, c, g, or t
  misc_feature (505)..(505): n is a, c, g, or t
  misc_feature (514)..(514): n is a, c, g, or t
  misc_feature (522)..(522): n is a, c, g, or t
  misc_feature (537)..(537): n is a, c, g, or t
  misc_feature (542)..(542): n is a, c, g, or t
  misc_feature (551)..(551): n is a, c, g, or t
  misc_feature (553)..(553): n is a, c, g, or t
  misc_feature (559)..(559): n is a, c, g, or t
  misc_feature (564)..(564): n is a, c, g, or t
  misc_feature (566)..(566): n is a, c, g, or t
  misc_feature (572)..(572): n is a, c, g, or t
cagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgctattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcaaatcctgcaaacttaacggcagttccgtgaattctggtagccagtgttcacgaactgccgttaagtttgcaggatttgacaggtctggaacncatgctaataaattgctcaaaaatgcttcctgctgatatcncgcagctaaataatattccnccaactcaggaatcctactatgatcccaacctgccnccggtcnctaaaagtntagtaacnaactgtaaaccagtnactgncaaaatccncnaagcanaaggncnaaaacnaatataggtttgaaatcatgggagaaaaaaaaatcgcttttaaaatgatttggaccaacgtttttcatgtggttggccagttggatgacataaaaaaaaaccctaggggctgatttttataaataatttttaattatgccaataaacctgaataaaaggga

SEQ ID NO: 621577 - DNA, 605 bp, Homo sapiens
  misc_feature (344)..(344): n is a, c, g, or t
  misc_feature (372)..(372): n is a, c, g, or t
  misc_feature (374)..(374): n is a, c, g, or t
  misc_feature (482)..(482): n is a, c, g, or t
actcacctggctgccaggatgcgtagcacaggcctatcagtggaaaggggcatatagtagtctttaaatatgcctttatgtcagagagtgttttaaatggtttgctagtggttatgttcatttctgtcccaatcagtgactattttaaataatagtgtatttactgtcttaacttctagtattggtgctgtttgatgttttcacatttaattaacttatttcatcatcataatgcaattaatgtatttgtaaattgaattttccaagattctgatatttgaagggtaagcatcttgatggatatatgtccatatgtttagagaaggttttggttttgggggcancagattgactagttctttaaatctgtgngnaacgtatgttttattcctcatttcttcctaatctgatgatcttgattctttttgattaacatgaaaaatcctgtctgcttgttttgggaaaaaaaaatgctttttttntcttctagctctccggtgtgacctttaggcatgtcatttccccttgtctgggggtcaggtcattcccctgtaaaatgagttggcttaaatatctccgagattccttggaaatttttccttttt

SEQ ID NO: 621578 - DNA, 746 bp, Homo sapiens
gctccttcgtcgcggcctctagtgcactttcggctccttaccccttcccgggcctttcagcttggtctttcctgggcctcgcttcccccagcccctgctgccctggcctgaacgagaggttcctgtgagccccgtgcgctgggcgggtatctagggtgtgtagactgctgctgggcacagccctgccccagccgagtgttctcgtggaaccgccttgagagctatcagcctgctcccagtggtgtgcagattagaatcccaagaaaatcaaatggcatccggggatttctgctcacctggagaagggatggaactacttcaacaagtgtgcagcaaacaacttcctccttgtaacctgagtcaagaggacctgttacagaacccatacttacagcaagcttctcctgaatctctcacagcactgtggatgagacgtggcttaagcctcaaccctagcaaaggagccaggctcaggccatggcacagcgacgtactgactgccgattcaagcacaaccattggcttgcagcgtctgcagcattctcaccacagcagtcaattcaagcactcgctctgtggcactcacttcatgtgacgcactcccacgaccacacctgtaccctatctgcgtgacacaacgcgctcgtcactgagaacccgtaggccacacgcggccttgctttgtacgcttgcaccctgactgcggggtctataggttccctaacccaggcaagaggggacgacta

SEQ ID NO: 621579 - DNA, 147 bp, Homo sapiens
cgctctcgacagtggggacacagaggcttagtttagtatatagtctaaccagattttgcatgtcaagcattggtccttttcctggctaatgttttcttgtagaacttatataaaccctatcaaatccactactaggtaaatttttaa

SEQ ID NO: 621580 - DNA, 585 bp, Homo sapiens
gcaaagcagctcagtgttcaccgtactttttgctgtatgaattcccttcggatatctgaagatgacaggcacaattcctggcattgggcatgcattctgccaccaaagagctgtgttgttgggatgggtatggccctcctcaggtgcctcttctcaataggattttttttttgtcagagtagtaatatttttagtactttagagtgagtcaatatatcagatttttgagaattcaggtggcaatagtagggaggattgtggatgcacggggaaagtagaaatatgtgctatgctggaagcaatgtgctcatgaatgtaatcccggtgctttggcagtcttaggtgtgagaatcagttgagcccaagagtgtgaggccatctgggggtaaataatggtactgtgtgtcacaataattaaacaattacgctggggatagtggtgtaagcgtgtagtgcaaagagtttaggaagaggaggtggaaaaattgttttagcgcaagagttagagagtcaagtaagcctgaggtcctccaccccgaccaccagcaccggcagccgagacaaggacgatgagagcaagaagca

SEQ ID NO: 621581 - DNA, 950 bp, Homo sapiens
  misc_feature (6)..(6): n is a, c, g, or t
tgaccnaggtcgcgcgtgtgttacttgtctattattatattgttatagttacttattgattgtctctatttcagggacctattctatttatcggtctatccctagaacagtatctggtcaccagttcaataaacacctgtatctctcaaatgcatgtatgaatgtgcagagctcatgaaatgagtttacaccttgaaagctgcaggaagagctgatgaggcaaaggggaggagctgcttggcctttctttttatagccatcattgctgcagtgactgtttaacagctcttgatccttggtctgttccttgatttattggtgagctgccaggttcggctcaactcacaactgcctcactcagcacagagaacaaggttccgctgtgccacctggtgtcctgacttcccatcaccacagatgagctttggtctcagaacaaactgaaagctcagagggaaacaccaaaccctataagctccccactccagcaaatggatatgttctcaaggattctttgagatctaaatcttcaggtaaggatagcttcatatccttacttactaaagcaaacttttattacagcactgggttcaatgcctctcaatgcctcactcttccctacaaaaagcgaacacatgctgatgaaaaaaaatctcagatccttttcttagggcaaatccatgaatctcttgagcagtttcaacagactgattgatgtgatggtcactttttgtcacaagatacttctgcaaaataggaaaattttccagcttgctctggaggggggtacattgtttggcaatttcaattagctttattcccaaactgcttaattgcaacagaggccatgcctggtaccatatcaagctttactccaatatcttaaatttaagaaatcatataagccttagaaacacaggtcatgtaaacaacacgcgcggatcctctga

SEQ ID NO: 621582 - DNA, 132 bp, Homo sapiens
gggatgggcgagctcagtggtaggacgatcgaagcgggagccgggaatttttttgtaggagcgcctgatgttgccgaaaggcgtgctgaaggtgggtcgcgcgtcgtagctctcgtggctgaaatggggaga

SEQ ID NO: 621583 - DNA, 398 bp, Homo sapiens
  misc_feature (1)..(1): n is a, c, g, or t
naacacacacttctctgggttgcttgtagaggaccaacccttccgattcaaatacacgcgtttcatccacccttaattctgggcccgagtataagaaatttcctgaagtgtctctgccaaaaaagaagccagagggtgcacgggttgcgcatggtatcttcttcaccggtagattcttgtgtggccttgtatagcatccaggctctccttgaatttctccggcagagtttctgcaagttcacagaccaaggcaccattgtccaacttctccataaaagtttctcctgtaatctccttccataatagattggttacccacaagccagtatcctctctcagtggtagcaaattagcttcatgtctgctggatacccagtggctatactgatgcatatcag

SEQ ID NO: 621584 - DNA, 443 bp, Homo sapiens
  misc_feature (8)..(8): n is a, c, g, or t
  misc_feature (46)..(46): n is a, c, g, or t
  misc_feature (53)..(53): n is a, c, g, or t
  misc_feature (142)..(142): n is a, c, g, or t
  misc_feature (206)..(206): n is a, c, g, or t
  misc_feature (426)..(426): n is a, c, g, or t
gggacgcnaaaccccaccccacggaaaatatgccctataatggtanccttttncataaatggtattttttaaaaaaattaatttaaacccccccttcctcctccttcagagttaaagatgatgttgggccctattgtggtgnctcatgccctgtaatccccagcaccctggggagggctgaggcggggtggatcaccctgagatcnggagttcaagaccagcctggccaccatggcggccccatctctactaaaaatacagaaattagctgggcgtggtgcatgcgcctataatcccagctacttgggaggctgagctggagagtcatttgagcccaagagatggaggttgcagtgagcagagatcatgccattgcactccagcctgagcaacaagtatgaaacatcctacaggagtgtgaaatanccatctcaaaaaaaaat

SEQ ID NO: 621585 - DNA, 609 bp, Homo sapiens
tgaacaaaccctgtcttgggtgggtgtgggtataatactacagtggaaatgatatcatttacggggaaaggcgcttgtgtgaagtaggccttatttctctttgtcctttcgtacagggaggaattcgaagtcaaataaaaaccgcccgtggcattactcccggctctggaactccagaatcacgtaggcacttcaatcgtctcgaacaaaccacaccttctaatagcggcgtgcacccatgtgggcatgccctgactccacacatcggaggctcgctaaaaacccctaatgttgtgtgaaatatgcgcacctcttaacaactagcgcatgtgcgcctgctctcaatcccttaaggggttcacctttctgctccccccgtcttgcgctcccaacgctaacatatgcgggaatccaatccgcccttcatcagttagctccaccgcatttcggacactttgccctgcacacgctccttcacccacttgtcaccactcgcctcccagccacgcgctctcgggcgcctatcttcgcctcccaacaacttccccccccacccccgcaaaactacttaacatccgccacctctttctcggcccacttttccccaac

SEQ ID NO: 621586 - DNA, 124 bp, Homo sapiens
cccttcgttctggtgggcgctggtgcggagactggcggatgacatcggtgagctgggtgcacttgagaggcatggcctgtctcctcacttgagtgcaaggtccatcgaccagagccctgttctg

SEQ ID NO: 621587 - DNA, 268 bp, Homo sapiens
  misc_feature (110)..(110): n is a, c, g, or t
caggaggtctcgtcgaggtgagagcggggccagagccagcccggccattcaccattcccctgtcctcccacaggccactgaggtgtctgaacacaggtcagggtgactcnatgtgtgccctgcggattggaaggcagaggacagaggagggaagggaacagccacatgcccttggtggtgccctgtggccacagacccgggcccagagctgaaagtggggtgcccctccaactccccaagccttgccccaagggagtcctgcctgccg

SEQ ID NO: 621588 - DNA, 837 bp, Homo sapiens
  misc_feature (14)..(14): n is a, c, g, or t
  misc_feature (62)..(62): n is a, c, g, or t
  misc_feature (93)..(93): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (170)..(170): n is a, c, g, or t
  misc_feature (175)..(176): n is a, c, g, or t
  misc_feature (179)..(179): n is a, c, g, or t
  misc_feature (182)..(182): n is a, c, g, or t
  misc_feature (190)..(190): n is a, c, g, or t
  misc_feature (194)..(194): n is a, c, g, or t
  misc_feature (200)..(200): n is a, c, g, or t
  misc_feature (216)..(216): n is a, c, g, or t
  misc_feature (225)..(226): n is a, c, g, or t
  misc_feature (228)..(228): n is a, c, g, or t
  misc_feature (231)..(231): n is a, c, g, or t
  misc_feature (258)..(258): n is a, c, g, or t
  misc_feature (267)..(267): n is a, c, g, or t
  misc_feature (271)..(273): n is a, c, g, or t
  misc_feature (280)..(280): n is a, c, g, or t
  misc_feature (303)..(303): n is a, c, g, or t
  misc_feature (308)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (329)..(329): n is a, c, g, or t
  misc_feature (332)..(332): n is a, c, g, or t
  misc_feature (355)..(355): n is a, c, g, or t
  misc_feature (360)..(360): n is a, c, g, or t
  misc_feature (421)..(421): n is a, c, g, or t
  misc_feature (435)..(435): n is a, c, g, or t
  misc_feature (457)..(457): n is a, c, g, or t
  misc_feature (459)..(459): n is a, c, g, or t
  misc_feature (479)..(479): n is a, c, g, or t
  misc_feature (487)..(487): n is a, c, g, or t
  misc_feature (517)..(517): n is a, c, g, or t
  misc_feature (521)..(521): n is a, c, g, or t
  misc_feature (581)..(581): n is a, c, g, or t
  misc_feature (826)..(826): n is a, c, g, or t
aattcaatattggnatacaatatccattaccttatatacttgtagaaacaaggttgcaaccngaaggttaacatttatgtatttatgactggntacatttatgacttaaaaataaccagcacntcnggggtngggtgtggggggtggtgggggtgttttttttgtggggnggggnnttngtngatggggngggnagattnctgagttccaaattangggataagnngngcncccacggcgaatgctgggggggggggngggggggtntttnnntgggggnttggtactctcaggggggtaggnctttnnggnggnacngaagcnaggtngtngggatctgctcatcaggtttatnagggngactcacaaatgcctcagcaaatcccaaatgatcaggtcagtgtttcttaacacacatganaggttacagatganattttcagataagaaccaagananatgtcataacccaaattttnggcaaaantgtggcacaactgtgaaagtcctacatgtnagtnacaactgctatctttgctgtgactttcctgtacagtaatttttgagcattgtggcgaganaccaatgatcatctaatcagacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaaatccacctcttgccattcaatttgtcagatggtgaagaccaagaaagaatgttccatcagtttcaattttaaaatacngattgtcaaat

SEQ ID NO: 621589 - DNA, 227 bp, Homo sapiens
  misc_feature (37)..(38): n is a, c, g, or t
  misc_feature (104)..(104): n is a, c, g, or t
  misc_feature (145)..(145): n is a, c, g, or t
ccttacgctagtggaggttgcagtgacgcagatatannacactgcaaggcagcatggaccacagagctccatctctaaaaaaaaaaaaagtctatgaaggtcanatgactttagtttcaaattagtctcaattctactgtaggtnggtaaatagcttcaaacttttgggcagcttcacctataaatgatttataatagcggtgagggcggggatctccttctaaagt

SEQ ID NO: 621590 - DNA, 430 bp, Homo sapiens
tccagctaccaggaagctgagggggagacagaagttgcagtgagctgagattgagccacgtgtgctctagcctaatgcaacagagtgaatccctgtctccaaaaataacagctaattttatcaaagagaaacacttcaggtacttataggaggtcatcgaatgtgaccagtgaaggtgttttttctgtaactttccctactgcttgccaagccattggcagggcagggcaggagcatttagttgcttctctctcatgacagcctcaggaagagacagggctgcacccacttccagatgggaagttaagctcggggaagcgggggatgacccaaggtatacccacctcagggctcaccgaagtcaagatacatcccaggtcaggggcctgaggaactggctccaccactgacttgctgtgagctctgcctg

SEQ ID NO: 621591 - DNA, 220 bp, Homo sapiens
  misc_feature (143)..(143): n is a, c, g, or t
  misc_feature (168)..(168): n is a, c, g, or t
ccgggtcaaggctgcagtgagccaagatttgcaccagcgcatctccagttctttgattgacagagtcagaaacctgttctcaagaaaaaaaaattttattgttgagcttgatccctaaacttgggctcaaaatgagggcttantcttcattctaaatgtcaaacctantgaatgtaatttgggattatccatttcaaattcaagtaattgctaagtctac

SEQ ID NO: 621592 - DNA, 441 bp, Homo sapiens
gggaatcagtatctgcgtagtatcgggggctgatcatctgaggccacagactactccttgcccaccagataatagccagttcggggacggttagcccgacttctcttctgagtatccaaactcgaacttgctataatcttgtacttatagcaacattgattcaagcacttgtgtgtgccaggtatgatgccacacctatgaggatagaataatgaagaagatatagcccctggtctcggggagttcatagtctttgtggaaaggctgacaagatccacaaggtattcaaaacccagcaggatccaggctggcatgaaggcaactctcaagggcacaggccgtgcgcaccgaggaggacctgacaaaacccgtggaatgcaaggaggacaccctggaggaagcaaggccaatgctgccaatatcccatagcctaccgagcag

SEQ ID NO: 621593 - DNA, 142 bp, Homo sapiens
acgcgcaccgcggtcacaaatatattcctgagatctccctggcgcactcagattcttaacactaatatgagagtacagaatgtaaagccagaaagtaccttgagacgggtctcaatcaatttagtgagttaattttggccac

SEQ ID NO: 621594 - DNA, 162 bp, Homo sapiens
gagcggtcctactctgagagaatcctcagcttacacagaagctattagcgttagtaagaacccaagcaaacctcactttaatcactacatgtgtgaagcaatatgtttatccataagaataactgcaaagctaaccctgctgctgttgtctttcagcaggta

SEQ ID NO: 621595 - DNA, 822 bp, Homo sapiens
gcgcaaatagatatagtaccgaagcgaacgatgaaaaattataacaagcataatatagcaaggactaaccctataccttctgataatgaattactagaaatacattgaaggagagccaaagctaagacccccgaaacagagagctacctaagcacagctaaaagagcacacccgtctatgtacgcacaactagtgggcagcttataggtagaggcgacaaacctaccgagctggtgatagctggtggtccaaggatagaatcttagttcaactttaaattgtgcccacagaaccctctaaatcccctgtgtaacatttaccctgttagtccaaagaggaacagtcttgtggacactaggaaaaacttgtagcgcgagtaaaaaatttaacacccatagtaggcctaaaagcagcaccaatttaagaaagcgtcaagctcaacaccataactaaaaaatcccaaaatataatgaactctcaacccaatgtgacaatctatcacctatagaagataatgtagtataagtaacagtgaaaacattctcctcggaataagccctgcgtccagatcaaaacactgaagtgacaattaacagcccaatattacaatcaccaaaagtcttattaccctcagtgtaaaccaaacagggatgccataggaggtcaaacagtcaacgaccgccggaattacccgctgtacaaaaatcctttagatacagatagaggtgcgccgtgcactgtcaggcgggaccaccggaggacaaacatgcccacagggcgtaaggcagagacggtataaaaaagcgcgaagggacacggaaa

SEQ ID NO: 621596 - DNA, 444 bp, Homo sapiens
atagggtggaataacacatgcagattgacatgatttgaatctgtgtctccaccgaatctcatgtcgaattgtaatctcccatggtgcagtatgtgggatgtgattggctcattggggcatagttctcataaatggattagcaccatccccttggtgctgtacacatgatggtgagtgagtgaattatcgtgaaatctggttgtttaaaagtgtgtggtgcccccactctctcttcctcctgcactggccacgtaagacacgtctacttccccttcaccgtaataggtttccttaggccttcccagaagccaggaagatggcagcatccatgcttcctctacagcctacagaaccactagccaattaaaccttttttctttatatattacccagtctcaggtatttctttatagcagcatgaaaacagacgaatacacccttatg

SEQ ID NO: 621597 - DNA, 157 bp, Homo sapiens
agattatgctatcagattacagctatggcaaccgaccactatcagggggcagtacacatgactaagtacccatattaaccaatacacaggccattatcgccctcagtggcaaacaacctatcgcatcatcggccacctcggtgccacctatttgctt

SEQ ID NO: 621598 - DNA, 148 bp, Homo sapiens
acctcatcctttttaaacttaaaagtaagtgtgtcttaacggtaagcatgtctctttataatctagcatgccattccatgtatttaatggagtgtttagtccacttacatttaattgatatttggtatacaccttacctttctcggta

SEQ ID NO: 621599 - DNA, 249 bp, Homo sapiens
cacctagaatagatattcagcgtagacttcagtgatcacagagatctgaaaagaaagaccaacaaagacaatgacagacacttctgtgctgtcgtgcacccagaaaaatacaacccatgtatagaccttcaattattttacattattgagaatattttccctgctgaagcaaatcaaaattacatttgagaattttaattgaagtaacacacatctaggtgtgtcacagtgcggggagtgatgctttga

SEQ ID NO: 621600 - DNA, 635 bp, Homo sapiens
gacgggttaagccaatgacctcttaacccagtacacaatgaaacagccaagcatcttaagttcccaatctcaaagtctttgggcctgcctggctttgacctggaggaactccttggcaacaccctttcaagggccctgtttcaaaatgtcttctgtcttaagcttacgcaagcttgcttgccgttctgtggaccatacaagtgctccttttcacagatgatggctcctgcagggagtgcccccagtgcccagcacagggccaggcacacagtggtgcatcgggaacgtttgcttgatgcccaccctaaggccaatcaaggagccagggggctgggtcctggtcctcacatcctcttccagcatcttgcccttcttggagcgggcaccccggccgaaggcgccctgctgcagctcctggacgcgacggcggttgcgggcagagagctgcttgaggccaccacgctgcaggaagtgcagcttctgggcccggcgccgctgcttcaggatctgctgcttggtcttcagttccgggcagaactcggcctgcaggggtgcctggggcgtggggccgggatgcaccttggccacggtctcgcttcccacctcttcgctactgggcctcgccggtcagatgc

SEQ ID NO: 621601 - DNA, 491 bp, Homo sapiens
tctggctgcaagtgtcgtatcacgaccgggtatcttacaggaatatctgtgcatctatggctatagaaatagaatcgctactccaaaagtccttagatgaagaataactcaggtagtaactgataatgatacctcaagccattaaagtgccagaacagaaatcttacaaactgaaacaaaccttttaaattattctctaaaattacatatttttaaaaatttaagactgatttgaatacttaacatgcacattttgaagaacacaaaataatgttccctaagatgatttaatatcatggcaaagatgctcacaacatattctttcgtgaagaatccagatggaaaaagtatatatgagctgtcatagcatgtttaggtagaattcacataaaaatcactatttcaaccattctaaagtgtctaattcaatagccatttagtgcactcacagtgtcgtgctaccttcatcactatctaggtccggaacctct

SEQ ID NO: 621602 - DNA, 876 bp, Homo sapiens
  misc_feature (4)..(4): n is a, c, g, or t
  misc_feature (71)..(71): n is a, c, g, or t
  misc_feature (93)..(93): n is a, c, g, or t
  misc_feature (104)..(104): n is a, c, g, or t
  misc_feature (115)..(115): n is a, c, g, or t
  misc_feature (127)..(127): n is a, c, g, or t
  misc_feature (129)..(129): n is a, c, g, or t
  misc_feature (142)..(142): n is a, c, g, or t
  misc_feature (182)..(183): n is a, c, g, or t
  misc_feature (226)..(226): n is a, c, g, or t
  misc_feature (230)..(230): n is a, c, g, or t
  misc_feature (249)..(249): n is a, c, g, or t
  misc_feature (252)..(252): n is a, c, g, or t
  misc_feature (343)..(343): n is a, c, g, or t
  misc_feature (345)..(346): n is a, c, g, or t
  misc_feature (366)..(366): n is a, c, g, or t
  misc_feature (369)..(369): n is a, c, g, or t
  misc_feature (382)..(382): n is a, c, g, or t
  misc_feature (390)..(390): n is a, c, g, or t
  misc_feature (396)..(396): n is a, c, g, or t
  misc_feature (401)..(401): n is a, c, g, or t
  misc_feature (487)..(488): n is a, c, g, or t
  misc_feature (490)..(490): n is a, c, g, or t
  misc_feature (497)..(497): n is a, c, g, or t
  misc_feature (523)..(523): n is a, c, g, or t
  misc_feature (525)..(525): n is a, c, g, or t
  misc_feature (561)..(561): n is a, c, g, or t
  misc_feature (815)..(815): n is a, c, g, or t
  misc_feature (862)..(862): n is a, c, g, or t
attnaaaggtatatcccttagtactaaaacataatggtagtaggttagtttacctctgccaactcaaaatnaacaatgatgtattcaaaatanaaaaattaaanaaccttaaaanaaaacaaaaaantnacccataaaacanggtttacaaaactcaagaataagatatactgccgttcttnngtttttcattgtgtactgatccataacgtgatgtcaaattggntatngccatcatgggtagactcnggntatacattgcactgagtaactgtttacaacactttaacactgtacttcttacattcactaactgccatggggggtcctaaacactacttcngnngcttcattcatagttatganggngtctacttgcttntcttaagntttttnttttngcacagtaagggcatcagtggaagtatattctctatttataaaattgccatcacttctaacttaaaaacagtctgtagaaaaaaanncnggagggntcaatctagtctggacttaccttagngnggggaagcaagttttcgaagtgataatttattttgngttactaatacaatagaaactagttttcttgatgggattcagtttgaggcagtaggttctgtataaaaatttttatcgtagatacaaatgtcacctgttttctagaaaaaaatattaaaagataacttaatgaatatgccaaactttataggtctgtatttttctttatataaaatgccctcaaatttaaatgtaattcccatatagcaataaagtccacatctctagattacctattacttgcattatggggngtgtttatactgcctagaatgttaaccttattatgccttaaaagtanatttgtgaaatgtt

SEQ ID NO: 621603 - DNA, 235 bp, Homo sapiens
tgcattaaaataatttattacttacaagccagatttatagcctcagtatttttctccacaaaacataattttatgaaattacgtacataaatttatgacattacatgcatatttagttgttataatcttaaactataaatgtgaaatatgtcggctttaataacacaaatcagactgctatggtacagtacagccgagaaagttctatattatatagccagcacaagaagcaggt

SEQ ID NO: 621604 - DNA, 284 bp, Homo sapiens
ccccctgggcccccccttggggggggccctttgtttgggcccccctagcccccccccccaaccaatttttccctggcccccctttttgggcccccccccccctgggggggggggccccctttttagcccttcccctttcaaaggggggttgtggaaaaacccccattaaaaggtccccccccccccccgtttttgggggccccgggggcgggggtttttcccctccccccggggggttttggggggggggggggggggtttttttaaagtttttccccttttca

SEQ ID NO: 621605 - DNA, 106 bp, Homo sapiens
agctactgaccagttcatccagttttccccacagtcgttgctgcctattgtggtgccgcctcaggttaggggctctcagcaatctctatacctctgccctcgcctg

SEQ ID NO: 621606 - DNA, 363 bp, Homo sapiens
tgtttgcagcgctgaggcaggagaattgcttgaacccaggaggcggaggttgcagtgagccagattgcaccactgcattccaactccagcctgggcaacagagagagactccatctcaaaaaaacaagaaacagaaagagaaagccccttatacttctgtgatgccttcctgaccccccaggcagcatggtcttctctctgtgctcccatatataccagtactcactgacattatagcacatcttattgtgccctcatggcccaccgtgtgtcctcggaggcctgggactgtggggaaatcatactgcatcctctgcatctggcactgtcatgacacatgggggtggacataaaccagttagt

SEQ ID NO: 621607 - DNA, 401 bp, Homo sapiens
  misc_feature (13)..(13): n is a, c, g, or t
ccggggggttttnaaagggactttcaggaatttgggaatttcaaaactttccaagcccccccccttcctaaattttaagaactttaattggcggtttcaattgaaggggcggttggtagacttaacccccagtgaaagccccgccttcatgacaaacccttgaaggtttttttaagaaaatgatggtggtcatcgcagcttcagcatcccctgttttttgagggtgggcccccttgggggatttcagtttccggggttttcctccctcagccccttttcccccctttgttgtcttggggagtgatttggggagaaatggttggggcccccttcccccagccccatttatgggtttcaagttttattattgcaaaaaaaggggtttaagcggggttttttca

SEQ ID NO: 621608 - DNA, 465 bp, Homo sapiens
ggatcctgggcttggggctggctgcagtctgtctgagggcggacgaagctggatggtcatgtaagatgaggcttctgctgcttctcctatggcggcgtctgcgatggtccggacgaggcctcggccaatctgggcgcgtgtgtcccagactaagagcattacacgatgccagtagcgccacggggccgctgctcaagttccagattagtgtttccggtgaggttgataggcgggattgtggagagagtacaatgcgggtcattgagaacagacggtacccagaggatcgcgcattgaagggagagaatgacgctccctcaagcaagtatataggacacatagcatactgttccgtgttcagtcttcaaactacgtattaataggctgtacatacttgttggcaaggatcctttggcgtttctttggcatgcaagcctcctagcatctggcaggggggcaagaaag

SEQ ID NO: 621609 - DNA, 315 bp, Homo sapiens
gtcgacagaatgggcttagcatgtataggtactcaataaatatttgttgaatgtcgaaatagcatatgttgggaggccaaggcgggcagattacctgaggtcgggagttcaagaccagcctgcctaacatggagaaactccgtctctactaaaaatacaaaaaattagccgggcgtggtggtggatgcctgtaatcccagctacttgagaggctgaggcaggagaatcacttgaacccaggaggcggaggttgcggtgagctgagatcacaccattgcactccagcctgggcaacaagagtgaaactccatctct

SEQ ID NO: 621610 - DNA, 625 bp, Homo sapiens
gaagagttttatactgcagggcttgtcttcactgagagctaaataagggtaaagtaagataaacttaaaaatgagggattgaggcccggcacagtggtgcatgcctgtaatcccagctactcgggaggctgaggcgggagaatcgcttgaatccggggggcggaggttgctgtgagccgagatcgcgccatttccagcctgggcaacaagagggaaactccgtctcaaaaaaaaaaaaaaaaaaaagaagagaaaagaaaacataagtttcagccaggcatggtgggtcacacctgtaatcccaacactttgggaggccagggtgggagaactgcttgagcccaggagttcataccagtctaggggcaacatggtgagaagttgtctctactaaaagtaaaaagaattagctgggcatggtggcatgcacctgaggtcaggtcccagcgacttgggaggttgagaggttggaggattgcttgagcccaggagatgaggctgcaatagcatgatcacgccgctgcacttcagcctgggtgacagagcgagagcctgcctcaaaaaacaaatatgtttcaacttttttataataaatatgttcattttgcaactagcaaaaaaaaaa

SEQ ID NO: 621611 - DNA, 1818 bp, Homo sapiens
  misc_feature (143)..(143): n is a, c, g, or t
tgcgcgtctgaccagccgcctgtgacgataggcgaggaacaagcgccttacgaaaagcgtgggtatagatcggaagcctactgaaagcaaagtatgtgtgtgtgatcgcttgttgtactaagcgcacatagcattaggttatngattgttgaagagcatccttgcgtaatagtatcgcttcatcacgcaaatgatccggagggaccgctcgtcgcctcgtgacaccgaatgcgtaaccgagtcttgctagtcttgatgcgttcatctacatgtggctcggatgttggtcatggaaatgtagtagatacgtttggctagtattttgacaagaatattgaatgcaaggatatgacttgtataaggaatagtaatcacgagagtctagcatatcacgtcgcataggaattaatatcctaatgcgcgattagagacaaatgtgtgttccttgaacctcacaagcttgtacccaaattagagtcgattggtggactccatttgagctcacatgtagaaacatagacgactagtacgtatactcgaattgtggtaacaagactaaccaactgtgggcgaagtagctacaataagcaatcttgaaccaccgcatttcgagcctggttaccggtatgaggcttctaccaggtaactcttgatcccccgtaggttgggggtttatgagcctttgatcatccttccgggtaccattagatttggccttagagtcgactattggccgaagtttatttaacacgttgaacaaggaaacacactctgcctataaattagactttccaaggaaattaaccggaggaacaaaggaacctccgtccggttctcaatagatttccccggggcaaaacgccaaaaggcaattgggagatcgcggggcaccaatacaaaatcgcacgcgcacaagggaaacacggaggttggacctttgggacaaacatatctaagtaggaatttcgcaagaacggaaaggggtagcgatcgaaccatacaaattgtaccgttttgtccccaacggaacacgggtcgggttccagcggttaaaaacaattatcggcatttcgcaaaagagaaacgcgggttatttcggggcactacacaagtatccattttaggcatacgatatcgggctttgggatcggaaattctccagtttttacgttacccttactttcccaatagaattgcgttcggaaaaccgataggacgcaaaaacagtgtctcagacacatattgcgcgtggaaaaaagcactgccctcggaaaggttcttcggacgtgtgtgtgcggacaaagggctgccaatgggggcccgccgtcctccacatagggtcgaacaacgggcgccgacacaagattaccatggggaaagcactaaccccacctttggagcggacgaccgacacagggggatcccattaaaaaggcttgcacacggacgcatggaatagttgcatcgttatttaaaacggtccacgatcctacgcaaatcctggtggtgcaacaggctgccacgacgtgctcaaatcttgttggggggcaacaacaacaccaacatgcgccaactgggcgggcacgcggacccaaaacacagactacaccgaggaggggcgcgccacgataaaatagcattccacccagagggcacccaggctaacagagggccccccgatattgtgtcgcaagtagcaacccccatgggtcgtcttataccaaacgcgcgcgcagcatacaacgctccgtcgtcaacacaacacctacgtatggtagcactacccaacgtgataattgtaaccgagcaacatatcgt

SEQ ID NO: 621612 - DNA, 352 bp, Homo sapiens
ttgtgtctcagccagtaagctcagggtttgaaaatcaaagcctacaacaagatagtgtgattccgcttctgtggggttagtaggcttccaaaggggcaatgatcattcattagttcaacaaatactgcgggcccactatgtgccaggtgctattctaggcactagggtcatatcagtgtacaatcaaagatctctgagcaagtccagtggcattgtgcctgtaatcccagcatattgggcagcctgaggtgggagctctctttagctcaggcagttagcgtccacagtgcagctatgatagtaccactgcactccggcctgggtgacaaagtgagcaccctgtctcaaacaa

SEQ ID NO: 621613 - DNA, 295 bp, Homo sapiens
  misc_feature (274)..(274): n is a, c, g, or t
ggaaaaatgcagctcccagtcaactctagccttcccacatggagaaaaggaaattccctaactcccacctccctctagacttcccagttgtgggaagggaaataacttcagccctctccagccaccctgttccatttgaagggaggaaaaaacctgagaaatgctggtggaaggtcacagtctagaggcacgggctcaccagaggactgagacctaatcctaggcctatagaatgcttctcctcccccatcaccctagtactgcattacaaaanacctgtttactgtaggcttta

SEQ ID NO: 621614 - DNA, 404 bp, Homo sapiens
aattttttattgtatcctggacgttggaatgtgacgatatgtgaactctgggttctgttatagtcctgtagggaacattggtagccttattttagtaggtatcaaccctcttaattcaaattataacttctgtctcatcttccatcagctctcgctccttctgtaaacccagttattcagttatcagctccccaagcatttgctacactttttaaaatctgttccctgtactgtagtttaggggttaaacaaagacttctgagtgttcatactcagaaataaggagccaccttccccagctgttctcctcagggtttctcccacactggtccaggttatgtggtttccttgggctagagttgcagtgggatttccggttggagttttggctctccatacagctc

SEQ ID NO: 621615 - DNA, 125 bp, Homo sapiens
gggatacactatgttgatgaacgatgttggcatacgacttctccacacacatcagctggacagggacagcgtggtgtccgtccacacccagtccagtgactgcccgcagccttcgacccctggga

SEQ ID NO: 621616 - DNA, 185 bp, Homo sapiens
  misc_feature (79)..(79): n is a, c, g, or t
tcagagcataccctgactaaacagtagaattgtatgctgaccaagatcgtcctcatctcatacagtgcatatatgatantgacatttattggttccctggcaaggatcgggtatggttccagctggcacttggagaacattggctttaaaacttattccgggaaagggcaggtgtcccaggaatg

SEQ ID NO: 621617 - DNA, 202 bp, Homo sapiens
cacaccacctgcgctgagtagctgacactacaggcatacgcatcaatgccctgtaaatttcagatatttttgtagagatggggttttgctagtattgtccaggctgtcttgaattcctggcctgaggcagtccttccactttggcctcccaaaatgctaggattataggcatgagccactgaacccagcctgtaagtggact

SEQ ID NO: 621618 - DNA, 650 bp, Homo sapiens
  misc_feature (182)..(182): n is a, c, g, or t
gttctagatcgcgagcggccgccctttttttttttggggggatcaataccacagtttattggtaaaccctgttatatgtgttcaatacatcaaatggacaacacttatatagattccatggtattacatattaccactccttaacagaaaaacaactccactgtgttacctcagtttacagnttgtggtatttttaaaactcctttaaatacaaatttgtatttgaaacacttgaacacaaaataaaaaacattgaattggcaagagcaaataaaaaaaaaaaaaaaacaaaaataaaaagagggtggcgccttctctaaagaattatcttcctctcaggaggtgcccccaaattttttttccgcattctccccaggttttctcttttgtgccaccagaggtggtgatccctttatatggagatgttctttatttaaaaaagaacgtaagagacgatatcagtgtgcacccggcgttgagtatttaaaaacaaaccccgtctacacccaagggcggagaaaaaaacactgtggattatactatgtgcgggagacaatcattttggagagaaagagaagaaacccctacataaacatctctatgagagcgttgcggccgacacaatattgtggggcgcaaaaaaccctaca

SEQ ID NO: 621619 - DNA, 275 bp, Homo sapiens
  misc_feature (1)..(1): n is a, c, g, or t
ncccctttccgcacgcgcaaaaacaataatgaagtgttctgtgtgctaacaacatagcttttaaaaaaaaaaaaaaagtaaaacaagggtctccggttttataaaacttgataaaaaatagtatttcaaactgtccagtcaccagaggtccacagttatcaaaaatgccccccctttacttggcatctccagcaccttaagttttttggccctggattgttttggcatctccattttttgcagggtttttcccctctttgccagcatcagctttt

SEQ ID NO: 621620 - DNA, 242 bp, Homo sapiens
gaaccctatttgcctgagtctgtcccacacctggagctgtcacccagtggaggctgcaaaacaacaaagatggctgcctgctccttcctctgggggctccatcccagagaggcactgacctgatgccagccagaatgctcctgtataaagtgtctagcgaccactgttggagggtctcacccagtcacaaggcatgggatcagggacccacttaacgaaggcagtctggctgccccttggga

SEQ ID NO: 621621 - DNA, 132 bp, Homo sapiens
tcgcgagagcttaaatgatcactcaaagagacaagctgaaaatcagtgcaaagacgattacaaaacgacactcaagagttacttagacatatttaaaccccataactgtcctattaaaaaacggaaaacgct

SEQ ID NO: 621622 - DNA, 318 bp, Homo sapiens
tactacaaggctgtcctgggtctggacgcatgaagagtccgcctctaaatcagtcaaacggatttattatctcgatgtccatgttcacggtcatagctattgccagaaggtcgaaaggaacagtgtgacagataaacaggaaagtacagcaggcaatagaaactacctgtgggagggcccagatatccaggttagcataaacttcacaatagccattacaagtatgttcacagaaatcagggaaacaatgattacagaagcgaagactttccagctcagagagtgaagagagctatttgtccaagaactctgaagatg

SEQ ID NO: 621623 - DNA, 118 bp, Homo sapiens
cgcgactatcgagcctgcccggaggacgtccgtgcaactggtctgctgtttaacgacgtctgtgaatgtcgctcttctttgccgtcgcggtgtgtcgacggtgtcgcccagcgatggc

SEQ ID NO: 621624 - DNA, 206 bp, Homo sapiens
ggaccggatacgtgaatggccgacgaaagtgtcgtggaaataaagctagatttacgcctgatgactattatagctgtaaatggattttggcgtaagtctgggtctagggtgtagcctgagaataggggaagtcagtgaatgatgcctcctatgatggtcaattcagctcctattgataggacataggccattcaatgcctccgcgt

SEQ ID NO: 621625 - DNA, 124 bp, Homo sapiens
agctcggaccccaggtgggaggattgcttaagcctaggagtttgagcccagcctggacaacatagcaagacctcgtctctacaaataaaataaaacccaaacttcctaacaatgaggctagtgg

SEQ ID NO: 621626 - DNA, 1413 bp, Homo sapiens
ttgaccccaccgtgtgtaacttttgtgtgccccccagaagttgtcttatacactggtctcacaaacggataccaaaacacccctgggggaaaataaatatagtggcgccccctctttgacgccccctgttagccaccgccctgcccaaaacttttgctgtaaatatcctcccccccgagatgttcttttttcacaccgggagaaaagtttctcccaaggagtgtggtgataaaagtcccccctctcacccctttaattgttgcagaagaaagatagtttcttttaataccccggagaacccggcgggggcccccttaatattgggcccacttggaaaaaggagaggagtttggtgaatgaatacccccaccggaggttgttattgttgccccacatgcccaccaaaattggggccctttcataatatctccaacgagagcgctcactataatcccccacggagaaagattttctcctcgagattggaccccccttgtagaacgcccccaccccttctgtgtaatataatagagaacaccttcgtttttttggggaaaaaaattctttctcccaccgagaaaaaccctcgggtttgtcttccccaaagaaattggggcacagctcctggagaggaagagagaggggtgcctctgtccaccagtgggaagatccccacaaggcccccaacatttctcttttggaaagacaatgtcccacccacgtctgtgctgtagagcccgcctatacacctaatatggcgccacaaaaacctctccactcttattaggtatatgggcaccttttttctcatcccgcgcgctcgtggagaaacacacgcggggttttctgtataagagacttcgcgggaagatgttattatatatatgtttaaaagggaccacacacgagtcctcaccgccacagtctatatattcccacacatctcccccgctttgcacactctctataaaataaaagggaggaagaagctgctctataaaagagatatataaagaataaaaggtatatcccacaaagagaggagaagaaaagaggacaaggaagagaggaaccacccgccacgcccctcgggtgttgtcttctcttggaagaaattatgaagagatgaaatgtgttttagaatagtgtgggagattctccgagaggagaaagaactctgtgagaagaagacccacgccactgtcttcacgtaagcccaaactacctttttgaggcactaagaataaggtaataagtgggtttgcttgaaggtggtaaaggctttgctggagccccgttgcacgcccacaaaggagagtataattgagatttaaaagatactgttaatgatgttaatgatttttttttaaacatcatatattgggattttccccccaaataatgccttttgta

SEQ ID NO: 621627 - DNA, 407 bp, Homo sapiens
ggagccgcgatccccgggaaaaacgttcgacaacatcacgccagtctaaggtgggtgtcctgtgattggcaggagaccggtctaagtacaatacgtgaatgggctgacacttgggggccagaaatgtacaggtgatccgggactcactgctgcaggatggggaatttagcatggatcttcgtaccatgagcaccggtggggcccccaccttcaatgtcactgtcaccaagactgacaagacgctagtcctgctgatgggcaaagaaggtgtccacggtggtaagatcaacaagaaatgttatgaaatggcctcccaacttcggcgttcccagtactgacctcgtctgtcccttccccttcaccgctccccacagctttgcacccctttcctccccatacacacacaa

SEQ ID NO: 621628 - DNA, 181 bp, Homo sapiens
agtcccacacctcacggttcaccatctcagagtctggacagcgtcggcttgtcacttacaccaccacatgctccaccccaatctagtctggccagtaataagtgctctcggctctggggcatggggccttctattggctgctaccaccaggatgcagccgtcgaggggtgcaggtgcctgt

SEQ ID NO: 621629 - DNA, 206 bp, Homo sapiens
  misc_feature (6)..(7): n is a, c, g, or t
  misc_feature (10)..(10): n is a, c, g, or t
  misc_feature (50)..(50): n is a, c, g, or t
  misc_feature (59)..(59): n is a, c, g, or t
  misc_feature (85)..(85): n is a, c, g, or t
  misc_feature (99)..(99): n is a, c, g, or t
  misc_feature (102)..(102): n is a, c, g, or t
  misc_feature (142)..(142): n is a, c, g, or t
  misc_feature (154)..(154): n is a, c, g, or t
  misc_feature (162)..(162): n is a, c, g, or t
  misc_feature (171)..(171): n is a, c, g, or t
  misc_feature (187)..(187): n is a, c, g, or t
  misc_feature (200)..(200): n is a, c, g, or t
  misc_feature (202)..(202): n is a, c, g, or t
tttctnnganagcaattaggttattcacctggtattaaaactatttactnttaaaaaanctgtgacttcatgaagttggattttnaaaggcagcatcanaanaactgaaaaggaagggtaaaaataggcagccttcttcttncacttctttggngctccccnaaacaaggngccatggagaagtggnatcaagcccgggntngccc

SEQ ID NO: 621630 - DNA, 117 bp, Homo sapiens
tccgttgacatctccgccttaccaatctccgcttacaccacatcaccgtttgccaacctcatcaccgtgccaaccacatcccgtcttgccaacccatcaccgtaaccacatcaccgt

SEQ ID NO: 621631 - DNA, 473 bp, Homo sapiens
  misc_feature (230)..(231): n is a, c, g, or t
ttctgaggctagatatgtctggctgaagatttgatgtggtacctccttaagctatgcgtcctgttactaatacggtactgtagctgcgctctgtgtaagtatccttggggtaggacctatatttgtctactgttcctaacattttattttactaccgagaaatctttgatttcattttattctttgtagttctagactctatattcgtagtttagccctatctgtttgcnntgaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgg

SEQ ID NO: 621632 - DNA, 956 bp, Homo sapiens
ccaccctcaaaatggcagccctcatcagtgacttgtcaggcatggcacacgcaaaggtcatattctgtcatagtactaagtaatccctggtactcccaaaagcctcaaagatgggagaaagcaatgcaaaagagagcagagttttagaccacagagaaaccttctcatgactcttggaaccccacaaggaaggcagaagaccccaaaaagggggtgagtggcaccttttcctgtgttcctcaaggagtcgtgttagtctgtgtgttataatgaaataactgagactgggtaatgtttttttgagacagagtttcactcttgttgcccaggctggagtgcaatggtgcgatcttggctcaccgcaaattctgcctcctgagttcaagcgattctcctgcctcagcctcccaggtagctgggattctgcctggctaactttgtatttttttttttagtagagatggagtttctccatgtgggtcaggctggtcttgaactcccgacctcaggtgatctgcccacctcggctcccaaagtgctgagattacaggcatgagccaccgtgcccggcgagactgggtaatttatagagaagaaaggttattggtcatgattctgcaggctgagcagaaagcatcgtgttagcttctgcttctgtgagaccgcaggaagttcccaatcatggcggatggtgaagggaaggccgtgtgtcccctggtgagacagagagacttgagcaaagagacgaggcaggtgcaggtcctttaaacaaccagtcctccgagggactacagaacaggactcctcttaaccataggcggcgcacctctgggaatgccctgaccaaactgcacatccactacgggcctcctggatcaggaccccgataagggcggcaagctaaagaatgtcaacagcacacggagtgacaacccaacggcctcctggacactcac

SEQ ID NO: 621633 - DNA, 716 bp, Homo sapiens
  misc_feature (6)..(6): n is a, c, g, or t
gctcgnttaagcgtagtaccaagacacaaacactgtaggaggcacagggacgctgactaggaaagccaggtattgtccaaggtttctccccatgtgatagtctgaaatatggcctcgtgggaagggaaagacctgaccgtcccccagcccgacacccttaaagggtctgtgctgaggaggattagtataagaggaaggaatgcctctttgcagttgagacaagaggaaggcatctgtctcctgcccgtccctgggcaatggaatgtctcggtataaaacccgattgtatgttccatctactgagatagggaaaaaccgccttaggggtggaggtgggacacgcaggcagcaatactgctttgtaaggcattgagatgtttatgtgtatgtgtatctaaagcacagcacttaattctttaccttgtctatgatgcagagacctttgttcatgtgtttatctgctgaccttctctccactattatcctatgaccctgacacatccccctctccgagaaacacccaagaatgatcaataaatatgaagggaactcagagtccggcagcatcctccatatgctgaacgcaggtactctgggcccccttatttctttctctatactttgtgtctttttcttttccaagtctctcgttccacttaacgagaaacactcacaggtgtggaggggcaaccaccccttcacacaccaagtctccg

SEQ ID NO: 621634 - DNA, 378 bp, Homo sapiens
  misc_feature (109)..(111): n is a, c, g, or t
  misc_feature (114)..(114): n is a, c, g, or t
  misc_feature (119)..(119): n is a, c, g, or t
  misc_feature (121)..(124): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (141)..(142): n is a, c, g, or t
  misc_feature (144)..(144): n is a, c, g, or t
  misc_feature (146)..(150): n is a, c, g, or t
  misc_feature (156)..(160): n is a, c, g, or t
  misc_feature (162)..(163): n is a, c, g, or t
  misc_feature (183)..(183): n is a, c, g, or t
  misc_feature (187)..(187): n is a, c, g, or t
  misc_feature (202)..(202): n is a, c, g, or t
  misc_feature (246)..(246): n is a, c, g, or t
  misc_feature (282)..(282): n is a, c, g, or t
  misc_feature (292)..(292): n is a, c, g, or t
ttcctgaacgaagtggccaagaaggagaagcagctgcggaaaatgctagaaggccccttcagcacgccggtcccttcctgcagagtgtccccctgtacccttgcggcgnnnagntctgngnnnnaaangngnaanctcaanngncnnnnnagaggnnnnntnntagagacgtcgtcgggcccngtgngcgccagtacggggnggcgggcacagcagcggtgagggccagtctgggcagcccctggncctgcagctccacgcagcacttggtggccctgcggncggcgccaanccaagtgcactcaagccccgtgttccccccaatcgcagtatcccaatggctccgcgcccaagcaagcccatgctcccccaagtatg

SEQ ID NO: 621635 - DNA, 339 bp, Homo sapiens
gcttagcccatgctgacacagaatttgggcgcttgtttgttctaatgcgacattactgtaacactggcttaatggttagctggcaggcattcaggaaatggctatcagaagatggacgaattaagttacacgagggtaattgatatcatggtcatgtctatttgctgcgtgagatagcgtgaaaggcagatcatctaccctttactaaagaagagagacagaaaaacgaaatatttcgtagttgctgttcactgcacttgacaaaacgtacagaagagatgaactcagaagagactggtcagttcgctggcaaatgtgaaaaggaagagaattcaaatt

SEQ ID NO: 621636 - DNA, 473 bp, Homo sapiens
ggcacgagggatgctctcagtttaatagtttagggccatgaggcttggagtccagtgacggctgtttttcccgtaaggaaattccacccgcagttggtttcttcttgccttcaactcacccgagcagaaccttgaacttattttttaagccatccagaaaggagccagatttcgctggggtgatactgcttgtcgcctgggtcgctgccgaagtggcctgggtcgctgccggtgtctcctgggcaggtgcaggcgtctcctgggtggcctccgctggagcaggggtttcagcaggggtctcggcaggggtctcggcaggggtctcagcaggggtctcagtaggggtttcttctaccggggcgtcttgggcacagaccagggccccggccagggcagtcaggaagaggagagcgatgagtttcatgctgcgggatgagggtgacacagccacagaatccgcctcgtgccgaatt

SEQ ID NO: 621637 - DNA, 456 bp, Homo sapiens
tcgactatatgtacgtcagtacagaacatgatctagggtgttacactgggctgtcggttaaaagatgaggtcagtgtatgctcacttccccatcaacgtggttatccaggagaatgggtctctttttgaaatccgaaatttctaggcgtgaaaaatatatccgcaggtttcggatgagaccaggtgtagctggttcagttatctcaagcccagaaagatgaattactccttgaaggaaatgagattgagcttgtaacaaattcagcggctttgattcagcaagccacaacagttaaaaacaaggatatcaggaaatcgatgggtggtatctatgtctctgaaagagggaactgttcagcaggctgatgaataagatctaagagttacctggctacagaaagaagatgccagatgacacttaagacctacttgtgtaaactgattgggtaccgagct

SEQ ID NO: 621638 - DNA, 385 bp, Homo sapiens
  misc_feature (246)..(247): n is a, c, g, or t
  misc_feature (249)..(249): n is a, c, g, or t
  misc_feature (303)..(303): n is a, c, g, or t
  misc_feature (319)..(320): n is a, c, g, or t
  misc_feature (332)..(332): n is a, c, g, or t
  misc_feature (334)..(334): n is a, c, g, or t
  misc_feature (339)..(339): n is a, c, g, or t
  misc_feature (358)..(358): n is a, c, g, or t
  misc_feature (365)..(365): n is a, c, g, or t
atggggtatttggctttgtacactttggtgaagacctcatccagggcctccagttccttgtccgtgagatccgtagtgtcatgggtgaggtctgcaggatccaaggacatcttggctacccctctagtggagtccttccccgtcaaggcattgtagggggctcctcgtccataaaactcctttccggaggtgacatcaaacaccactcccttcactgccaagtagatgggctgatcttcctcctcnncnccatagcgggccagctcctcctcggtgaaaagccgcactgggggcccccgctcngcagggcgcggtgtcnncccggccggctntnggcanccccggggccagcgccagnaccaggnccagcgctgccagcgcccgc

SEQ ID NO: 621639 - DNA, 146 bp, Homo sapiens
acccagggctaggggaagaaagaatgggagttattgcttaatgcgtatagagttactgtttggagagatggaaaagttttagaaacagatcgtggtgatggtatgcacaaccctgtgaatgtacttaattaataccactaaactgt

SEQ ID NO: 621640 - DNA, 854 bp, Homo sapiens
gcagtttctaagtcatattaaaaggactatttctctaaaactcaaaaaaaaaaaaaaaactcaagatagtaaaagcacctagggtgatagattatcggttaggtcattggggggtggattcttcagaaaagcagttgatacctagcagcgtaatggatgggcataaatctatgtagtgggcaccttaagatactattgcagtagaatttcatttaggggacatcaccagtaactggactggaccaattggattttcgagagacagtacccaaaccaaatatatatctgcggcaacagtcataaattctccacttgaatgcgctcatgacacaataacggccaaaacaacgagttctggggccacagctcagcccagagggttcctgggggatgggaggcctctctctccccaccccctgatctagagaacgggggtttttctccccagtactcccaagaaattccattcctggaaagcacagtggacgccactttacttccaacagtaccacttgcacgatgttacaaactctccatttactctataccccttccaccgtgcagttttggctgactctcactggtacatgagtggttacgcataaggacataatgcttcttcgatctgaacgacagtgtcccaggtcatggatgactctggatcccttaggaaaatattttctacaaaacagtaggacatctcacttatcccctttgaagatgtctagcagttaacattgggtagaaccagtggaacacaaccctggtattggttctttgaacaggatcacagcggccaaattcagctgaagggcaccaatgctcaatggaaacgtgacatgctacatttgcca

SEQ ID NO: 621641 - DNA, 857 bp, Homo sapiens
  misc_feature (753)..(753): n is a, c, g, or t
ctgagagatcctttcaccgacctctgcttgcctgcgtaataatagacgaactgcatctgcctattaccggagaatgcaccttgagcttgagcatgaccacctatgcatacaacattactgggagtggcagcacaatggataggagactttgaaacgcatgttatggacgtccagcactgtgaaagaaacattgatgaaggggcggagaggcagccactgggtggaaacatgtgtatatatagatgaaatgtcttgaggggggcaagccgggtgcgcggcaaggctggcgggaaggccttcctttgaccgtttgtgcctctgcgccccctctacaagagaagaggattgtagtgcactcactaaataaacaaaaagacaaacaagacaataaggagaaaacccagtgaagccagcccctgatcgtgtctgtacttcgttttcttctgttatttaacggaaggtcggagatcgaggtaagggacaattcttgggcgacaggcgatgtggcatagtctaattaaggatactgacgcaagtgtatgtggtcgcttattttgacgacgttactcggattacccaccacgatgaaaagtcggaggtcactgacgcgcatcgtatacacagctgtaccatcaccgtaatctccacccttgtttccgaatattcaacacatctaagctcattcatgtcggcccataccactgctagatacttgcgaattataataacgtccacgagaaagagactagagcngcacactgtaactagcctgacgattgtatgtgaaggaagacatagctccagtttagcaacgtagatatgatcgaacgcacaataaattagtgtataatatatac

SEQ ID NO: 621642 - DNA, 145 bp, Homo sapiens
aggggggacaatcactggaagtcaggagtacgagacaggccgggccaatcgctggaacccgggaggcagaggtggcagggagccaagatcagtggcatggcactccagcctgggcgagagagcaagactccatctccaaaagaaa

SEQ ID NO: 621643 - DNA, 828 bp, Homo sapiens
  misc_feature (212)..(212): n is a, c, g, or t
  misc_feature (244)..(244): n is a, c, g, or t
  misc_feature (297)..(297): n is a, c, g, or t
  misc_feature (307)..(307): n is a, c, g, or t
  misc_feature (337)..(337): n is a, c, g, or t
  misc_feature (360)..(360): n is a, c, g, or t
  misc_feature (401)..(401): n is a, c, g, or t
  misc_feature (517)..(517): n is a, c, g, or t
  misc_feature (650)..(650): n is a, c, g, or t
  misc_feature (663)..(663): n is a, c, g, or t
  misc_feature (697)..(697): n is a, c, g, or t
  misc_feature (699)..(699): n is a, c, g, or t
  misc_feature (708)..(708): n is a, c, g, or t
  misc_feature (713)..(713): n is a, c, g, or t
  misc_feature (724)..(724): n is a, c, g, or t
  misc_feature (743)..(743): n is a, c, g, or t
  misc_feature (753)..(753): n is a, c, g, or t
  misc_feature (824)..(824): n is a, c, g, or t
cattttatttcaagcacttatgctcatccttgattttaaaaggtctaaaaaaatctaagaacccgggttcctttaaacatgtttacctacttgtggagaaaccaacaggaacaagcaaaccattgtttatttatttacataatgtattttccatggagaactatttggcttaccacttttcataggcctagtacaatttcatagagcacccnaggatttcactgatcaatacctaatggcaccnaaaagtacctatgctttttttcttgttccatgaattcgtgaaagtttgcagancctcccagcnctagaagcagtaatgttttttaccaaaatnagcattttgcttaatggaaaaanaggaaaaaactgaaagcgaagagggcattaagatttgactnaaccaaaattgcctgaaaacgaaaaagtaattaaatcattttgcttgggaatgtagttttcagaaataaactgtaaaaaaaagcaggaaaaaactgtaaaaattttagcaactacnaaaaggctggaaggtgggtttaacagtttattaggattaataagttttattttaaaaacagtggatttaaaccatgtagaaataagtatgcaaaagtatgcaaaacaaaacatactttaaacatgtttaagtngatagattatctnaaattctggatttttcagttacttcattgttatncnatggcagcnaagtnatccttaactncagttggagttagccttcnaaatccagcntcattgcagattccaacttctatgttatcctctgttatttgcccttgaaagctttcctttagggttaaganggct

SEQ ID NO: 621644 - DNA, 399 bp, Homo sapiens
gtttggcgtgaggccaacgtagtggcaggcgtctgtaatcccaggtactcaggaggccgaggcaggagaatcgcttgaacctggggggcggaggttgcagtgaatcaagatcgcaccattgcactccaccatgggcgacaaaagcaagattccgtctcaaaaaaaaaaaacctttaattaaaaaatttacccgggcttgggggtgggcgccttgtatccccagctactagggaaggctgaggcaggaaaatggcttaaccctgggcaggcacagtttgcagtgacccgaaattgtcccagtgcactccagccgtgggcaacccagtgagattctgtctcaaaaaggaaaaaacaggacctattacgaccgattccattagggcagtggggcctcacgcc

SEQ ID NO: 621645 - DNA, 1191 bp, Homo sapiens
  misc_feature (1175)..(1175): n is a, c, g, or t
  misc_feature (1178)..(1178): n is a, c, g, or t
aataaacttcacagcaattacgttggaattcggggcaatttgggaaccaagccccttgttcgggttccggcccaattccttgttgccggcgcaattgcggaatatgcccctgtgattcgggaaccgaaattccccagagttgcccaatttaacattgaagaccagcaacaatttcaaggcaacttgctggaaaactttccggccaatcttctaacttacattgcattctccttgcgcatcatccacctggtgcaccgcttcaacgcccaccacggggacaccaaaggtggcgtacacctttgacgcgggcccccaatgccgtgatcttcaccctggacgaacactgtggctgagtttgtggctgctgtgtggcacggctttcccccaggctcgaaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattngcnggcggcctcgtgc

SEQ ID NO: 621646 - DNA, 199 bp, Homo sapiens
tccactcaccccatcccatcttggcaaagcgctgcttcagctgccctaagctgcaccagcgctttgccaagatgggatggggagggggtatgagaactggcagagcctcggtgcagcagggctgaagggctttctcaccccagctctggctatgcccagttctctgagaaaggagctctgtggggtgggtggagagcgg

SEQ ID NO: 621647 - DNA, 116 bp, Homo sapiens
agctcgtgatccaccctcctgggcctccccgagggctgggattcacaggtgtgacgtcgaccacgccctggccaagcgtgcgcttcttgttattctatccatcctgttctccccat

SEQ ID NO: 621648 - DNA, 801 bp, Homo sapiens
  misc_feature (785)..(785): n is a, c, g, or t
  misc_feature (788)..(788): n is a, c, g, or t
ctgaccaggacccacaggaagggcgggggcacaccgctaccctcctgtgtccggccctacagatgctgggcacaggatgaggcgctgccattcctggtgacctgacatggatttctatccccaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattngcnggcggcctcgtgc

SEQ ID NO: 621649 - DNA, 1461 bp, Homo sapiens
  misc_feature (1461)..(1461): n is a, c, g, or t
gggactagtgctgggtgtgtgagctgcagcgtagtccacaggccccatggatgcaggccctggatgcttactccatgctggcatttggaagccactccatctgtggcacatgctaagctagccatgaatcctctgctcaggcgcacctccgtgatggagtgtgcgtcctccgagatgccgcgacatgcacatgtggtggcgctgagtaggacgtgaggacggatacactattggttcgaagaggtcccacggaagagagacaagcatggaccagcggagcatggactaccaacattcgaggctatggaccattgttaccagggtgcaggatcccagcaatggagccccgagggatcgaacgatgacatccgtggtatccatcttcgaggtgatgagtcagtggagccatcgtcggtcgcatcatcggcatgcggagccggaggcaagcgaaacgggagatccatacattcagctggagctcatcgtactatagacatatgatacagcgagaaccgagagatccagtaggataccccataataaaggggatgcatcagtatgcagaacagagtacaacataggagacacacgcaggacagaaaagcatacaaggaaggttgcacatcccgggaatctgatcatattgaggccagggaaaaggctagacgacaagtaaaaagtccaaggcatagaggttgagcagcactcatgggaagaaagtcataatgaggaagcagagaccaagagtccctgaacgggcaaaacctacgctagaggaccgtggacatgaggatcaagcaaagtggcgtgcaaggcagcacagattgaacaggggaaactacggacaaggtcccgagaaaaaggaaaaaatggcgcagagtgaggaatcaggaatagcatcggttagaatagggatgtggggagcacatttaaagggggtgaaaggagtggggtaacaaaagatatgaagttcaataaaggaatatcacattgagagaatgtctaagatagggatgtgaaataaggtgacggagaggagtaacaaagtgagaggagaggacacaataaggaaggcagatagggaaaggtagctgtgagttggagtgtatggaaggatgaaggataagatgcgggaaagtctagttgagagagggtcgatcagacgcaaccaaggccaaagagcacaagaaccgaccaccgaagagtgacggaaaaagaaagaggaggaacgaaacgaggagacgaagaacggagcacggaacaaagtccacggaggcaaccagagcgcaggaagaagagagagaggagacagaacaggaggacaggagacacgagctagaatgacaaagaggagcggaagagagcagcacgcgcacggaggtcgtgagagaaagctacgaggcactgagagaacacgggtcacatcaacacgttacatcgactagaggtaacgaatgaagn

SEQ ID NO: 621650 - DNA, 560 bp, Homo sapiens
  misc_feature (42)..(42): n is a, c, g, or t
  misc_feature (71)..(71): n is a, c, g, or t
  misc_feature (288)..(288): n is a, c, g, or t
gcctgtatccactactcagaggctgaggcaggagatcgcgtnacccgggcccggtggaggtccagtgaacnagatcgcgcccctcacttcagcctggcggcagagcgaggccccgtctcaaaaaaaaaaaaaagaaaattgtgcaaagcataggtaaatatttttctttattaagcttctcactgagaagccctctttattttggtaaatgtccctctgtttgttaggagatgtttgcttttccctgaaattaaatagggggctaaagccctgaaagaggcaagactncaatgggctgaaacagttggtatagcaaccccaaaaaagtgcttcattttctttttatagtaaaagcagggccatgtcttttgtggtttcctgcacatctttggagtagttatgacttttcagtttttccccccttaaactgcattgcctatttttttttcctgacatgctatcagggatcagtgtgttgaaaacataatgcttgtgtatcaaacttacgttactgtcatccccattaaaaaaattgcagccttgtgccccctgcccttcca

SEQ ID NO: 621651 - DNA, 5482 bp, Homo sapiens
  misc_feature (813)..(814): n is a, c, g, or t
  misc_feature (816)..(817): n is a, c, g, or t
  misc_feature (819)..(819): n is a, c, g, or t
  misc_feature (1864)..(1864): n is a, c, g, or t
tatgcataagaagcagcctcaaaactaacaaaaaagattcgcacattcctcagttagaggaggagcagagatgaagaaaaggagaagaaaagcgctggaaagagaagaaaaggaacctccttctgtgcagcaggctcctggcccagggagtgcggtgtgcggcagagtgcgtgcagggaagcagcctctgaaatcgtgcagggaagcaccctgtgaaatcgtgcagggaagcaccctgtgaaatcgtgcagggaagcaccctgtgaagtcgtgcagggaagcaccctctgaaatcgtgcagggaagcaccctctgaaatcgtgcagggaagcaccctgtgaaatcgtgcagggaagcaccctgtgaagtcgtgcagggaagcaccttctgaaatcgtgcagggaagcaccctctgaaattgtgcagggaagcaccctctgaaatgcctagaaatagctgccgggctttcacttggttcccaaatttcttcaaaggtcaaaaccatcacagtgggcaactttacaccccagtgttcactgtcctcaggccactgcagagccatcctagtggggcagtgggcgcggggcgggggctcctgactccggtgaggtcaccctggaggggagtcccaggaatcagcctgatgttcagaatgccttcctggcatctcagaagtgtactgggggagacgtgaggacctttcagccaagtgtcagcgttcttattgcaggagaacattaaagccacaacccagaaacttctcaggagcatggcgcacccacaccagccccgggctccgcctggacagcaccnncnngnccgccctgaccagcagacaccatccttccagcctctcttggccacccagaccagcgggcaccaccctcccagcctcacgcggccaccctgaccagcaggcaccatccttccagccttgctcagtcaccctgacccagagggctgccctgaccagcgggcaccatcctcccagccccactcagctgccctgaccagcgggcaccatcctcccagcctcactcggccagccgagctctgtaggcctcagagtgcagagaacctcaaatgttgtgactttgctctgctgcagggacctgccatggagtgtcccttgtgcgagcattttgagagctatgccagcatccatccccgcaggtcccatccctgagccatttctcaggagagcaggaagggagcagggagaggggtgctcccagccagccccggaaccagaggtctggggacgcagccgaccagccctccttgtctgggcctctgtttcctcttcgacacagggaagcagggaggggccgatcagcgacttaggcctgttggctgtggtggggtccacctgcgtttctggggagcccacggaccctggggtgtacctgggtttcattcccagtgacctctcctattggtccccatttggggcgctgagatgtgatcgtttctttcctgagaatgagctgaggtaaaaacatgctggggaggaagatgggccctgggggcagcgagctgcgcctctgcaccgggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggnctaacgctgctgtctcgcagtcacccctgcaggccgctcagggcagggctctggcctgacgggggttcctggacacgcctctgagccggcagcccctacccgcacccgtgcaccttccacgcccgtctccagcagcccctgcccgcacccgcacccctgcacctgccacgcctgtctccggcagcccctgcccgcacccgcacccctgcacctgccacgcccgtctccggcagcacctgccacgcccgtctccggcagcacctgccacgcccgtctccggcagcccctgcccgcacccgcacccctgcacctgccacgcccgtctccggcagcccctgcccgcacccgcacccctgcacctgccacgcccgtctccggcagcccctgcccgcgcccgcacctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaagtggattcagcgagggtttttagtgtttgtgcctgtgtccccgtgtgcctgtttcctggtgaggctggacgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgacttgctctgcgtgagtcctcggtccacgtgggccgttgcgctggttcccagcctgcccgacacactcactgcgacgcctcccttgcctactgcttgctggcttctgtgttctctgcagtaaacattgatttctgactcgagtgctgtcttcattgagctctctgcactctggggatgcagtcagcgaccccacgaaggctaccggcttcctcccagggaacagtgcaggtgctgcttcccaggaccacaggaccctggctggtcgctgcctgtgatgggtctccacaagaccactccccattagccagactcacaggagactgacacataaatgagaaagttgttcactaactcacaatgggagcaaccctttgcagtgcggaaatgctctcagcctttctggccccggatacctgggaagctaagggttcattaggtggcctagtgcctgcactcaggatgccccagaggaggccccggggttcctgaacgccttctccaggccctgtcttcagcccttctccaggccctctgagttccaaacagcactcacttttgtctggtcctctgttccccggctcgcacctccttcgtcagggcagttgctctcaaccaggggtacttctgcccctggggcccactcggcaatgtccgggaccgtgttggcggtcacagctgggcgggggcaccaccggaatctggtgtgcagaggcgggggtcctgcccagatgccagaggtgctgcaggtgagagatacagatttagaccctgtgacgacaaagaaaaggacgggaaaggtggctctcaaggccccagggaaccgcccagagacgcctggggttccagaagctggaaaggcatggagcggtgcgggaacaagcctctgcggtggctggagatgtggggatggagactggtcatgccttcacacacttaaccagaaccctcccagctctccctcccctgcaaccaagccagcaaggcgacacggtggctggcgctggcgagaggcaagtgtgcttgactgcctttctccactcttgaggacaacacccagagtggccccgtctttgccccaccagcccaggcctaaagcttcctcatcatccgcatcccggcctgggacttaggcggacttctgccagctgtgtcacgtgcaggggactgcagccactgaccccctctcccttctgtcctgctcttctctaccccacagccccaggcagatcttcagtgcgtgtcagctctcctccctccctccctgcagacccctgtgccccgcagtgccctgagaatgacgtctgagcccccagtggaggtgtcaaggctgttcggtctgtccccatcccgttctgtcctccccttgctcaccacactcccctgcctggtcttccaaactcgaaccccaggcaactccttcagccatcagacctctgcccctgcgcccctcctgcctctctgtgatgggctggcccttcccttctgctgcctcctctccctccttcctgctccaacccctatctctctctgatgctgccccttagagaagccttcttggaccttaagcctggccactcctctaagcccctcatctccaggtgtggtctaggaagtgctctcagcctctctactccagtggctcgggggctctgaccagccctcctgccagggaagctttgaaggttcccacagggacccctagagacaagggcactgcccgtccagatggcaccctcaccccaaccccagcagcactggctggagcaggccatgcctgtgtgggtatctgaacaggcactggattccccgatctcaacaaaagaagcccatggaggccttttctaatccacagtccaagaggacaaatcaagacaacaggctgcgggggctggctgtgggccgactcccacgtcttaggaccaggggctctggggctgtttgggctggaacccctcctcccagcataacaaacactagctcattatttacagtgaatacccaacaaaaccctgctcgaggtgaggagcggggacctgctgctccaacagaccagactggctgctggctccgagctcattaaatcagcaacctttgcactccggctccgagctcattaaatcagcaacccttgcactccctccaaagccctgcccgtcaccttcacacctccctggtgggggaaggggattcttccactctgattacacccgttcccatctcccttcactcctgtgagctggccaggctgaggatttgtccaaagggcctggggagtgagacgctccacagcttctcatgggtcagccgacatggacggtagcttgggtgactcagcttcccgtgatgcgctggatgcacagggagctggtgacaacagcctgtgtgtgtgacagaacagcctgtgcgtgtgacaggacgtcaagaactacatacaaagacacagctgcccccaaaaatgagtctgcacagcctggtgcaatgcagctgcagcctgtcatcgagtcaattgcattgtcgtccgccgctctcctgatgtagttctgtgtttgtccattttgcactgctataaaggaatacctgagactgggtaagttggtgagcgcctgtagtcccagctactcaggacggtgaggcaggagaatagcatgaatccgggaggcggagcttgcagtgagccaagatcgcgccactgcactccagcctgggccacagagcgagactccgtctc

SEQ ID NO: 621652 - DNA, 841 bp, Homo sapiens
  misc_feature (214)..(214): n is a, c, g, or t
ttctttcttttgagatgaggtctcattctgtcacccagactagagggcagtggtgcaatcacagctcaccacagcctcaacctcctgggcctcccaggtagctgcgatcacgggtgtgcaccaacgatgcccagctaatttttttttaatttttaatttgtacagacagggtcttgctgtgttgcccaggctggtctcgaactcctgggctcangtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaagaaaaaacaaacgtggagcagatccagcgcagagggctcatgcctgtaaatcccagacagcttggtggagggcatggcagcgaagggcatggatgtgcttgacggctatggagttcaagaccatgccggggtaacagtggaatagaccctgtctctacaaagaacacaaaaaattatgccaggcgtggtggtgcatgcctgtagtaccagctacttgagaagctgaggcgaggaggactgcttgaagccaggagtttgagaccaggcctgtggcagacataggtgagcaccccggtgtctcacgaacaagttcacgcatttgtctactgttctgtccttaacacgtgggagcccgttcccatattaggagctcttgtttctgaaaccaccggttgagctacgactgtcctttttctttgcgccgaggaaagggggtttcccccttcgttgtacccggcagcgc

SEQ ID NO: 621653 - DNA, 5523 bp, Homo sapiens
  misc_feature (813)..(814): n is a, c, g, or t
  misc_feature (816)..(817): n is a, c, g, or t
  misc_feature (819)..(819): n is a, c, g, or t
  misc_feature (1864)..(1864): n is a, c, g, or t
tatgcataagaagcagcctcaaaactaacaaaaaagattcgcacattcctcagttagaggaggagcagagatgaagaaaaggagaagaaaagcgctggaaagagaagaaaaggaacctccttctgtgcagcaggctcctggcccagggagtgcggtgtgcggcagagtgcgtgcagggaagcagcctctgaaatcgtgcagggaagcaccctgtgaaatcgtgcagggaagcaccctgtgaaatcgtgcagggaagcaccctgtgaagtcgtgcagggaagcaccctctgaaatcgtgcagggaagcaccctctgaaatcgtgcagggaagcaccctgtgaaatcgtgcagggaagcaccctgtgaagtcgtgcagggaagcaccttctgaaatcgtgcagggaagcaccctctgaaattgtgcagggaagcaccctctgaaatgcctagaaatagctgccgggctttcacttggttcccaaatttcttcaaaggtcaaaaccatcacagtgggcaactttacaccccagtgttcactgtcctcaggccactgcagagccatcctagtggggcagtgggcgcggggcgggggctcctgactccggtgaggtcaccctggaggggagtcccaggaatcagcctgatgttcagaatgccttcctggcatctcagaagtgtactgggggagacgtgaggacctttcagccaagtgtcagcgttcttattgcaggagaacattaaagccacaacccagaaacttctcaggagcatggcgcacccacaccagccccgggctccgcctggacagcaccnncnngnccgccctgaccagcagacaccatccttccagcctctcttggccacccagaccagcgggcaccaccctcccagcctcacgcggccaccctgaccagcaggcaccatccttccagccttgctcagtcaccctgacccagagggctgccctgaccagcgggcaccatcctcccagccccactcagctgccctgaccagcgggcaccatcctcccagcctcactcggccagccgagctctgtaggcctcagagtgcagagaacctcaaatgttgtgactttgctctgctgcagggacctgccatggagtgtcccttgtgcgagcattttgagagctatgccagcatccatccccgcaggtcccatccctgagccatttctcaggagagcaggaagggagcagggagaggggtgctcccagccagccccggaaccagaggtctggggacgcagccgaccagccctccttgtctgggcctctgtttcctcttcgacacagggaagcagggaggggccgatcagcgacttaggcctgttggctgtggtggggtccacctgcgtttctggggagcccacggaccctggggtgtacctgggtttcattcccagtgacctctcctattggtccccatttggggcgctgagatgtgatcgtttctttcctgagaatgagctgaggtaaaaacatgctggggaggaagatgggccctgggggcagcgagctgcgcctctgcaccgggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggnctaacgctgctgtctcgcagtcacccctgcaggccgctcagggcagggctctggcctgacgggggttcctggacacgcctctgagccggcagcccctacccgcacccgtgcaccttccacgcccgtctccagcagcccctgcccgcacccgcacccctgcacctgccacgcctgtctccggcagcccctgcccgcacccgcacccctgcacctgccacgcccgtctccggcagcacctgccacgcccgtctccggcagcacctgccacgcccgtctccggcagcccctgcccgcacccgcacccctgcacctgccacgcccgtctccggcagcccctgcccgcacccgcacccctgcacctgccacgcccgtctccggcagcccctgcctgcacccgcacccctcacggctgtctccggcagcccctgcccgcgcccgcacctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaagtggattcagcgagggtttttagtgtttgtgcctgtgtccccgtgtgcctgtttcctggtgaggctggacgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgacttgctctgcgtgagtcctcggtccacgtgggccgttgcgctggttcccagcctgcccgacacactcactgcgacgcctcccttgcctactgcttgctggcttctgtgttctctgcagtaaacattgatttctgactcgagtgctgtcttcattgagctctctgcactctggggatgcagtcagcgaccccacgaaggctaccggcttcctcccagggaacagtgcaggtgctgcttcccaggaccacaggaccctggctggtcgctgcctgtgatgggtctccacaagaccactccccattagccagactcacaggagactgacacataaatgagaaagttgttcactaactcacaatgggagcaaccctttgcagtgcggaaatgctctcagcctttctggccccggatacctgggaagctaagggttcattaggtggcctagtgcctgcactcaggatgccccagaggaggccccggggttcctgaacgccttctccaggccctgtcttcagcccttctccaggccctctgagttccaaacagcactcacttttgtctggtcctctgttccccggctcgcacctccttcgtcagggcagttgctctcaaccaggggtacttctgcccctggggcccactcggcaatgtccgggaccgtgttggcggtcacagctgggcgggggcaccaccggaatctggtgtgcagaggcgggggtcctgcccagatgccagaggtgctgcaggtgagagatacagatttagaccctgtgacgacaaagaaaaggacgggaaaggtggctctcaaggccccagggaaccgcccagagacgcctggggttccagaagctggaaaggcatggagcggtgcgggaacaagcctctgcggtggctggagatgtggggatggagactggtcatgccttcacacacttaaccagaaccctcccagctctccctcccctgcaaccaagccagcaaggcgacacggtggctggcgctggcgagaggcaagtgtgcttgactgcctttctccactcttgaggacaacacccagagtggccccgtctttgccccaccagcccaggcctaaagcttcctcatcatccgcatcccggcctgggacttaggcggacttctgccagctgtgtcacgtgcaggggactgcagccactgaccccctctcccttctgtcctgctcttctctaccccacagccccaggcagatcttcagtgcgtgtcagctctcctccctccctccctgcagacccctgtgccccgcagtgccctgagaatgacgtctgagcccccagtggaggtgtcaaggctgttcggtctgtccccatcccgttctgtcctccccttgctcaccacactcccctgcctggtcttccaaactcgaaccccaggcaactccttcagccatcagacctctgcccctgcgcccctcctgcctctctgtgatgggctggcccttcccttctgctgcctcctctccctccttcctgctccaacccctatctctctctgatgctgccccttagagaagccttcttggaccttaagcctggccactcctctaagcccctcatctccaggtgtggtctaggaagtgctctcagcctctctactccagtggctcgggggctctgaccagccctcctgccagggaagctttgaaggttcccacagggacccctagagacaagggcactgcccgtccagatggcaccctcaccccaaccccagcagcactggctggagcaggccatgcctgtgtgggtatctgaacaggcactggattccccgatctcaacaaaagaagcccatggaggccttttctaatccacagtccaagaggacaaatcaagacaacaggctgcgggggctggctgtgggccgactcccacgtcttaggaccaggggctctggggctgtttgggctggaacccctcctcccagcataacaaacactagctcattatttacagtgaatacccaacaaaaccctgctcgaggtgaggagcggggacctgctgctccaacagaccagactggctgctggctccgagctcattaaatcagcaacctttgcactccggctccgagctcattaaatcagcaacccttgcactccctccaaagccctgcccgtcaccttcacacctccctggtgggggaaggggattcttccactctgattacacccgttcccatctcccttcactcctgtgagctggccaggctgaggatttgtccaaagggcctggggagtgagacgctccacagcttctcatgggtcagccgacatggacggtagcttgggtgactcagcttcccgtgatgcgctggatgcacagggagctggtgacaacagcctgtgtgtgtgacagaacagcctgtgcgtgtgacaggacgtcaagaactacatacaaagacacagctgcccccaaaaatgagtctgcacagcctggtgcaatgcagctgcagcctgtcatcgagtcaattgcattgtcgtccgccgctctcctgatgtagttctgtgtttgtccattttgcactgctataaaggaatacctgagactgggtaagttggtgagcgcctgtagtcccagctactcaggacggtgaggcaggagaatagcatgaatccgggaggcggagcttgcagtgagccaagatcgcgccactgcactccagcctgggccacagagcgagactccgtctc

SEQ ID NO: 621654 - DNA, 861 bp, Homo sapiens
  misc_feature (214)..(214): n is a, c, g, or t
  misc_feature (265)..(265): n is a, c, g, or t
ttctttcttttgagatgaggtctcattctgtcacccagactagagggcagtggtgcaatcacagctcaccacagcctcaacctcctgggcctcccaggtagctgcgatcacgggtgtgcaccaacgatgcccagctaatttttttttaatttttaatttgtacagacagggtcttgctgtgttgcccaggctggtctcgaactcctgggctcangtggtcctcccacctaagcttccccaaatactgggattataggtgtgagcnagggattataggtgtgagccactgtgcccaggcttgcctcagatatttgaaggctgggaaggattttgcaaagctgggaaaaggaaaaggcattcccagcagaggggatagcaggtggaaatacataattaaagaaaaaacaaacgtggagcagatccagcgcagagggctcatgcctgtaaatcccagacagcttggtggagggcatggcagcgaagggcatggatgtgcttgacggctatggagttcaagaccatgccggggtaacagtggaatagaccctgtctctacaaagaacacaaaaaattatgccaggcgtggtggtgcatgcctgtagtaccagctacttgagaagctgaggcgaggaggactgcttgaagccaggagtttgagaccaggcctgtggcagacataggtgagcaccccggtgtctcacgaacaagttcacgcatttgtctactgttctgtccttaacacgtgggagcccgttcccatattaggagctcttgtttctgaaaccaccggttgagctacgactgtcctttttctttgcgccgaggaaagggggtttcccccttcgttgtacccggcagcgc

SEQ ID NO: 621655 - DNA, 530 bp, Homo sapiens
gaacttcgcggacggactcggacgggcatggacgctatatcacctgtactggactgctgtaggcagccctggtcggtgttaaaggcatggaagggctgaagcgagcaaagggattcctacaagaaggatagcgtgggggatacagatcagggaattggtgggatatggaaaagagccgggtaattaaatcagagtctaaggaaccgttattcgatctgtaaggaaccgtgatgagagtgccatgtgactaatagtaaagtcatatgcgtagtggtgttactttcattattaaggagtgaatatcagtggaatgaaaatggagaatcagaaggaggacagtgcgccagtagaagatttgattagcattgggatcagttgattgggaagtatttatatctataagcgggctgagcctatggacttggtcaataaatgtcaggctgaatataatagcagggtttctatttatctgaatggtaaaataaatgtggggccgggggggtttgtaaaagtatgtagaatcatgaaag

SEQ ID NO: 621656 - DNA, 669 bp, Homo sapiens
gggccccctaagatcaacggagaggcccagccgtggctgtgcacattcacagaggggctcaagatccccatgactcctatcatcctctttgtgtgtctccgccaccatccatctgcctcacctcattccaagccgtgagccacaccgtctgaagcggaccagaatggccaggtcccccatggcagccctgatcttagtagcagacaatgcagggggcagtcatgcctcgaaaagatgccaaccaggttcactccatctaccaggaggaatagcagacagtccgcctctccgtcctctatgaaccaaagaaggctgggcccctagtagaggtggggggccagggagctggcaacaccaggaggactggagccagtgcacccttgccagcctcccggactcctctctggcaaccagtgcccctgctgtgctgctagcctctgccacgagcggctgccgtgatacccattttgtgcagtgcccgtccgtcccttcgcacaagttctgcttgcccttgctccagacaatagcctcacatcacgccgggcagctagtggcgcaggtctatggtcccagtggggacacatgcccgtcttgtgggcctccaatgtcccctggtgcctttatgcccggggcaccttgccaccatccttgctgcccgatgtgcccctc

SEQ ID NO: 621657 - DNA, 194 bp, Homo sapiens
attgcatagatacttagcgagtgactaacaaaagcattattacaccatttctacatccaaccagctattgctttgcagtgtcttggtgatacgttcgaataggaggtcatattcaattggttagatccttggagagatagtagtatttgctgttagagtacaagactgcatcggtctctgtgcccgtatcatgt

SEQ ID NO: 621658 - DNA, 311 bp, Homo sapiens
gggtagcacaactagggtcagtttgcaggtgtaagcatttacaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgagcccgcaggttgtttgtgattagctgtctctaacaattgttcatacaataattgttcattattgttctcaacttggggctctccccaacctggggacccttcctta

SEQ ID NO: 621659 - DNA, 543 bp, Homo sapiens
ggtcacacaactctgctgtatcagagggggcctcgcgcgcgcccacacgccctgcgcatcgcactccgcgtgcgcttggggcctcctccttcacgccccttcacactctacacgtctagcctctgtcctggagaagaagctatagtcgtctcccttgtgggcccggtgcgcagcatggcggacggcggcggcgggcgggggaactggcagcggtgggcggggcaggaactagccaggctctgccggggcagcgactggcgctactgggccagcgggggcggatggccccatcaaacccggcttagatgcctcccgggagaaccagcagtcatcgctcacatcgggggagcagctcaagaagccggggcctcataggacagctaccgcacgggacgtgcctggccagacgtggcacaccaagccagcgttaccaaaactgaggcagacaagtggataattatagtgtcaacacatctggacaagcaggaatggaatcctaccgatgagcaaaacacagatgcgaaacggtctgaggcagagtgt

SEQ ID NO: 621660 - DNA, 107 bp, Homo sapiens
agaaatgttgagccgtatatccgtcgtgactggtaaagctgctgtcgaagtactctgaggcttgtaggagggtaaaatagagacccagtaaaattgtaataagcagt

SEQ ID NO: 621661 - DNA, 828 bp, Homo sapiens
tgacatttcggtatctttcatctgaccatccatatccaatgtgctcatttaaacattacccagcatcattgttcataatcagaaactctggtccttctgtctggtgcgcacttaaagtcttcttgtgccataatgcagcagctatggagggaggatgtgatggagaaatggggatagctcttcatgaccacgcacataagactacaaggaacatactaagctgcatctgtgggtttagcaaagggttattatacttcttaacaattctttttgccaggactttgtctacgctgtatgactgttacttgaccttctttgtacaatgcattcccaaaatgctctattttagatagattgaacgattaatccaaccataatttcttattgtagatcgagtcaggcatgacatgttgtctaagtcagacctctagtacgtggtttcatgctctttcacctgcatttaatttggtgttgtctgaccgaaaggaaagaggacaagcagcttgacgatagttgtactattgtgttaccaaaatactttggggatacatctggcaagataatttcacgtgtggtgtattattcacatagaatcctcttacattttggtgccctaggttcgcaggtctatgcgatacgttggacttctgatgaccatatatgccgctcttcgcaaagtgaatttggttgcactgatagtgacgagcactctgtcattctttcctctgtgaggatgtcagctgtgcatgcccagaggtacctgctggcatcccacctgacgggggtgtacccttctttccagggtcaggcttctttctgaattcccaa

SEQ ID NO: 621662 - DNA, 405 bp, Homo sapiens
gtccagattgtgttgataataatatccaccttttactctttgcttcacccacttgctgttattatctggggctgttagtcttttcttcttggcttcagcatgatcactgtgctaagtttcaccacactcagggatgactccatacaagccaacatcaggggagcgaagggcactcagtgttttgccaacatcaccactttctactgcctcattaatggcaaagattcctaaggcaaacttctgtgcttcttgggtgtctttgttggactgccagattccaccttgaatttcatccaaccataacacagctgactcatcctggatttcctgggctttctctctcttcgctctaatcagcgtgtcttggtaatgctggaccacttctgcaaggactcgctcaaggtt

SEQ ID NO: 621663 - DNA, 637 bp, Homo sapiens
tcaatattttattatggcacacaggattgaatatggaactgtgttcttcaatcaagtatttataaaccaaccagatgttggcattcactcatgactgacatgtgtgaaaagcttgcagacaaggaacttcctatctacaaaggaatgccaagagccttcatagttcaaactcacatcatgataaagaaatgcttggcctattggtgtagtaacatattcaagtagaggtaagtgaaacaaagagacttcaatggcagatcacttcagttttagataaaatttctaagtctaaaaaacaggtagtgaagaaatcaacaaaccaagcagttcctaggaacatcagagccgcagaagtacaacagagctgtagataggcaaagacgtcatctatattccacaccaaacacaagtagtgcaagcttggtcggggctttaccagggatgtggatggatgggggaaagatgatgtagtgtccaaccaggcatagaaatccaaatagttaccaattaagacatgcagagcaataccaatgcagcacgcaaatttattctctcccccaagaagtgacagtaatgtaatcccattatctgctgtgtggtcttaaagggctttaatgtttagcatcaaagcatttgt

SEQ ID NO: 621664 - DNA, 114 bp, Homo sapiens
ctggacaagatcaccgtaccggctcgctgatgccgcagtacccaggttgtgacccagaccgcggtcatgaccatcagcgctgaagccatccatgtcgcgcggtttctacagcgt

SEQ ID NO: 621665 - DNA, 787 bp, Homo sapiens
ttggtcttcatgatagatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgacttttgaaagagactgtcacctatcaccaagtggtgagactattgccaagcagtgagatatttgccaagtgggtgaagaaccatcaccaaagcgggtgagactattcactaattggccaaggttgggcctgatttcaggcagggaagccattctcagaacaccaaaccataatgctggtcaagcaggttggccgggggctaacaagggctggttttcattcccctgtgctaggcctttcctgtgaaggattgagcagcaccggggataaggacagagaaggggcgttccttggctaaccggggttagccgtgggtcacgggggtcccaccaagtgggatcgagctttgccatcgcccgacgtctggccgggacggggcccacgtggtccatcagcagccggaagcagcagaacgtggaccgggcatggccaagctgcaggggggagggggctgagtgtggcggggcattggtgtgcccacgtgtggcaaagggtgagagacaggggagcaacctggtgtgccaaggcctggaagcacg

SEQ ID NO: 621666 - DNA, 843 bp, Homo sapiens
  misc_feature (79)..(79): n is a, c, g, or t
  misc_feature (88)..(88): n is a, c, g, or t
  misc_feature (658)..(658): n is a, c, g, or t
  misc_feature (711)..(711): n is a, c, g, or t
  misc_feature (720)..(720): n is a, c, g, or t
  misc_feature (723)..(724): n is a, c, g, or t
  misc_feature (731)..(731): n is a, c, g, or t
  misc_feature (739)..(742): n is a, c, g, or t
  misc_feature (744)..(744): n is a, c, g, or t
  misc_feature (747)..(747): n is a, c, g, or t
  misc_feature (749)..(749): n is a, c, g, or t
gcaatagtaaggacagtgcaggttcttggcacagccagtgtcaggacagtgtcagggcagggccaaggcagggtctggnccatgatangactcagcaacagggctggggctaggccagtgacaggaccagagtcagggcaagggccagagcagtgcaaggccagggtagggccaggcatttcagggtcagggccaggggagaaccagggcaaggtctgaagcagggaagggccagggccaggacaggtccagggcagggccatgacacggccaggggctgcgttagggcaagggcagggccagagcaaggttagggtcagggccaaggccagggtagggacagggcaagaaatatggcaggaccaggggcaatgccaaggccaaggctgggccagggctgagccagggctgagtcagggcagggcaaggcagggcatggtatggccagtgcaggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactggacagggcagagcagggcaaggngatggtagcggcagggcagggacaggccaatgcagagccatgtcatgccgggncaggacacntcnnatccacntcaggccnnnngntangncaggacaaagaccagggccaggatcaggccaggtctgtgctaggccagctgcagatgagggtctagcgaagactagggtgaagacctattccac

SEQ ID NO: 621667 - DNA, 3838 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattct

SEQ ID NO: 621668 - DNA, 692 bp, Homo sapiens
  misc_feature (649)..(649): n is a, c, g, or t
  misc_feature (651)..(651): n is a, c, g, or t
atttttgtatttttagtagagagaaggtttcgccatgttggctaggctggtctcgaactcctgacctcaggtgatctacccgcctgggcctctcaaaatgctagaattacaggcatgaggtactgcacccggccttacatttctattcttaaagtactttggtgataatgattctccttctttgcttttccagtatgacatgatgggaagaaatcagactgctgtgagagaagagatgattctcctggcaaactacttggatagtgtaagttgtattttctatcaaccaggatgattctgtcctattctttcagtcccagaacagaacttaaaaatgtctcattttgagttctgcttttcatagggcctcaatgacttagtctttcagaggtctgctttctggtttgttttgtaactctttttaatgtttaaaggaaagtaccagtgtagaaagactgagaagagcaagagatttcatattagcatctactttatcttcagagttgctaggcttaggtgctttggcatttatggaaagatctttgaatttttgtcgaatgcatcttattttgaataaggctgccttctaccctgaaaacatgatatgacaatatttgtgtgtgtgtgtgtgtgtgtgtgtgtgtgtgananagagggaaggatcgtagaagggaaggatgggtgccgagctc

SEQ ID NO: 621669 - DNA, 491 bp, Homo sapiens
cagtacagggggggccgggttatcggggcggggtgagagggtcaggcagccatacttgactccacacttcctttgcggccagactcttcgaatccggtcatttttctggtatagaaagcccattttctcggacccaaagggtttgtggcctgggggctgggtggatgctggagccacatcctgagtcctcccggctcaggtgtccctctctgctctcaagctggcagtgtccctcggagggagtcccggagcggggacagcttcggtagctcgtcctccggggccttgatggatgtgcatgtacggaggccgccagtttctcgaggaaggggaccaggctcggggcagccttccagccatctgggaaaaagtggtgcggggcgtgaaagagctggatgaggctctgacggaagtcaggaccttgcttcatcgggctctccctggttttgagcagatactcacacatgtgcagctggaagatgcgccgatct

SEQ ID NO: 621670 - DNA, 452 bp, Homo sapiens
aagaagcatagtatatccaatttaattaacgcacacagtgccacagacgaggcagggttagcagccaatacaggcctatgtatcaaattcttatcctctgttgctggctgtaacctggggaaatctaagcttaagttttcttctctgccgaatatctacctgctaaatggttgtaagggatttacgaaaattgcttgcaaagcacttaagtcagggcaatgtagacagcaggtacataatgagataaacttgaaatacagagttcaaatcattatgatttcaactgtactgcagccacaaagcacccagtgagaacgttattaaaatcaggggtgaacatacttaatacacctgataggagttacggcctgaacgtttatgtctccctaaatagctgaagaactaactgcagcatgtctgtatttgaagatggggcctctacagaagtcatt

SEQ ID NO: 621671 - DNA, 818 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacaggtaatgtatttttctcttgatcccatagcaaattttaaaacaattataatttacaaatgagttctgtttaggcactcaggactgttacattgcacagccccacagggtacctttaacattataacatatgggttatcttgggacaagtgggtgcatttctatagactaagctgtaccttacagctctccaggtactcagtagttaaggttgcctcttaaagactaggacagtaagtcttctatttaatggtaatccttactgatgagaaacttcgatatgtcttgaaaataggacgttctgatgtctggttgaacagtagtatctctacaagtgcccttattgcaccccatttaattggtcagtgatatttagtataggaacaaactccttcattgactgttatgtg

SEQ ID NO: 621672 - DNA, 115 bp, Homo sapiens
tgtgaagtggtacagtgaagctaattggatacagaaacaggtctcacaagaatctttgcttatctaagtgcaacatggaacccaggaacaagacctgtaataagaaagaaagaag

SEQ ID NO: 621673 - DNA, 554 bp, Homo sapiens
taccggggtctcggttgaatgggacggtcggtaagacgacgggcactgcgtatcgaccgggacctttcactaattcggcaaccgccacaggccgagacaaatgatcattgcggacacagacacagccacaacagtccagcagcagagcacccagcaccagaagtccccagatgtatggtggtaactggactcacgacctgacaggctgaccgaattcttcctctccgacatttggggctgaggagtcagtacctatgaattacgactagactacaatgcacaaagcgcgtagtcctgtgaattttagctcagtcaagctaagagttgaactgctttttaccaactccttaaaggggtgggttattgtttagttttaaacctatttaccttcagattctgcatctattagaaaggcaatcaaagaaagaaggcatcacctaggtgcccaggtagaatttcttgtccagtctacagtatcttagtttttgactttctgctagttctttcacctaagaaatattttgaatcacatttgaaaccagcattcccaaagg

SEQ ID NO: 621674 - DNA, 3281 bp, Homo sapiens
atttttgtatttttagtagagagaaggtttcgccatgttggctaggctggtctcgaactcctgacctcaggtgatctacccgcctgggcctctcaaaatgctagaattacaggcatgaggtactgcacccggccttacatttctattcttaaagtactttggtgataatgattctccttctttgcttttccagtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattct

SEQ ID NO: 621675 - DNA, 4096 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttattttaacaatcaagtatacatattaaaaattgtgagcaatctc

SEQ ID NO: 621676 - DNA, 258 bp, Homo sapiens
ggacgcctcgcgacgccatctccgacactccggattcagagggatctgaaaccagactcactttcgatcaggcgagagagaaacggaggccatcgcccgtcccttcggaacggcgctcgaccatctctcaggaccgaatgacccatgtacaactgctgttcacatggaacccttctccacttcggacttcaaagttctcgtttgaatattatgctactaccaccaagatcgagaagctgtggaggacggagacactgt

SEQ ID NO: 621677 - DNA, 3861 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaagctgtcactgaaatttcatgctccattctgagcactatgcttcaagaggcagtgaggcaaactggaacatatttaggagggagcgtccttgttgcatgaaaagtgattgtaggatagtgacctggtgaagaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattct

SEQ ID NO: 621678 - DNA, 154 bp, Homo sapiens
gccttttgtcgcgtagggacggcagtatgatgaactgcaactaacgtcagttctgtgtcaacttggcatggggctacagctctgtactcagtcaaactctaatgtagcgtgggtatgtgcaaggtgttttgtaggtagtgattaacagcttata

SEQ ID NO: 621679 - DNA, 3691 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttccaatgatttgtactgccagatatgctattgaaacttctcaaactaggggtac

SEQ ID NO: 621680 - DNA, 1518 bp, Homo sapiens
  misc_feature (43)..(43): n is a, c, g, or t
tataaaccaatatatagtcgttcaaatcaagtagaaaaaaagnccgcacactctgcacgtcatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattct

SEQ ID NO: 621681 - DNA, 1464 bp, Homo sapiens
tggcggtcataagcggatgaaactcccccaccaacacaagccttttccttttccagaacgcctaatctactccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattct

SEQ ID NO: 621682 - DNA, 2734 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagatcacccttcgtgcacagatcacccttcgtgtcagtaacacacagatcaccctaca

SEQ ID NO: 621683 - DNA, 869 bp, Homo sapiens
atatttacacagtcgactctattaaataaccgaaaacaaaagaacccttactggacaccacatttcttttagatatcctgaacatgacccagactactgtgcgtgggtcccacctcgacgtcacaggggggatggcagaacccatcttaatgacaagtatggctattgattgcttcacaatcccaaaagaaaaccttgcggaccatgtgacatggaatatttcggataatgtatcaaactgcatggccagagaagtctagatgattattcccaagatctaggagagtgggttttccctcctgcgctctcggccacctaaatttatctgcccatatgagtctcccgcattcgccatttactctcaaaactgcctatacatatatgtcacacggtaaccatatgtccccacactcccccacttgatatacattatactatccccatttgatcgccatcttcaaaacccactggctctcttccactccgcccgagatgtctccctgacgccccccttcacacgagcaaaaaatccaatacctttatccacatgagtcgacaaaaatcccacacccccgaaatatccacccaaaccatctccttcacccccagaccaccaaaacgctcaccgcatatccatcccggccgctacccgctaaatcaaccactcgcccaaatgccttatcccacccataacacctcctaacctcccacctgaagtccatccccaacgccaatgtgctggcccgctccatcgcagacctcatgacaaataatgccgcttagccgtccagaggactcgaatccacagaagaatcatccataccatccaaatttctcctcatagcctccctgcctacatcccgcatctg

SEQ ID NO: 621684 - DNA, 276 bp, Homo sapiens
aacttgggcccccccagttgtaaaaaggtaggtttttccccgcccgttaaccccccgggagcctgtcaagttgagaagagggaacccaaaactgggatttgttttaaaaattaaattaacccctgataaggggggctttttttttttaggggttagcccttgccccctagtttgagcccctcccccttttgggggccctgtttcccccccgggcctgttcctccccatgcctaacgggggaagggcttaaaatggaataaattgcttttttccata

SEQ ID NO: 621685 - DNA, 557 bp, Homo sapiens
taaaaccaaaaccccctaggttaaaaagacccgggggaaggtttattgccccagggggggggggttaaaaagggggtttaggggggcaaaaggggggccccaaaaaggggtttttaaccaaaaaagctatggggaaagccaggcaaaaaaaggggggggcccaggggtttgaaagttctggggccaggaaagggagtagaaaaagggttagggggcccagggggttgggaagggaaaacagggccaaaaggtggggaagggggcccaccaggggggaaaaaaggaagattgggcccgggtaaaagggttttgggggggcccccaaacgggggaaaaaagccaagggggggaaaaagggggcctccaaaaaaaaaaaaagaatgatgggggaaacacttaaaaggttttggggacccgacgtaaaaacgcaaaaaggggaaaagagagttcccgtggagaaaatggtttcccccaacaatttcacccaaaaaaaaggacccggaggaaaaagagggaaaacccggggggcccaaaaagggggccacacccaattgggg

SEQ ID NO: 621686 - DNA, 851 bp, Homo sapiens
ttcaatatgcctgttgcgctgtcagtgagccagtcatgctactctttatgccaacaactactgactcttcatcgagcaaccgctgctgcgtgagtcttgccctgatgttgttaccttcttataggcgagcacaaatggcgttgattaacttatttatactagccaattggtaatctgaccacttcagtgtactttagtcctctccgtaatgacgttaccatctcagtccaacccttaatcccgaaatcctacgccctagtagtactacttatgggtgccatagcctaatcacggtaacgttgttataaacgctcgacgttcatagtgcgcccactgattgaagctcccttgcggaccggttaacttgcacgcggtctatcagcgatcccgtaaaggagttccacatctaacggcatagcgtgtgaaccctccagtgtataacctatagctatgtctaccaaaataaatgttgtaccgtcgaatttgtggatcaccagcaaggccttagctgtcggctcctacgtattacatggcacatgaacctcgttggatgataaagtcctgaaaaacccttatattaatattagctcgatacttttcaccctcacttgttgtcctgtttactatcatgcgctacgatctacgtggttagacattaggcgtgtacatgttaccgcaattattggcacctcacgaccgcgagatgtagtccttcgctgaagctattatttccctcgcacacttaaggttattacccaccggtgtaacgtccatagaaatccgttcttctgtctgttggtcccaacacatcgcgggaaggaattcctaagcaggtcgtggaagacttcggc

SEQ ID NO: 621687 - DNA, 182 bp, Homo sapiens
ttgctctttatgggtcttcgcgcttttggggcttttgcggggggctttttgcttgtcccttttgatcgccgcgatttataggtgggaactcactggaacggggttgcttgcattgtgtaatcttactaagagctaatagaaaggctaggaccaaacctatagcaaagaccccaaatgggtta

SEQ ID NO: 621688 - DNA, 152 bp, Homo sapiens
gaggtacatgacatgaccctatcttccccatagtgctactactctatagaaaatccaatatgaaatgacaaagagtacatgtacacagaataagaactacatcatatcataaatgtacaacatacaatatcagatgaactatgtcatacatc

SEQ ID NO: 621689 - DNA, 976 bp, Homo sapiens
  misc_feature (234)..(234): n is a, c, g, or t
  misc_feature (376)..(376): n is a, c, g, or t
ggccaaccgttgttacagcccctagctggattcctagacctgattgctagtatgctgctccatcagtgcacttttctcagggaccctaaacaatacacgtcagccagcttgctatccacaagggatggttgatccagtgtgatatattgcttcttcctctggctcatacgagcgatataagaagaaatacaacaagatggtgctgtggatgttcctaggaagccactcctcttnaggactttgactgaccgaagctatattttgcaagactcgagatagaaaaggacgaattctgcgatacgcttggaattggtagggatggactacattgttaccctggaaacaattcatggttacgatcgcatgctctcatggnttttaaccaccctagtctcggccctcagtaattttctcaagtggaaaaggagcatgctatcggtcggggaccttatagaagttgccctatcgtttaggatagggccagcatgtatagaattaactgtccagtgttacttgcccgtgtgcatgtaaggactttgcaacaatgactctcacaacccctgggctcttacagaccaggtagatgccacgcataagctcgcgaagggcacaagccgagcacacaagtccattccgacaaccgtttgacatggcatcgtgtagcgtattaaagacatgtacctcgacataggattgaaggtcatccaattggcctctttgactgatagaatagcatcgaaacttagccatttggcttgccaagtagggaaatatggagggcttaaatggtgtgcaaccgtaagtgacgcattaaaggaaaggggcttcttgcaccaattggtcaatcatttcaacagaattgaatttcttcatttttaacacctttttggaaccatttatggggtggattcatggctggagggagacatggggactttttaacaataagaatttactattaattaacgttagatat

SEQ ID NO: 621690 - DNA, 415 bp, Homo sapiens
atatattggggagagaggtataatggggagacgatataacatgaggaatacagatttgtgggactgggtttgaatactgccttgatgatgaagaggagctagatgtgaagagctggctggaggctgtgtaatgagcataggagaaatgctacgatcttttctcacaaaactggagtggttttctacctagatttccaagaattccagttccagttcaacaacgaatattgatcaacagattaaaccccgacctagaaaaactcaagaaagatgggacaggaaggtgctgaggaaactagacagacctgttgaacgcagccgttcaaggtctccaaggagatctctgagtccacggaggtccccaagaaggtcaacgaagtagaagtcctcatcgggagggccatgggtcttctag

SEQ ID NO: 621691 - DNA, 738 bp, Homo sapiens
tggctaccggtgactaaaatggaagcgttttgggggtcgcggcccggactctgggcggggggctccggccccaggacagttttaccgcatcccgcccactcccgatcccttcatggtcccggcgtctgcactttacagaggtccaatcacgcggacccaaaaccccagtggtgaccggaacctcagctcctcggcgtaaagtaccgagggcggagttggtgattgccgcagacatgctggaactcctacggcccccttggctcgttcccgcaacatctctcgcattatgcgagttcaacaacatgtcccatggctgggtgtgcgcctctgggaagatctaaccgctggtattccccatgtatatttgagaaagcaatgttctccgcgccaaaatgggtggatctgagatgagaagagagctattctgggggaatatgggacaacagcttataaggcccctaaagagctattcacattcccatggggtggaccaagggccatgtacagccggcagctcgaagattgaacccttaggtggacccacccatggtcatacggaagctatgctagaatggagaagagctcccctcggtaatgtggacattgcttagcgtgtagcccaaaaaaagccccttcgttggcccatggtatatggggcatcacttggtcacctctgtggcgaaaagcccggaaaccaccaggtaacaaacgaagccccaataataaacccgctgcatc

SEQ ID NO: 621692 - DNA, 280 bp, Homo sapiens
tgacagacgtgtgcactgtcatcggaccaggaaaacgtagccgagggcgttttgattgtgtgtcaagggtggcacaggtgcattttcatcggcacatgggcaggtgcattcctcagggggttgtttgcatcccgtttcgtgcaagaatcagcaggtggagtgctgctcagggctgcacataatgcaagggcaagcatgcaagtgcaaaggtacagaatcgtgtgagggtgggactgtctactgagtagcctcctcagattcattgcaacacggtctctca

SEQ ID NO: 621693 - DNA, 157 bp, Homo sapiens
tgaatctggaaatgtttttcattattgtaaagaataattttcctgctgttaacactgaggcatactgaaacatacatagaagtttaaatcattgcctatgttattctttgaattatatatgccctaactgaacttaagtgagggtgtgtgctcaaat

SEQ ID NO: 621694 - DNA, 115 bp, Homo sapiens
ggccgccttgttgactgggggacttacacttgcttcttggtgggaagcagaagaagacagaccctttccccaccttccttacctcctcttcccccattagggcgctgtagggtgt

SEQ ID NO: 621695 - DNA, 111 bp, Homo sapiens
ggcacccccccccagttctgcgaccaacagattaaattggtccagagtaaccagctctggagtaggagttaccggagtgggagctagaggcagagcctaaggcatagtctg

SEQ ID NO: 621696 - DNA, 317 bp, Homo sapiens
ggaccccaatggagatgaaggtggctgtctggtagtctcagtgtcgtagcttgcgccgagacacgaagcgtacccatcagcatgacagggatcacctatataggccttgggcagcatctgggtgtggaagctgacgaacttaagggcttcgtattggtcaccagcgtgctaagcacattggacatgctgggaaaggagtaccggtacgtgggtgccccattgccggggctgcttgcagtaggaacagaggagaggccatgcagaatcagtgccagcactcggttcattagcaccaggaactgtctcaaggtaaagca

SEQ ID NO: 621697 - DNA, 350 bp, Homo sapiens
  misc_feature (208)..(208): n is a, c, g, or t
  misc_feature (291)..(291): n is a, c, g, or t
atttccagatcattttatttccctcattcctagtatggctttgactcaacaaaccctaaaatttgtttcaaaattaatctcagactgatattacatgtctgaaggctttgtaacaagaggggcgtgtgctttcctaagccacaacatactctgaaactttaagaattcaagggcggaaggggaggtttctctctcctttccctttcanagcttctgggtgcttcccaagaattctgatacaaagtggtattaccccacccccagttaagaggagtgctctgagggggtcanttcttccaaattatatctagggctttcacttctcttttttatctcctttacatctgggc

SEQ ID NO: 621698 - DNA, 279 bp, Homo sapiens
ggaggtcgaggctgcagtgagttgtgatcacaccactgcacttcagcctgagcaataggctgtctctttaaagaacaaaaaaagacaaagttctgatttttccatagtgaaatgcctcagctagaaacatcaacacgactgattgctactacttcaataattctgccacttttcatcttgttccaatgaaatatttcaaagtttgccccttacccgggcacacctgccacagcccaccctggtgcccatgccagccctccaccgcccctcgatgaccct

SEQ ID NO: 621699 - DNA, 404 bp, Homo sapiens
gcccgtagcagtgtctacacaatctgagatatcgtagttccaacggccagtgagaaaataatttataaaaataaagcaatggtataccagatgatagaaaaaaaacataactttcagaaatagtatgtatcattccaatgctagctccttcttgggagtacttctctgcaggagtagtatgctatgtacaacactgactgtattaggtactacagaagctttaagtaagttagacacttaaactctttccgcctggatccaaccaattctttactcagtcacacaacaaatgaggtaatatttgtatgtaagtaacacctatctgtcagtttatttctcttttcggaagaatgaatagaaaaaagtgtatatgcttgccttctccctggaaatatgcacgcggg

SEQ ID NO: 621700 - DNA, 464 bp, Homo sapiens
  misc_feature (26)..(27): n is a, c, g, or t
  misc_feature (102)..(102): n is a, c, g, or t
  misc_feature (107)..(108): n is a, c, g, or t
  misc_feature (180)..(180): n is a, c, g, or t
  misc_feature (240)..(240): n is a, c, g, or t
  misc_feature (255)..(255): n is a, c, g, or t
  misc_feature (341)..(341): n is a, c, g, or t
  misc_feature (346)..(346): n is a, c, g, or t
aaaaacaaacacacgaagggggacanngcaccaaaaagaaccaaaaagatgaaaaaaaccagccatcaaacaaagcggcaagagacggggaagaacgacaanccccnngagagctggagcgaccccgacaagcgaaagggagccaggagccgggagacagtgaccggaagcggaaccccngcagaaggacccccagaaccggcggaaggtcaagcacgccctcccccccgggcggcagancgaagccacgttcgncaggttctgagcccttcagggcccaaggggcccccccccgcggaagaacggcccagccacgggttttaaacccacctgtggccccngaggncgtcacaaaaccaacagtcacaaacccaagggcaaaaaaggcactgacgaaagctggcgcgcgcgacgccacacaccattttcagaagccgttgcaattaaatcttgccacactgtca

SEQ ID NO: 621701 - DNA, 502 bp, Homo sapiens
  misc_feature (149)..(149): n is a, c, g, or t
gtaaaggtcactacaggctgaaactcctgggctgaacgcaatcctcctgcctcagcctcttgagtagctgggaccacaggcacatgccacacacctggctaattttaaattttttgtagaggcaggctctccctatgttcccaggctgntcttgaactcctggcctcaagttatcctcccaccttgagctcccaaagtgctgctgagattagaggcatgaaccacagtgcctgaccttcatttctttttatggtgaaatattatttggttgtacgatatgccacattttatttacctacacttcatttgatgggcatttggattgtttacacttttgggctatagtaagtaatatagtacacaagttatgaatatgaacatttgtacacaagttttttggtgttgtatgttttcctttctcttgggtatgtatcccagagtggaattgctgggtcatatgggtaactctatgcttattattttgaagaactgccaaactgtt

SEQ ID NO: 621702 - DNA, 615 bp, Homo sapiens
gtggtctgaacaccgctagattgggtaaataatggttggtgtgttggaaaaagattaaatatcataatgtgccatgtgatcggaccaaggggagattgtgggggaggctattgctggctttgacagagtcttatacaaaagataaccaggggctgttcagcttcacttacaaacttgtgagatgctgactgcacggggataaaccaagactatgtcacagatgcatgtgtgggcgagtcacaacttacagagatagtttgggtctactctcactgattaagggctggatcgtgccagtcagtcatcggacctcatcgatgattctatgatcctccacaacatactgcataacgggcaccgcgtgatcctcacaacggcacgtggcgcaacgccatcactgcgcatgaacccaccccggctgcaacctgcggcctcgcccgcgcatcctcccactgccacccacaggtccccacgctgccataggtgccaacgccttcattgaccacagggtccttccgaaccatgtcacccctgtacaccggtgcacggacaactatcgtccggcaggttacagcacagaccgcgggcgcctgcaccagccgctctgacgccgtt

SEQ ID NO: 621703 - DNA, 377 bp, Homo sapiens
ctgatgctgctcatgagtggctcgtcgaaggacttgacgatgacagatactgctgccctcttcgcctcatgaagtatataggtggtgaccggtcgggttagaataatgagcggttattgctgactcccaggcttgaggtccctggtctgtagtgcgatgtgctattggcatggtgttgagggaagagctctctttctctttcccagcacaagcctgcccccatgtcacccagtagctggagtcttgctccttttctgcaatggccccacttcctggttgttgttgctgttgttgttgttgttgtttgagatagagtctcgctttgttgcccacgttggagtgcagtgggctgatctccgctcactgcaatctctgcc

SEQ ID NO: 621704 - DNA, 422 bp, Homo sapiens
  misc_feature (68)..(68): n is a, c, g, or t
  misc_feature (175)..(176): n is a, c, g, or t
  misc_feature (278)..(278): n is a, c, g, or t
caccccgccacaccgaggcccgagttcacctctgtcatccgggcagggtcctgaagcaggatccggtngcgcatgtggcctggcgcatcccgggaccccccgcccaccctcctgaacgcggcttcctgccgccggtggtgcggggcctgtgcacacccggcaccataccgcttanncccgcggagctgggcctggtgtacccgcacctgcagaggctgggtccgggccccgcgctcccggaggccttttaaccccccctgggcctgacctacccgggngcccgggcaccagcgtgccgcggaagggggactgaggacttggcagagctgccggcgccggaccctgcgacaaaccggggcccccaggacagttaggcccgctctgcccgtagccctgagaattaaacgccggctctccctgca

SEQ ID NO: 621705 - DNA, 528 bp, Homo sapiens
agagagttagagagttatagagagagagagagagagagagagagagagagagagagagagagagagagagagagagcgagatagatattgttcgagagagagctcccgtttttttttttctctctcttcccctccttttttctttttttgacttctttgtctccccactcccacccccctttctttcttttcactgcttgcttaggacccctcttcctttccttccaatccttacttgcttcttctggtgaaggctttttgattccagcccttcctttccatgcccttttcccttcttcctttccctcaagctttacttccccttttcttctttagccccacttggcttttttttttaccatcctctctttcgctcatctttcttccttttttcttacttcttttctattttttccctccttctcttacccttttccctgctcttcccttcctcctactcttcttcttttcccccctttaccccatccttttcttactccttttcttctccgtctccctctccttccc

SEQ ID NO: 621706 - DNA, 272 bp, Homo sapiens
  misc_feature (1)..(1): n is a, c, g, or t
ntcactcggaccgctctcgtgagactgccgcacgcatgttgtggaacatgtcgtaacgaacttgatgaagtacaccatgccggcgattgagacctgactcaggttcagacccgtgaccggatcgatcaggccgaactcggccgggaccggacacttggtcatgtacggggtcagatcgacattgaggacatcgctgcccataccgacggggatgtacttgtcagccggacggatgtagttgtgaccggtgaagatcactcggcacttctggg

SEQ ID NO: 621707 - DNA, 200 bp, Homo sapiens
aggacccgtaccttcacctacccgactctgaggagcttgtctagctccacctctaagataaccactttgtggctgaggacctcggtcattttcttttagtgccaccctactttgtggtcgatcagtctacccaccttcgtgaggtcaagactggggacctttctgtggttaaccgtgtggtcggttacttgtacgatggg

SEQ ID NO: 621708 - DNA, 498 bp, Homo sapiens
tctgaccgttttgtctagacatgcaaaggaaggtgatttcatcactaggccattacattttccatgtttaattgtttaattatttaccctctgctgattgctaagtcagagcatatcatttgataactctgtttaactttatgcagaggcactgtattgttttccacgggggctgcagcatctttcttacatccccaccagccaggcaccagggtctgaatttctccacatcatgggcaacacctgttactatctgatttttttcataatggccaccgtgataattcattgtggtttttatttgcatttctctaatgactagttatgatgagcatccttcatgtgcttgttgggcatttgctgtcttctctggagaaatgtccattcaagtcctttgcccatttttgaattgggttgttgattaacaaagttattaggatattaaaaatacacacatcacttccaagtaagattaatcccagcaattcaaggatggct

SEQ ID NO: 621709 - DNA, 129 bp, Homo sapiens
ggattagcttgcgtgctggcatgtgcctattatcccagctactcaaggcaggagagttgcttgaacccgggctgagatatgcaccactgcactccagcctgggtgacagggcaagactccgtctcaaac

SEQ ID NO: 621710 - DNA, 404 bp, Homo sapiens
agaatagtcagcctcagaatgagtgactgctgctgcttctgtgacttgccgagctgtctgcagaccttgtagctcctagtcttaggagtggatgtctggtgagtcatcatcaggttgagaagccttgatacagatgagaaggtgattcttgtctttttgggccgggatttttgctatgattgtggtccacctaatgtcagggaccttctggattatttacgggaaaagaggtaagcttgtctgtcggggcacttggctgaaactgctctacaggagtgaggcgatttgacgctgctcaaaccgtatcttgaagcatggacagaaaagcttgtggagacccaccctgctcagtgaacccctcaccgttggtttcggactccgaacctgggtacccgaggctcgaa

SEQ ID NO: 621711 - DNA, 212 bp, Homo sapiens
aaaagacatatttgttcattttaaaaaggaatcaaaattcacacattcctacttacagtaatccatctttgacttaaggcaatacactcatttgccaaaatcctatcatatctgcttagataaagattacatcgtataaaaatgcacttgcttttgcagaaatgcagttttaaagctacagtacatacttaaatttcaaagtcccttttaaa

SEQ ID NO: 621712 - DNA, 224 bp, Homo sapiens
aaaaactcagttgaacaaatagactagaaagtgctttacatatctgtacacacaatagctaagaccaaactgggattagataccccactatgcttagccctaaagctcaacagttaaatcaacgaaactgctcgccagaacactacgagccacagcttaaaactcaaaggagctggcggtgcttcatattcctctagaggagcctgttctgtaatcgataaacc

SEQ ID NO: 621713 - DNA, 1027 bp, Homo sapiens
atcaattgcctcgatcggtcgatcctgtaccataatgtctgggcccatgtaatccggtccgtgccgaaagcgaatggtggcgagcgtgcgtgccccgagaggttaagatgtcaccattgctgacgatctgcgttggcagagaacgcatgtaaattcgatctgtcggcacccaggagaccagtgttcacctcagagtacttagctaccacgggactggccagggcggtggataagatgcctacagtatatcactttactactcaagtggaggactagtacatccttcggaagtcatgcatcctctcaaggacagtagctggacggaatcatgtcagtcaatgataaaccatacctctatatatgaggttgtgatgatggacccaacgttacattactacgctgttcattagagtatcacaaatgttccctgcaaatggacgcaccgtgctgatgtatcgtgcgttgaaatacgatcttcctagattgtaggaaaatgggcccccatgaaacggatgcatgctaccaaatcctcctcccgttcaccggtttattaaggactgacttgttggctctctcagaggtatatccaagtatacctgggggcgcgaaatgtgtagccttgtctgtcaggatccggcagttattgtaaggacactaccttggtcaaataaaccaacataaggttgaataataagagttcttacggtaagaagcgttacataaacaatttttaatatactatttgtttgggttcgtgacctaatagtgtttctactggttcaattggattcaagaagaccgagcgtagatattgtgggttgaacaagtaaaatgcgagggagaaagagatgaagcacaacaaccaagaaagtgagccgaaccgggtttgccagaggactagtgaaactaacacgcgtgggcgcaataaactatttatattaaaaataacacaccactttaaaagagagagaaaccccataacaccttttttaaaaaaaaagaggggatggtagaaaatagaacacag

SEQ ID NO: 621714 - DNA, 116 bp, Homo sapiens
tgacttagcaggaccctcagtatatgtaacctgtgaggtttctatttcttcataattagtgtgttagatgtatgtttctaggaatttatccatttattctaggttatccaatttgt

SEQ ID NO: 621715 - DNA, 202 bp, Homo sapiens
tggttttttaaattgctttaaaaaatttttttaactgggttaatgcttggctgaattgggaagtgaatgtccatttcctttggcctcttttggcagatatacacttcagattaactacaccgagggagatgggctcaggggactatgactccattgagggaaccctgtttccgtgaggagaatgctaattgcaataaaatct

SEQ ID NO: 621716 - DNA, 399 bp, Homo sapiens
acaggtgtagattaagtctcaaagaccaagtcctcagggaagagccacctagagaggtgaaacattagggacggaaaggctggagcgcgactgggttcctccaatttgctgcgacaagtttggctttccaaatactagcgcgtccgtctctttaaatcacagagcaatcggggtcctggtgggcaagactgaccctgccgaccagatgcaggccgctagcgggaggcaagaaggaaaagaaggagacattatcaagatctctggcgtccactgaaggccctaatacccggccgcgatgaaccttccgaaaaggagccgcaggaaccccttttagattttatctaataaactgatagcaaagtatattgataaggcggaacccggagcaagtagcaataa

SEQ ID NO: 621717 - DNA, 157 bp, Homo sapiens
  misc_feature (3)..(3): n is a, c, g, or t
  misc_feature (24)..(24): n is a, c, g, or t
gtnattttgaaggtctcacaaatntaaagacttattgtagcccatgaacacattgacaagtacaaaaattacaaaaatatgcagaaatattgaataactagaacacaagccactgtttcaactccagaaaaaagaaaggctttactttttccatgaa

SEQ ID NO: 621718 - DNA, 197 bp, Homo sapiens
tattatcagtgtactgtgccgcccgaaccgtatacttttgcatatgataatattgtacaagatgcatgcccgacccgactggattgcgtagctaagaataatagtaatgggatcgcgagcgctattctgttgggtttgcggaactggaagccatgatttaatatggaaggcgcaggggcgcattcgtatttgtgact

SEQ ID NO: 621719 - DNA, 351 bp, Homo sapiens
tcttattgttttctctcactgcttcccaaaacaacagttcggaagttgtttaaatctaccaaagaactcttctattctcactgtctttgaatctcaaaatgaagtattctcccagattctcatagagcttcactcatgttgttgtgccttgtggagagtttttcatactgttctcgggcagtctttgtgaagctggtcctcttttccactaacttatcgtgttgattttctggatgggggaatttcttgatgttgcgttccagatgtaacatttgttgttcccttgatgccaggtttgtcctgagaatttgagctggaactttggttgccctttccgggtgggtcctggtt

SEQ ID NO: 621720 - DNA, 747 bp, Homo sapiens
ttgggccccagtatacacagtgggcacggtaataagcacattcgtttcccttcaggtgcactaagatagggaagctaaaagcagacctgggggtatgcctgcagactgcaaggaagatgtatggagactgacacacaacttccctcccagataagctctacctaaagagacacagatagcagtcgcaagcctcgtgataaacctctcccacccggaatccttgaatactcttagtctgtaagagagcatgcctggtgatgtaactcagccagaagccactactatgggtcttgtctattctgctaagataaacctgtcgtcgaccatcaagctcactctgttgtttctttcctctgatcgggaaattcattacacatcatggagcgctacgggaaatggatcattgcgtcctcgcaccacttgccagtgtagcatgatgaagaaagaacgccaagaaaaagtataacgcccactcggggaacaacattagacgatgttggtagccaggcataggcagctgatgcctgtaatgccagcacttaggggggttgaggtagaggattgtttgaggaccaggagattgtgagacacaggccatgggcgaacatagtagagaccctgtctctacaaaaaaagtttttaaataaattatctgggcctggggggcagagtacctgtacgtcccacgctgcttaggaggcggacgacgggaagatccctcgagctcagtacataatcaggctgtag

SEQ ID NO: 621721 - DNA, 376 bp, Homo sapiens
tacaaactggtttttggatattgcaaagttaaaagaacaaatatttaaagcatcccaggcacatctgaccttaataccaggaacctgagggcttgaaggagctgcagacggattagcagccagtaagccattagaatggatgaaaacacttggaagctgtgtgatttcaatgatgattgtgttattaatctgtgttgtttgtctttgtgtagtctgcagatgcagatcctgactcctgcgagaagtagctcaccgtgataaagctgcctttgcttttattgcctgcaaaaacaagaagggggatatgctggggaataggccccaaatctggacataaactggccccaaaactggccataaacaaaatctctgcagc

SEQ ID NO: 621722 - DNA, 281 bp, Homo sapiens
  misc_feature (128)..(128): n is a, c, g, or t
  misc_feature (149)..(149): n is a, c, g, or t
  misc_feature (257)..(257): n is a, c, g, or t
tgtgtccacgctcgaactggatggtttgcttttttactataagtttggagagttcattacacattctaggctgggcacgctggctcaagcctgtaatcccagcacttggggaggctgaggtgggcggntcacctgaggtcaggagtttnagaccagcttggccaacatggtgaaaccccgtttctactgaaaaaaaataaaatatgtattctagatattagtctcctgttggacatgtggtttgcaggtattgtctnccaaactaactaatctttttgtcc

SEQ ID NO: 621723 - DNA, 137 bp, Homo sapiens
  misc_feature (24)..(24): n is a, c, g, or t
acaacctacatctgccaccgaccnctcctctctacgacctagctactctcctctaaaaagctacctaactgcaaccttaagactgacaaaactgagaagcagagaaggccgggctgaccctacaagctgcctgctcc

SEQ ID NO: 621724 - DNA, 170 bp, Homo sapiens
atttggtttggatcaataggacagcatatgcagccaaccaagatgcaaatgttttgacatgatatgaccaacatcttagtaggacagtcacccacacacttctgctttcacttaagtttctggcccgcaatactgtaggcaccagcatgatcttgttactgtgatatttt

SEQ ID NO: 621725 - DNA, 190 bp, Homo sapiens
atcatcacaccactgcacactgcctgggcaacaaagcgcaaccctgtcaaaaaaaaaaaaaaaaaagaaaacctcaaagaggaaaatggtttattggattacctactaaaatttattttagaaattttataaaaaagcgtagcgagaaatgactattggtagtctcatgtggaattttaacctcgcggga

SEQ ID NO: 621726 - DNA, 136 bp, Homo sapiens
aggatcttcaaacaccgcaatctagacctggtgatcatatcgagagcagacagaaggggagtacagctctctggaacatgagagtgcaggggtgtgattgagtgttgaagattgtcacacgaggccaagtctcagc

SEQ ID NO: 621727 - DNA, 471 bp, Homo sapiens
  misc_feature (216)..(216): n is a, c, g, or t
gaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggtcgctatgacatggctcagcttcgatttaaaaaaggtcagtgtctatctggaaatttctangtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagctttttttaaaaaaa

SEQ ID NO: 621728 - DNA, 333 bp, Homo sapiens
ttttttggaaaaaaattttttttggccctgggccccttttttattttttaggcccccccccccctgggggggggtggggtggggaaacccccgggcttaaatttttttttttttccttttttggggcccaagggggggccccaaaagggggggggttttccccccccccccccctggggaagaaggggggttttttttttttcccccccccctttttccccgccccccgggggggggcccttttggggggggggggggggtccccattgggccccccttggaaaggtaaaacccccccccaaattttttttttttttttttttttgtttccca

SEQ ID NO: 621729 - DNA, 421 bp, Homo sapiens
ctgcagcattttttggggtcaccgagctgctcggggtcgatccacttacaaataagctcttgtttgatgcactgttgtcgcatgtagcgcaagaacgcgcctggatggtgcgccatgttcatactcatgtttaggccatattggctgtatggatcggcccgcgtattgggcacctggtgatactgctccgtccgcccgaaaacctcaccgggtaatccaaggcgtccattcaggatgtttggagagccgtgatgggacccgtgctgctcgtggattccggggaaaagtaggtgaccctgaccttctgggtgagagtgatggagagaccctgatgtggagctgaacatggggtgttgtccactggccggagtcgaatccccaaatcctcggctgcgcaagaggaactccctggtggagttaa

SEQ ID NO: 621730 - DNA, 116 bp, Homo sapiens
aacagtggaattggtgaaccctggagaagctgaaaccagagagccttttgtttctctataatatcctgtctatgctctgtctcacttaacactacgttttcttgctatggcctgtg

SEQ ID NO: 621731 - DNA, 349 bp, Homo sapiens
aagcttggcacgagggtcatgaccagcttggagtgccacgaggccgctgcccacgacccggccactgtcatgaccagcttgggagtggccacatggtcgctgcccacgtcccgggcactgtcatgaccagcttggagtgccaccgtggccgctgctgtgacagacagtattctcgggggtgggggctgcatccaaggctttgtcaaccggctggaccacgtctccctcgccccagtgaccgggggaggctgagcccctccctcctgtgtttgttcccattactcaaaatgtaggatagatcaggtcagagcccaggaaatactcacaggtttcaccaggggcctctacc

SEQ ID NO: 621732 - DNA, 661 bp, Homo sapiens
  misc_feature (110)..(110): n is a, c, g, or t
  misc_feature (130)..(130): n is a, c, g, or t
gtgtttatcgatgccactagtgtttatcgatgccactggtgtttatcgatgccactggtgttttcgatgccactggtgtttcgatgccactggtgtttatcgatgccacnggtgtttatcgatgccacgngtgtttatcgatgccactggtgtttatcgatgccactggtgtttatcgatgccactggtgtttatcgatgccacctggtgtttatcgatgccaccacctcctagtctgatgatgtactaggagattcacagactcagcctgtagtcatactcatggctatgttttactacagcgaaaggctaggaagcaaaatcagcaaaggaaaaaagcgcatggacaaagtccagggaaaccaggtgtaagcctcccacagtcctctcccagcagagtcacataggacacaattcctccagcaatcagttgtgacaacccatgtgcaatgttgtatacaagggaagctcattacagactcagtgttcagggttctcattgggagctgctcacctcatcctctgcctaacacatatgaaaatctgactcccagaaggaaagcagatgttgggcataacccacatggtttgtacgaacagtttaggcacagtgagccactcttatcatttagggagtaatgagaagagtggcatcgataaa

SEQ ID NO: 621733 - DNA, 337 bp, Homo sapiens
aggtgaatgatcatggtgattagggatatgaaagagacgacattgaattcatttggtaaggacaatgggatgccaagccagttgctcatattgaccaatttactggtgacatgctgggttctgctgagttagctgagtgaggtcaatttaaatggttctggcaatctgcgcaggattacaggcggtgccagccctggaaaaatagttagaattgtggttcgtggttctaacaaagtggtgagttgaggaagctgagggctccatacatgatgccctatgtgttatgcgtagtagagtgaagaagaggggcttattgaggaggtgtgctcagaaatga

SEQ ID NO: 621734 - DNA, 424 bp, Homo sapiens
  misc_feature (110)..(110): n is a, c, g, or t
  misc_feature (130)..(130): n is a, c, g, or t
  misc_feature (403)..(403): n is a, c, g, or t
gtgtttatcgatgccactagtgtttatcgatgccactggtgtttatcgatgccactggtgttttcgatgccactggtgtttcgatgccactggtgtttatcgatgccacnggtgtttatcgatgccacgngtgtttatcgatgccactggtgtttatcgatgccactggtgtttatcgatgccactggtgtttatcgatgccacctggtgtttatcgatgccacactcccctcccagcctggtcccaggacaggtggtcggtgagggtctggtgtctggaaaaggtggtgtgtagccccggaatagtcagggaagcagataatttagttaaagtgtctcggcctaataagggaactaggcaggtggggataactaaaaaggagagccttaaaagagtattgtncaggtgcatacgatacacacc

SEQ ID NO: 621735 - DNA, 793 bp, Homo sapiens
ggcagcttgctgaatggtgtctccctcgctggagcggcagaaaaaggcgctggacaaacagtgaatatcgtaaccaagaagccgagagtgcggagaaccaggatgaatcagaactccttagggttcctgatggtggaaggaaccagctttgtccaaagaggacaatcccagaggcacttttggaggagagcagtttgcgctagtctgtgtgtgcccaatagatacagggtgatgctatacttgtagaagagtgtgggtgcatatggctgcagacatagccttcatgtgacacatcatgtctaatgcaatccctggagctgatctgattggcagcatgagtgtatgtactacaaagaagactgtttgatccatatatcatcattagggccagagactctgatcaaagaggtgtgtagcaaggagtgtcctcgtttgaacaggccaggacgagatgcttcaggatgatggttgcatgtgacgtgccttacaactaggttcttcagctaaggaataggagagagatttgtaaaaggatgactagcgggtaatgcgtcccaagggatctacgttgacagggcattggaaactactttaattgaaattgttaggattatggttcaaggggaatcactagttgcaaaccaatggcacccttggaggtggtttgcaaagacggttagaaaaggtagtccttgatactattgaagatgatgcactccaagttgataagatgacaagttaatgatcagagaggtggaaaagatccggttagatcaccatgggagacatgggg

SEQ ID NO: 621736 - DNA, 234 bp, Homo sapiens
ttgtcaccggtctggtgatggtgggcatggcggatgcggtacaggatcgggtcacgcaggttcatgttcggcgaggccatgtcgatcttggcccgcagcacgcgctcgccgtccttgaactcgccggccttcatgcgggcgaacaggtcgaggttttcttccacgctgcgctcgcggaacgggctgttcttgcccggctccttgagggtgccgcggtattccttgtcttactca

SEQ ID NO: 621737 - DNA, 856 bp, Homo sapiens
  misc_feature (181)..(181): n is a, c, g, or t
agactcactaagaatccattcttcagtagcgcaggcgcatgagatagcgctaggtgaatggtggatcgcttatctgttatcactattggcatctcttggttcattgcactagtagcatagtccttctttgacacaactaagacaacgccagtggaggtaccgtatcgattctgtaactaanatcaaccaatatgggagtcctcgagagtcaatttagtagcgtagtacattaatgaaagaggatgtcactaatgagtatgaataacagactatgtaggatataacgagacgcagaacctggaagagagataatggtgaaagtttaggcacattttcactaaaagtgggaacagaaaatggaggcctgttttttattgctaccaccatagatctggagatcttcgccagtaacaagcaacaaattcaagttgtaaatattgcgacaaggaacagacaaacaatagcatgacatggtccatctacaactaatattaagactccctgtggtattgcattgagcagagccagaagagatttcaaaaaaagagctatgcatttattagaatttggaatatgatacaagtggcatcgggaaatgaggaaataatggaagctatttaaattaagtggaggtagatggtctccaagggggaacaatagaccatgaactatacacaaaaagtgcagtccagagcattaaccaaacaagaactatgcgcacaaggcttatgtactaaaaatgcatattgaccttgggcacataggggaaaccattccttggaacaattggagaaactacttcagcgggactataatggagtatagaatgctccaggaaaatacggccctagggata

SEQ ID NO: 621738 - DNA, 129 bp, Homo sapiens
gggtttttttttcccccccccccccccccccaggcccattttccccttcctgcccagggggggggggggggccggggggccccctttttcccccccctccacccggttttttaaagggtttctttttta

SEQ ID NO: 621739 - DNA, 100 bp, Homo sapiens
ctgcgctattacccctctgatactggtctacactgcagcagcgtctcagtgcttgagtgtggcatcagaacgcctggatgccttgctatagacacagtgt

SEQ ID NO: 621740 - DNA, 144 bp, Homo sapiens
tcagtcggtaccctgcttctgcttcctctgctgcttcctgcgttctgccaggcgcggtggctcatgtctattatcccaccacatcaggctcattttttttttgtagagatgggtgcttcctgcttctgccaggtcttggtgagg

SEQ ID NO: 621741 - DNA, 734 bp, Homo sapiens
gatctatggacgaggacctgtggttagtctggcactgaggaactagtggcgggctgaagacgccgtacccctcggaatggcagccctgcggtccctttgccgcccgttccctcccggacatggaggacgtggatggcgcagcttctgcccacctcttgcagcccatcctgcgacctcaccaatgaactggtgagtgtggactgtggcggcccagctggtgcgagtatctggatgtgatgctggatcatgatctgcatttctttttgactgaatgtgcaagaccacaatgaacttcattgaggcagcgttgttgatccagtggctctgcctgcgtctacagtaagaatgtgtggaatacctctactcactctgtctaccatgtgcccttgatttacatctctcgtgaaatgatggcgggccaatgcatgctctcttcgtgttgcatgtgatggacagggccaatggtggttgccagctccggggtcccccagtgaggcacgagaatgatgttcctgtctgctggatgacttccctgactcccggactaactgtggcatctcaagaatgatcatgacgcccagtgaggtcctcatcatccccctcctgcccatggcacctgtgtggcccctgatgacatgtgagaaggaacaacaaatcccctgtacagacgaacagggtgaggtcctggccagccaggaaggattcaggatgaacacgtgcgtaacccaacccca

SEQ ID NO: 621742 - DNA, 142 bp, Homo sapiens
  misc_feature (134)..(134): n is a, c, g, or t
ggcacgagcccagatcacctgtggttttccccaaatggccacttgatggcactcaagaatcttcttcttgttcacatgattcctggaatggctcatgtgaaataaagggggtatgatgaatgaaggacttttgntaaaagtc

SEQ ID NO: 621743 - DNA, 319 bp, Homo sapiens
tcttaggttttgatgtgtccgccgccatggcccaagctgacatctcgctgttcggattgtccgtcatgggccagaacttaattctgaacatgaatgaccacggctttgcggactggctacaaaggtgatgatttcttggccaatgaacgcaaagggaaccaaagtggtgggtgcccactccctgaaagagatggcttccaagctgaagaagccccggcggatcatcctcctagaagaacgctggccaagctgtggatgacttcatcgagaaattgagacggtgccgagacctcaccgccacgggaatcttatttgtggg

SEQ ID NO: 621744 - DNA, 533 bp, Homo sapiens
cccgaacatgtcgaggctggcttgaactcctaacctcaagtgatctgcctgtctcggcctcccagagtgctgggattacaggcatgagccaccacatttggcctattttttctttttaatgtaatttctttagtaacagttttatgtttcagtaatagatatctatttccattttttggaaatgactagaattacttatggatgctgcttaatttatttttatgcaattctttctaatctacttgagttatttctgtttttcttatattatgaaccatgctgcactcaacatttttatacagcttcttttacttgaatggatatttttggggataaattatagaagcagatcaaaatgtatgaagggaagtatgtcagagtatgaagtgggtaaaaaggttgtggaaattaagtgttagctattatgagttttaaatggtttggttcctgattccatttagatctttatagtggttcttcatttttgtttgtatttactttgtattattttgctttgttgcatgtattctagt

SEQ ID NO: 621745 - DNA, 107 bp, Homo sapiens
cccgccgagcaggggctgccccaagctgatgctgacggcttcatcatggtgtatcttcctagacgggcagagccccgtgactgtacagagctatttcattgttgatg

SEQ ID NO: 621746 - DNA, 288 bp, Homo sapiens
ttgacagcatcctaaccagcagcggagcgtagtgagcgagatgtgcaatgcccacagcctggtggcagagtgagacctgtctcaaaaaaaacaaggcgggtgcgggtgctcaattgtatccagcacttggaggcaggcgatagatcacctgaggtcaggagttcgagacagcctggccaacatggtaaaccccgtctctactaccaatacaaaaattagccggggtgtggtggcacacgcctgtaatcccagctactagagaggctgagggaggagaactgcttgaac

SEQ ID NO: 621747 - DNA, 947 bp, Homo sapiens
  misc_feature (354)..(354): n is a, c, g, or t
  misc_feature (662)..(662): n is a, c, g, or t
  misc_feature (759)..(759): n is a, c, g, or t
  misc_feature (810)..(810): n is a, c, g, or t
  misc_feature (837)..(837): n is a, c, g, or t
  misc_feature (845)..(845): n is a, c, g, or t
  misc_feature (874)..(874): n is a, c, g, or t
ctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcaagtggaaggatttgcaacggctgcancgtttcctcctaactagaatatcgcgtcatgaattaaagggaaagaaagtgggatagttccggtgaaagaagatcaaagctgccctttgctgaaattacacaactgcatcattgaacaaaaggaagtttcattaatgggcaagaaatgggataaaagttaaagaaagaagccatgggaaatcctggactggctcgtcaggaagaaaagcaagaagaaactaaagagactcactgaccttggccagtcaagaatggcagagatgcagctgggcccgaaactcaggggcagaaattaagcactttgtcangcgaagcggtaaattatgacgagggagctcgggaaaagctgccccgggttttcctgtgacatcgaacaagctgaagggcccaaatcattgctctgcnggggaaaattacacatccaaaagggaacaactattcctcaagaaatccccngcaggctccctggctggcctccggctngaattgcngcacgcagcaaacctctgggggaaaaaanagttaactttttcccgaaaaatcaatcccactccacaaataaggccccccctgaaagggcaaaagccggcaaa

SEQ ID NO: 621748 - DNA, 648 bp, Homo sapiens
cccaaataggctcaaaaggggtaaccggtgcattgggagtaacaacaaattccgagttcaatcaagctttgggttaagaaatgttaataataaaggcctgggctgaaagactggtctagaaggtacagtacaacttagggttagctctcatcagaggacgtcaattttgctgatcatgattggcactttaagggccatgaatacctgaatatacttaaattctacattccgaggatatataatgtaggagatctcacgcaattggtctgactcatagagattttgcaaatctcatcaggcacatagccaccggttgagggctgatcttctgacttggctttcatggttgtccagtgctggttctataatcccattaacttcagtattccaagcaatgaattaagcttgctggtttcatcctggcaaatatgaacataatcttgagctagtattgtcagtatgtagtccaacaataatggcagacactaaggctatgtatccggtacaaagaccagcatttcacctgcataatctcaattagcatttcacaattctgtaccgtagatattatctataaatccatttgacaagcgagtaagcatactcagctccccccaaagtcagaaaacgatgaaatctacatctaag

SEQ ID NO: 621749 - DNA, 834 bp, Homo sapiens
  misc_feature (249)..(249): n is a, c, g, or t
ctggccgcatcggcatttattttattttatttatttattttgagacacagtcttgctttgtcacccaggctggagtgcagtggggtggggtgatctcggatcactgcaacctccacctccagggttcaagtgattctcctgcctcagcctcctgagtagctgggactacagatgcccgccactaagcctggctaatttttgtatttttagtagagacggggtttcaccatgttgaccagggggggctanatcttctgacctcatgatccgctcgccttggcctcccaaagtgctgggattacaggtgtgagccactgcacccagcctaaaagtcattttaatttgtaagatatgtttactggtttagagagacagaggctaacttttcattttcaagggactggtgaacagtcatccatgagttcttgaagttgaataacaggaaactgggcttgtttttcaaaccatttggctactagaagaagctggtgggtccaaaacgcacgtccaataaactggagtctatgggcaacccttggtttgagagggcaacagggatactcactggtgggcatgctggccattttaacggcttggggaaaaatatctttcctgggcccttgaggtgtgtggggcctttgtgaagaaatcggagagagggggcgggctcactcaggggggtgggagagtaccgaaacgttggttcggagggaaaagcgtgggcagggggtttttcaatagaggggtttctttttttggctgtggaagaaatagggaaaggtatcgggagggggggggtgaaagaaggagttggcataaagggagggagtggag

SEQ ID NO: 621750 - DNA, 252 bp, Homo sapiens
tttttttttaaccccaaaaatataaaaaaaaaaaaaaagggggggctccctttccccgggggggtttttccccccccctttttggggggaatgggggggggaagaaaccccctttttttttgtaaaatttttttttttttaaaattttccccaaagggcccccccccggggtttttttttagggaaaattttttcccccccccctttttttaaaacccaaaagtttttccccggggggggggggaaaggcga

SEQ ID NO: 621751 - DNA, 706 bp, Homo sapiens
gatttccgccttattctcaggctacaccctagacaaaacctacgccaaaatccatttcactatcatattgatcggagtaaatctaactttcttcccacaacactttctcggcctatccggaatgccccgacgtgactcggactaccccgatgcatacaccacatgaaagatcctatcatctgtaggctcattcatttctctaacagcaggtaatattaagtaattttcatgattgacgaagccattcgcttcgaagcgagaaagtccgtaagtagtagaagaagcccgtccagtaaagcgcctggagtgactatagtggatgccccccaccctaggcacacattcgaagaacccgtatacataaagatctagacaaaaaagaggaaggaatcgaacccccctaaagctggtttcaaggccaaggcccatggcctccatgactttgtgtcaaaaaaaatagggaatccacacttgacgggacaaacataaggaacacgaagatgacgggcgaaaactatacgaggaccgcgcacacccggcgcaaaaaggagcctatgaaaaaccaccacgctccttgcggcgcaccaggcgccacacgagtgggcgaaaagtcacaccccgacacacaacgggcggtgcccacaaagagaaacactgggaacacacaaagccagcgcggaggagagagacccccccgataaatagg

SEQ ID NO: 621752 - DNA, 1043 bp, Homo sapiens
  misc_feature (253)..(253): n is a, c, g, or t
agcggagagcggggaaagtgcgcatgcgctggactggtgtgtgcgcgtttctagtagtagcagacgaggcgcatagctgccagctccagcagaccatgatcgctgcaggtattatctgcgtgagcagactgtgtgtcggatgcggctatgtacaagcagtggtcgaatccggctccggggaagcccacattctactgtggacgatggggagcacccatgagcagggtcgttaggaggttcctgcccaagtggncttcgacagaacgcgagcatggaggtagatgaccaaatggaagctgggtgtccggcgaccgtcgcgcaagatcaatcagttaggcacctctcggggacactgcgagctggccagagttgatgatgaacggaatgcagatgctgagggaacatccagcagtcgtccacatacgatggacagtcatgagtacgaggacgatgcttgtgctccctagcagatgcagcaccaagagatcgcaggccagagaggtacttaggctctgcgaagagcaaatatgcctctgggcatctagcgtgtgctcgcgcatctcgtcgccagaccgcggtcccacaacattcgggaccatgacagagatgtgttcagacgccaattgtgggcgctatcgagccgggagtcagtacaaggccgtcaagccaccaggggatttggagaaaggatgagagcaaaggacctccgagaagatgatcttgtgcgcacggggtacacggacactggagggaacgtgaaacagaaagggtcccttcctgtcacgaacaaaaaggttccagggcccctgaagcttagcaccgatttggaagaagctggtgcaagggaatcccaggagaagggacaacaattcccgtgctgaccattggaggccctggggacagggcaaaacagttacggaggaatcatcctggctgaaagtctccaaaaaaggtccgggcaatggaagacattgaccgacagcaggacgtgaaggaccttagacaaggccttgccacactgaatcggcatccagagaacgggg

SEQ ID NO: 621753 - DNA, 529 bp, Homo sapiens
cggaccaaacaaaaattttttttttttaatccccccctaaaaaacaacaccaaaatttttttttattttgggggaaaaaaaaaaaactcggggtttttttggacctcacaaaaaaaaaacttttacctcaaatcccggttttattgggagaatttcctcgcacaaaaaaaaagtggcgttttccttaaaaaaaaaaaaaaaacgcctccaaacttgtggggtggggggaaaaaaagaacattttttttccttgagaaaaaacccccccccccacaatttgaaaattctttttattttttggccccccgttttttacaaaaaaccccctatattttccccaaaaaacacggcggttttttcccccggggggtggttcaatataaatttacacaatctttggtttactgccccccctcttaagaaaataaaacctcattttttttttttatggcccaaaaaaagtggggctaaaacgacaaatatttttcgtggaaaaattttcccctcaaaaactaaaaaaataaggggg

SEQ ID NO: 621754 - DNA, 154 bp, Homo sapiens
gaagggctgtgagccggttgaagcgtgtggggcgatggcatggcagattgtcgtacgaggtgtccgtgtctcacaccggtgctctccattgtggttgaagcaggcatcaggcactgctttgcactatgggggaaataagagcgtggccagaagg

SEQ ID NO: 621755 - DNA, 733 bp, Homo sapiens
agcggggcttgaacgtcacttccttagcaatgcgctttaactcttgctgtccacattttccacataagtatacgatcacatactctttgtgaaaatctatcttttattcctttaatccaagaacaattacctattcaagggatccgtaaaaattcaggcccaccgagatgtagagcgctgggactggacggaggcagggcggagctcgacgtcatgtgactggttggtgacaggaccggagggagtcgcgacgaaagacgatcagcagaaacgaacgcatgaagacaaaagaggacgtgccccagagatccacaaggaacaaacagaacgacagaagaaggaggaagaaaaccaaagacggcaaacaacaacacagggacacaccaaaaaagaagcacaacaaaagaagagcaaaggacacgtaagacgagaagaagaatcaagaggagaaaaagtacgacgcaattagcgagagttcagaagtataaagacgataaggcagagaatgcagaagggacggacgagagggggaaacagagacgacggaacacccgcgagacgcagagaacaatgcagaaaagaaccgacgaacgaaaaaaaggggaggacgaaaagcaaagcgagagagggcagaaagagaagaaccaggagaagaacgaaaggagaagaaaaaaaacggacacaacagacgccagccggagagccaggatacaaagacaggccagaaaaatac

SEQ ID NO: 621756 - DNA, 129 bp, Homo sapiens
ctgatgcgagaccgtattgatggctttttccattatggagatgatcatatggtttttgtttttaattctgtttatcaacatctatcaataatgtgtgattcatcacataaacagaattaaaatacaagt

SEQ ID NO: 621757 - DNA, 455 bp, Homo sapiens
tcttcattgtcttctcagaactactccaaacctgctgatgttacaccgctcaacggatttttctgaaggaccaaaaacagatgccactgacggcacggattacacatgcctcagcctctacgatatcctcaccctcttccatggagcaagaccaattcagcagatctgctccacgtgatgcttactgctctgaagtgaaagccaccactctcggcgagccccagggggtagatcacctgcggccaggcgctcgagaccagcctggccaccatggtgaaagccgtctccactaaaaatacaaagatatgcctcgtgtggtgcttggcccccgtaattccagccacttgggaggctgacgcaggagaactccttgaaccttggaaccggaggttccactgagctgaaaccatgccactgcactccagcctgggcagcaagagcgaaactccatcaca

SEQ ID NO: 621758 - DNA, 776 bp, Homo sapiens
gagcttgtgagtggtgtggactagccgtcgtcatggccgggatcgagaagctggggacgcgtctcagacgcagcgtggtagtccctggccatagctccgccgcgtgcccgtggtgtctcaccatttgaagtctccttatgctgggtgaaaacatgagagtgatagattcgtgtggtcctttcaaatgatgtgaagtggtggaaatggatccaacaataataagtgacttctctaccaagagcatagaagattcttcgatatctccttccagtggctcaagtttagatgttggggaaggagcagacacaagtgaaagcacagaaaactgaagagaagaaatcctcagttggacctatatttctccttgactattgcttagtatccatgctagccatcgtgctaagtgttttaacttgctcggaatttataaatagtaacaggccaaagacatagacatgatacatttagtagctttataccaagaaattggcctgaaagctgcgtgttcgtggagggaaaacgtgtagcaaaattccgtgtctaatggtcatgaagcacttgtggtgtgtaacaaagacgagatgtatgtccctagatttggaaggttaaggcaaatattaatacatatctgcaaacgtatttttttagcagttgcatgaggtaagagtaatgagaatgggattgaaggacttggcatgtggatgttgggggacgttgacttgctcagatctttgaatagggctttaatattttgagtctattacccttgatgacct

SEQ ID NO: 621759 - DNA, 212 bp, Homo sapiens
cgatgtatgaactggaattgtgaagaagagggtctcattcactgttttctcattttccctttattctttaattttaccctcagtttcttctaggacttactttactctgggaatgttcttaatccactgactagagatgaagataaaatgacgtgtggtcaacttcataagatgttgatattctcgtccctttgctacatttagtctaaatc

SEQ ID NO: 621760 - DNA, 405 bp, Homo sapiens
  misc_feature (15)..(15): n is a, c, g, or t
acatgcggagttatngatacaggaagatgctaactgggaactgtacaaaagtgtgcatagtggctacagtggactcgactgtaagggctctgtgggttaggcctttgcaggtcagcatttgcacatcgcatgctaaacccattgaggcagtcatccagccagtcttggttcccagccctcaatcaatccacaccgacagggtccaaatccatagtttcagcaaagttagctttgagcttacttctcacattgcgtttattcaattttcatccagtccaccagtcttctccatttgtcactatgtgagtttcatgcccaacacattgttcactcattcgttaccattcaacacacacttgtccatccagccaagccatttccagcatccttgggtcatccagcagc

SEQ ID NO: 621761 - DNA, 1184 bp, Homo sapiens
gggagactccatctctacaaaaataaaataattttaaaaagtatccaggcatgatggcacacgcctgtgttcccagctactcgggaggctgaggtgggaggatctcctgggcccaggaggtcgaggttgcagctggggtatggttgtaccactgtactctagcctgggtgacagagccgacgacccctgctcctcgaaaccaccaaactttaccacccacaccagcaacacacactacgggctctccgctcccgctcttcgcatcgtaactaccagcccaacactcgtcactttactcactgcacactcccgctgactcggcgacgcggggcgactacgggcaacacacaacccgacacactactgcacctactgcccttccttctccgctcctcttccctcctgctctctccctgcttactgcccctctcctaccctctgacttcctgccacctccacgctagctcttgacccctctactctctcccctctcccctcccccccccggctccctgcgcgtcgcacgcccacacgaacgctttcgcgcctcaagtgcttcggccccagggctgtggacagccgcacacgcgtgcagcccccacacccccggcgcccttcaaccagtgcacacgaccccttcatgccccatcccgagccgcctccagcggccagcactcccctcaccctgccccccacacccctaccccccggccgcactccaccagcgcgcccccaccccacaccccaatctccccgcgccccaactcccccgcgccaactacaccaccaccgccaccaccccgaccgctcccccccgccccctgacccacaccacccgccccaccccccccacgcccccccaccccggcaacccgccccccccccaccccccccccaccccccccacacccccccccccacccaccccgcagccccccccacacgccacgccgcacacctccgcccccgcccacccacagccacacggacgaccacacccagacacgacgacccccgaacacccccagccccaccgccaacaccagcacacagccgcacgaacgccgagcgcacaaccccccacggcgccccacaacagccagaaccgacagacacccaaacgcccaccaacacacccgcgaccacactcagccccagggcccacgcacgcccacaccacggca

SEQ ID NO: 621762 - DNA, 857 bp, Homo sapiens
  misc_feature (13)..(13): n is a, c, g, or t
agttgggtgtctncttatgtaatggacatccgctaaatcgctgcgagcggcgaggacccgcacaccaggtaatcgactactactgtgcatatcattattgagaccataactgtcgtcgtgcagtagtggttgagacatgggtctcggaatcagttgtggtcgttctacttttggccgccgttgttgtcaccggcccctttgtttgatgggcgaaatattactttaaccggaaaaagtttctaaatcttgagtagaggaaatatttcttaggaaaacattcgattaaccccggaggaaacatttccgcaggggcacagagaagtccccccccagagggctcaccctccgaaatctggaagcgcggggcacactgtcagaaatccggcggccccgcaaaacacaccgcaaaaaccgcgggtgcgaaacacccccccaagtgcggggggcaaagaagcgccccgcctccgtcctggctcaatcccacgccgccaagggtcgccgctgggccaccaacatcagggcacggatgcacccagggccggaaaatttttggaacagctccacaaatatagggccaccaccgttcaggaaagacattctacacccccggcttttccaaaaatgctttggcagtcgccctctcgttcggccaataccgccacaccctggggacacacgaaggtgtaccaaaataaataccacgtggacagaacaacttgttatagctttcgggcaactggcagaaaattagttaattcctggtggaaaataaaaccccccgctgttcttcatcagccacattgtttccaccccaaaggccaccatttttctccccgggaaagagttccctcttaaca

SEQ ID NO: 621763 - DNA, 120 bp, Homo sapiens
gactgcttgagcccaggagttcaaggctgcaatgaactacagttgtacccctgtactccagcctgggtggcaaggagcaggaccctgtcacacaacatacacagggattgttgtgtgtgg

SEQ ID NO: 621764 - DNA, 393 bp, Homo sapiens
  misc_feature (163)..(163): n is a, c, g, or t
ccaggccctgtctctggcagtggacaagcagtttgaagagagaaagaagcttgcagcttacatctgatccctgggcttccccagtctggtggcttttcccactggagaacactagcaaccagtaatgtgacggttggccctcatcacaggcctgtcttcccangggaactcacctctctggcaaagccaaagctgttacgttagacgtggcaaagcttagaagaggcgcatccatatggcgcaggctgtggttaaagagaaggtggtattttctaatttactagtcggtgtattaagaagtggcattacttggacgatgacacaacgatcgtgtgtcaatttttctactggcttgtgtagaaaggataagttcacgactggtattgtcatccg

SEQ ID NO: 621765 - DNA, 525 bp, Homo sapiens
  misc_feature (41)..(41): n is a, c, g, or t
  misc_feature (46)..(46): n is a, c, g, or t
  misc_feature (48)..(48): n is a, c, g, or t
  misc_feature (65)..(65): n is a, c, g, or t
  misc_feature (397)..(397): n is a, c, g, or t
tatgaacggtcggcgtctgatatccgtatccccgagaacgnatcgntnaacccacgagcaatcgntaccgccggattagcaaagctcgtggaggacgtgaaccagtaggctgcgacaacatacgcggcaaccacctgaggcacttttgctttgtgatatttatcgcacagcagaattgtcagcaccaaccccgacgttgccaagtactcactgaaccactgtgacggcccggtgcgaacgtgatgggagaactcgaccacaggcagctcgaacatgaaatgcgcagcgaataccccgaagattgcacccgttgcttgagccgccacgtattggcccagttgcttactgctcagtcctccgcgcaaatagtcgactacagagaccaccgggttgaagngcgcaccggagaaagtggagaagcacacgatcagtacatacaagctcgcgccagttgccagcgcattggcaagaagcgctagcgcatcgttaccgttcgccaggcgctgacccatgattccagaacca

SEQ ID NO: 621766 - DNA, 335 bp, Homo sapiens
tgtggctacagagtgaggcctgtcccctttggcctgggggcagaacatgggctcagagttttggggactatagggcggagcctgtggtccccaccatgcggtccgaattccccagttagttcacaggcctttgcgctgccgctttgatcgaatgactcgagtgtcatcactaggaggtggacacgtttcttgcttcttcatctgcacttgccactgtcccgtgagttgcagctttgatggcgctccgaggttgactcttggtggctaccagtcagctccttcatgcccttcgtcttctcactctgcaaagtgagcaccgtacccctcggcgtgtg

SEQ ID NO: 621767 - DNA, 514 bp, Homo sapiens
  misc_feature (25)..(25): n is a, c, g, or t
  misc_feature (41)..(41): n is a, c, g, or t
agaggtgaagtcttgctacattgcncaggctgatcttcacntggtgggctcaagcaatcctcccacctcagcctcccaaagtgctgggattacagttgtcagccaccgtgcccagccactggtttactatttttccttccacttggtatttcctactataatagcccttactttgcaggtcaggggaccagtgtaagaattctgacagttgatgagtatgtctattccaattacacattccagaactgaggaataacagagagtgggttcagtgacccaccaggcttgactatgaaacagacccacagcaaaactccattaaccacctgacctccacaaacccctactttgactggtaggccacactcattctaccaaagtatggattagtgtcaatttagaaccaggattcaaaaatcccccataaatgtgattcttttcccttccttggtgaacaggtaccctggtaaatgagcacaggtcccgtcgacgcggccgcgaatttagtagtaat

SEQ ID NO: 621768 - DNA, 694 bp, Homo sapiens
tccttttgggatgtgaagggtgaacttccctgattttggtctgttgtgaaaaaccctgtggtatttaacttttggaaattctcaaagaagccttaattataaaaagttggcttctctactcaggaaaaagcatcttcctggtatatgtctaaagtgtattttggctccctcattatacagaagagttcttaatggattttacagctcgtgtaagtgctggagtgttttaaaataataacaacttttatattttttaaaacgacaacctctcatatttatccggtgtccttcccgtgacgggtaaatatgggtggtgggaattccacgggttaaacgctcagtaggattggcacctttttagtgttttttacccctttaaagagctagattacttagttttccaccttaaaagaggggggaacactcttaattacagtgattcactgtgaccattacgtttttagacactttctgtattgtccccttctttctaggctcggtgggcggggtgactccacttagatttacgggtactcgtcactatcacaagttttctttaaaagccttctcttttagaatttaaaatatttggtccccttgaaggagttcggattgtgtaacctggggatggccttagaaaaatttcctaggacaaaaataaccttttttaaccacttctttaaggtggaagacc

SEQ ID NO: 621769 - DNA, 368 bp, Homo sapiens
  misc_feature (365)..(365): n is a, c, g, or t
tgggtcacctaaccacccgaggatttgaagaacagccctgatgaagatggtgagactgtttatacagaaagtttaaaaaaaaaaattagctgggcttggtgatgtgtgcctgttgacctagctatttgggaggcttaagcaggagagtcactggaggcccaggagttcaagaccagcatgggcaacatagcaagacaacctgtctctacaaaaaattttaaaaattatctgggcatggtggcatgctcctgtagtcctagctacttgggagacttgaggtgagaggatcccttgagcctaggagttcaaggctgcagtgagctatgatcatgccacaggactccggcatgggtgacagagcgagnccc

SEQ ID NO: 621770 - DNA, 397 bp, Homo sapiens
cgagtttcgtggggcgccgtatcagctccagcttggtccccctccgaacgtgtacgggataaccgactccactcctgtgcagtaatacagtggcagcatcctacagcctccattgcggttgattgtgagagcaataagaggtcccatgacccacttgccactgacagcgaaaacgggactccatggagccacgttgggatgtgtcatacaatccggagtctgggggaggatccaaggcttctgttggtaccaatatatgtcacgtatacttgagctggcactgcaggtcatggtgaccctctcccctggagatgcagaccatgattgctggagactgggtgagctcaatgtcagatccggcaccggcagagccacctccggctgaaccggctccaca

SEQ ID NO: 621771 - DNA, 418 bp, Homo sapiens
agcggactgtccggtggtgcccaggaggagtaggagcaggagcagaagcagaagcggggtccggagctgcgcgcctacgcgggacctgtgtccgaaatgccggtgcgaggagaccgcagggtttccacaaccgagagggagctgtcaggttggctccgcgaccccagtgcatggacagagcttgcatatgggaacagatacactgtgaccctacaacaccggattccaacaagaggattcggcaattgcagatgtccggaggcagcacgacaaaccccacttatgaaaatggagaaaactgtctaatttgtcatttctgatgtgctcccggagtgggacctgcatgatggcgctgcgtccaagcacaatgaccagagtggtcatggtcacatggaacacccacatggaaggaactgtc

SEQ ID NO: 621772 - DNA, 409 bp, Homo sapiens
  misc_feature (398)..(398): n is a, c, g, or t
ggagacagaatcttgctctgtcacctcgccccgggtggggtgtgggtggcacaatctcagctcactgcaacttccacccttccggatttaagcgattctcctgcctcagcctcccaaagagctgggattacaggcgcccacgaccccggctaatttttcttttttaagcagatacaggctttcaccatgttggccaagctggtctcaaactgctggcctcaagtgatccacccgccttggcctcctaaagtgctgggattacaggcatgagccaccacatctgggcattattattaaattttattgacaatacacatcagtcaagttatgggaatggggagatgttataaaaggtgttcccataagggaaagaaactgaaatggcatttgaatttgantctggcattga

SEQ ID NO: 621773 - DNA, 180 bp, Homo sapiens
gaatctgacgtcccgctgaggtaccggaagactacgtgcaggactacatcttaacacagcggaatttcctcctattgatcaactcgttaggcagcaaggacgttctctatcgtgtgctgcgtggacattcatgcatgctatcttgtgcgcaagagccctttatgcctacttacacgccag

SEQ ID NO: 621774 - DNA, 828 bp, Homo sapiens
gacccggagccggagcctgggagccggggctgggccgcgggggtgtagggaggagcccgggcctctccggagaacagaggctgcagcagaagcgaggaaaagccactagccccgatggatagacgtccgcgggaaacgcacgagatactgcgtgtggcctatgagggctcggacagtgagatagaggtgagggggctgtgcccctctaggtgccagtctgggaggccccaggactggctgcaacaggctggtcaacatccgtgtccatgaggaacaacaaaggatgtcaccttgtgcgtaccagtctggtgtgactgagcatctgtctagtgacctcacagtgtctccctcctcaagaggctacagctggtaccaggatgcatgctgttcacatgagtgctctccagccaaacgaaagaccatgtgacaggtcgggcgccatgcatcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagactctgtggccgagctggtggcgctgccgggtgttgggcccaagatggcacacctggctatggctgtggcctggggcactgtgtcaggcatttgcagttggacacgcatgtgcacagaatcgccaacaggctgaggtggaccaagaaaggcaaccaagtccccagaggagacccgcgccggccctggaggagtggctgctagggagctgtggcacgagatca

SEQ ID NO: 621775 - DNA, 168 bp, Homo sapiens
cagggcttggtgtacaatggtgaggcaggagtccgacggaggttagttagtaggcaatagagaatgattaaggatactagtataagagatcaggttcgtcctattatagttgtgtataggttatcatttgtttatgaggttcgctattagatatagtacatatgttgg

SEQ ID NO: 621776 - DNA, 375 bp, Homo sapiens
  misc_feature (11)..(11): n is a, c, g, or t
  misc_feature (32)..(32): n is a, c, g, or t
  misc_feature (68)..(68): n is a, c, g, or t
  misc_feature (195)..(195): n is a, c, g, or t
gctctggtagnaaaaacccagtccccctaccnccctagagaatgccatcccgtttccccccacctganatggtttggctgtgtcccccacctaaaactcatcttgaattgtagctcccataattgcccatgtgttgtgggaaggacccagtgggagataattgaaatatgggggcagtttccgtccatactgttnctggtgatagtgaatagatctcatcagagctgatgattttataagaggtttccccttttgcttagttctcattctctcttgcctgccgccatgtaagacgtgcctttctgtcatgcttgtgaggcctccccagccacgtggagctgtgagttcattaaacctctttttctttataaatta

SEQ ID NO: 621777 - DNA, 427 bp, Homo sapiens
caaagtacagttctcctcagttctaggaagatgttagtgccaccacatcaaaccctaaatatctcctgccagctttgggggcatctataagttgcacacctccatttctccccaacctcacatcctcctgccaaacatgggtctttggctttagccctttctatgtcttgctcttctccaggcctcagcttataatctacctcctgtaagaagagtgtatcaatggaagtacttagcatgtatctcctgaccattcctaccatattgattttctcttccctttaggcattaaccatctgtgaagttgagctcttaaaaaatatgattgtttgcgaccagcctgggcaacatggtgaaaccccgcctctactaaaaatacgaaaaaattagctgagcgtcatagctgtgtccctggtgttcccagcta

SEQ ID NO: 621778 - DNA, 536 bp, Homo sapiens
gctccacttggttcctgtgcttgtagggcattacaaaaaatctttacccaatccaatgtcctggaaagtttctgcactgttttcttttctttttttgagagatgggtctcactctgtcaccccggctagagtgcaatggcgtgatctccgcttactgcaatctctgcctcccggattcaagtgattctcctgcctcagcttcccaagtagctgcgactacaggcatgggccaccatgcccagctaattttgtatttttagtagagatggggtttcaccatgttggccaggctggtctccaactcctgacctcaggtgatgcacctgcctcggccttccaaagtgctaggattacaggcacaagccacagtgcccggctaggtagaagtttagaagagttcattaagactctgccactcggtggatttgtaacatgtattaaacattaaccctctctgggcctgagtttctctatcttaagatgaggaaaattggtgaaataatacctaacacacttcctagctctaactaactttg

SEQ ID NO: 621779 - DNA, 222 bp, Homo sapiens
ggctcggcacccttcaacaacaagtcgccggcttcatcaagaatagacccttaagggctgcggcatactgcagcattatggtcacgaagagcgtcggtcgcaggaccggcgctttttgtttgtctggaacgccgataacatacgggcgttcggggtaaggcaaagcaaggcgtcgatccacgggggtcgaactgatcgagaagcagactggttatgaataga

SEQ ID NO: 621780 - DNA, 787 bp, Homo sapiens
  misc_feature (538)..(538): n is a, c, g, or t
aggagctgctggcgtggggagggttcgaggcgattctagctctatcttggatgatcgaggctgcttgcatcgaccgtctgtggaagaaggtccgcgtataatgcaactaggatgatactcatgttgaccttaagtagctgcttgcctccctaactgttacctgttggaacatgattgtactgaagaagtgtgcactattctgaaggaccacatgcttgtggtgaactatgtaatatcacgttgggatgatcctgtagctttattatgactagatgagattccttatcttcctgtcaagctttcctctacgatactgatcctacacactgagatagttgcttggtcgaaaaaactcacctctacaaagacttagatgcttcctagaaccaggcgacctgcgactccttgtcggtcgccttggaccagtactctctagtgtagagcaagtttatgtatgcggtacatatcaagagctattgggctcatgagctgtatagagaggaggcttacaatcaaatggacgtccgggttcaacgtngtgacttggaaaaccctgggttttcccagttaatttggttgaagaaaatttagctttggcagatgtattgattgggaggaagtcgaccctattgccttataacctttttggggttgatggcaattaaaagttcagggttataatttgggaaaagggagacaaattggtgcaacaaatatttttgaaaaaacccctttcggaaggctttttaaaagaaaaaccccgccggttcagtgtgtcccctcgaga

SEQ ID NO: 621781 - DNA, 173 bp, Homo sapiens
tgcttctgctcccaggatcagcgattctcctgccagctcactgcgacctctgcctcccaggtcaagcgattctcctgcctcagcctgcttcctgcttctgccgcttcctgcttctgcaaaatggctgcttcctgcttctgccgcttcctgcttctgcacctctcatgtctcct

SEQ ID NO: 621782 - DNA, 177 bp, Homo sapiens
gcttttcggaccacggagcgacagagcgagcggcccctacggatcgtcggcggtcccggcggcccgagatgttatctgggaagaaggcggctagccgcggcggctggcggttgcagcggcagcaaccgggactggaggctggccctgggacagtaggcggttccgagaacgggtctg

SEQ ID NO: 621783 - DNA, 845 bp, Homo sapiens
gttccaacaaatataaaagtggaagggaagaataggggcacggcattcattaggctatttctgatcgcttcagtgttataaacttacaacatagaggctgacaacctaacattacaatggctgtagacacaagctctttgtgcctattgaccttgtatgtgtcatgtcgccacagggatctcatggaaccatgcatcaataaggggtttgacaccacaggattattccatgcattacgttggctggactagaataggtatttcgcgaccattcgaagcgagtctggtaagcatagggattcgttgagacccctgtgaatagagaataagaccgaaccaacacaacaagagactaatattcctagcagcatgtgagtagggaatatgcaagattgcgtgtgttagaacagattctgtggtgtaagagtgttcatggggcgtgtactgacaactatcatgattatgtaacgctgtatatctgaattgtgggtgaacacatatgggaactggtatgtggaacctacattggtgtagggacattctaaaagttatgttaaaggattctaatcttggctggtagacatcttgttggtgaaagattgtactcgattcactgcatagacatatatacattaattgcacagattgttttagacaattgtatttgtgttcaagattcgctacagggttagatttgggtaaaatagtaggtgtgcgcgaagataatagtgctggtctaaatcatttaagcataagtagattagtgtaggtagttaggtactagtacggtaattggttcaaagatgaggttcgatttaagactaatgttgatgtgaacttgaaagg

SEQ ID NO: 621784 - DNA, 289 bp, Homo sapiens
  misc_feature (63)..(63): n is a, c, g, or t
  misc_feature (78)..(78): n is a, c, g, or t
  misc_feature (100)..(100): n is a, c, g, or t
  misc_feature (128)..(129): n is a, c, g, or t
  misc_feature (158)..(158): n is a, c, g, or t
  misc_feature (172)..(172): n is a, c, g, or t
  misc_feature (222)..(222): n is a, c, g, or t
ccataatgttcttttttatgtaaaaagaagaacttggagacattaacatgaaaaagtcttttntcattagctcatgtntttgaggaagagcagctgtctntttatatgttttttgcaaatcatattgnnttcttttgtacaaaaaagaactacttgtnttctagaagaaatntgaaatgcttaaatttataagcgggctggagattctttccaatattgtcnctttggaaaatgaaagggggatcatctattttagttttggggtctggggaacctttttggaaaattt

SEQ ID NO: 621785 - DNA, 250 bp, Homo sapiens
tactgtggtgtacctgtcacacctataacggtagctcataacgccttgttaaacacacccccacggtctacagcagtgataaaaattaagccatgaacgaaagtttgactaagttatattaattagagttggtaaatctcgtgccagccaactgtggtcatacgattaacccaaattaatagatccacggcgtaacagagtgtttaacgaaacacaaaatcacactagagttaaattataactaacgctg

SEQ ID NO: 621786 - DNA, 646 bp, Homo sapiens
agctggccgaggaccccaggagcgttgataaactaaatgacttaagcaagttcaggactcctctttatttttatttgtagagacaaagtctgttctgtggcccaggctagtatgcaggtgtgtgatctcagctcacagcaacctctgcctcccaggttaaaaccattttcatgcctcagccccctacagtagctgggtttataggcatgcaccaccgacaccgggtctaatttttttattttaagatagagatgggatttcgccacatgggccaggctagtctcaagagctccgggcctcaagcgatccgcctgcctcagcctcccaaggggctgggattacagacgtgagccaccagcgccgggcctgtctgtataacctcagaattacttggtacctcacaaatctcaagtactaagtactgagatcttggttctccccctcaccaagtcctttggaagtcacacagagaaatttcttgaatttgagagagaggcgtatagaatattaataactaatgtttatggactggttattctgtgccaggtactttgagtactttatgtaccttatttcacttactgtctaggacaatctagtgagataagtaatatgatctccatttattaaaatattcccattttag

SEQ ID NO: 621787 - DNA, 808 bp, Homo sapiens
ccggtccacggtcccacgctgccaccctgtactgactcgccacctggtcttgtgggcagactgctgatcagatgttcacctcacccatgcccctggagctgggtgcagagtggagaacccaggcgtgctcatgggcggctgatacacacccgcccgacatgcaccaccagcccagacggtggctgtgtcatcatccccctttagacaccggggaacacgcacctgcggctactggctccacatatctacaccgccatcatatgaggccggcaagactggctgcagctacaggcgtcattatgtcatcaacgcaagcatggtgaggacaccattcaacgccgtggccaaagcatgcttacagtgtgggcttccataggaggcagcgtgaaggagagatgccagcctactgacatgcattcatcatacagcgagatgtggccctggatccccagtggaatgaccgcagacagtatagccagagtgcgtagagacacagaacgccgaacagcattttgcacatagaccatatgtcaacaaggttatggcattcactggcattcacctaatgcctggaatacatatggaggggtgtgatcaggacctgcgcaaggcgatcaggctgtcgtggagaatcaatggctatcaccaatggagtaactggggcatgagcgtggcacgatgtgtacatcttcgagcagatcctacctgattgtgtcaagaactagcaccaagaagtccaaactgacgctacacatggcacaacgaacgggaaagaaaagaaaccacacctcaggtcacgcacagaaca

SEQ ID NO: 621788 - DNA, 386 bp, Homo sapiens
tcccggtgctgcacatagacactcatcatgattcggcaatttatcaactttgcagtctcccacctccagagatgcggaaaggggctgcagactttgtgtcattaatccatcatgcctatgctctcctagacattatccgtttactatagagttcaggcagcttcagggcttggcatacacttttgaattgttgccagggaaaggttacgcacttctagactttttgacagtcagctcatcgtcctgtgcttccggatcgctttcgtggactcttgcccctagggtaccccgttcacttgtggcctcgttgttcattcatcgtttcctttctgtggccagggtactcgatgctcaaatttccgttagtcagtcagtccatagccttg

SEQ ID NO: 621789 - DNA, 300 bp, Homo sapiens
  misc_feature (294)..(294): n is a, c, g, or t
tcggagacggggtctcactcggctgagcgcggggtcagcctcggtcttgcccaggctggagtgcagtggcgcaatctcggctcactgcaacctctgcttcccgggttcaagtgattctcctgcctcagcctcccaagcagcagggactacagacacgtgccaccacacctggctaatttttttatttttagtagagatggggtttcaccatgttagccaggatggtctcgatctcctgaccttgtgatccgcctgccttgggctcccaaagtgctgggattataggcgtgagancggacg

SEQ ID NO: 621790 - DNA, 81 bp, Homo sapiens
ctccaggcctctcccacctcaggccccactcccccatcgtggggtctgtgtagccttcgctctagacatagtcttcctgca

SEQ ID NO: 621791 - DNA, 421 bp, Homo sapiens
cctgtagttcctctatatacatagagaatgcaaaaagaaaataattagcaagctatcctatatatcttgaaagcaatctaataaaagcgcattatcacatttatttgaaagttatttggaatagtctttttaccatatctactttacctatataaagaaatggtaggggaaaaacatctggtataccctatagtgttttactgtagtcaaggtaatataatagaaagaacacacgtaccctgggtttgaatcccaactgaaccacttaccactgttaccttaaaggaatgtaatatcttgtgaactcatatacctacctttatgaaattagagatcatactgactctgagaggggagaattaagtcaaatgacattgtaaagtgtcttgcacagagcttgacacataggagaactcagtaa

SEQ ID NO: 621792 - DNA, 720 bp, Homo sapiens
ggtttgcaatagattagtattcccgagtgaagcccccattcgtataataattacatcacaagactgccttgctactcatgtaggtgtcctacattaggcttgaccgagagcatactacggccagcggccctgaactctgcgcgccaaagctcattttttttgtctcttgtttagatttctgtgctctaagaaacagtaagaaagaggcccgaaataaacctataattccccagctactcgacccacgcactctacctttcccacatcaccccgtcacctctttatttcctcgtttttctttacgccaacaagccccttccttgtcgctgtttcggcgatgctgtcccgcgccactcgcccctgcatttggcagcctatactctgctcctaggacgtaggttgatcaaggtgcgatgagagtggagacccttgtactttccgatactatacgcgaatgaacgtctcgccgctgcttcccattgaggaagtatgtacaaagcccggatcgcgtccccccgtctcagcccaccgaggacaccgaagtcccagcgctctgtccatgcgttgtaatgtccgaaacgatgtgggaattctacgactgaattgctatattcgtacttgaactgagaaatgtgtcttataccattgatgcacttacgtaccgccccccgctctcacgtttcaacgcccacctgtttccctctcgtgggctaggccctg

SEQ ID NO: 621793 - DNA, 471 bp, Homo sapiens
  misc_feature (460)..(460): n is a, c, g, or t
ggaatgactcactgggtgtgtggcacagtccatgcttttacccatatttgaccagaagaatgcccacttgccccagttagaagtagatagagtgtttggttctcatgtgtcacatacctaccagagttcctccccacaatccaatcacaggtggaattgcactccttgtcaaatcccttcttaatataacccgcaatgcccttctatatgtgtgtatttctcaagcgcttaagtagcgcactccccagagtcctgttgcatctcttccacacatgtccgctatttttgactcacgcccctttgcgtgtcgacactatgtgtcaccatatgtggcacagagcccctgtgagagaaaggggctcgtgccccgatctcgcacgcgtgtcttcctaggaggactccttcgtgcacagtaatttcctacaagcgccgggagtgatacctactagctgactagcantcgcgccgcaa

SEQ ID NO: 621794 - DNA, 190 bp, Homo sapiens
tgatacaacccacttgatacaacccaccgtcagacccgatacaacccaccgtcagacctgatacaacccacctgatacaacccaccgtcagacctgatataacccaccgtcagacctgatactacaacccaccatcagacctgatacaacccaccatcagacctgatacaacccaccgtcaggtcgacgc

SEQ ID NO: 621795 - DNA, 159 bp, Homo sapiens
ccaatcacgagctgactctgatataaacgacttctgagaacgccgaatgcacacagactcttgagctctgcgaggaacacctattccggccaaccatgtccatagatcgcttaggatgctctacctaggaaaacgcagacgctgacctgctacgatctt

SEQ ID NO: 621796 - DNA, 144 bp, Homo sapiens
  misc_feature (84)..(84): n is a, c, g, or t
  misc_feature (112)..(112): n is a, c, g, or t
  misc_feature (116)..(116): n is a, c, g, or t
atggacacagagtaagaccagccatagaccaaaacaggaaggaaaaaaaaaaaagaggctcattgaaacatgaatcgccacccnctcctcacacattcttaaaatacacggngatnctcagacatggaagagggaagggtacag

SEQ ID NO: 621797 - DNA, 186 bp, Homo sapiens
gttgcacaggcgagcgaagtgcccaggagtcatcccaggacagattgacgccatctagctctttcataccaaaataatgtgggaacattctttaggattgcaaaggaatcagaaatacatcctcattaaaaaatataaagggacgggcgcggtggctcacgcctataatcccagcacttcgggagg

SEQ ID NO: 621798 - DNA, 147 bp, Homo sapiens
tagtttcttcttggtaaatatcctattggtgggggtaagattttactatatcttaagtttaaaattctggctgtgtagactctggcagctcgctctatggtgacgaaacaagcttttttttttttttttttttttttttccaataaa

SEQ ID NO: 621799 - DNA, 477 bp, Homo sapiens
tagttccagtctggacatgtgcattgtcatgaaattttgaagaaattctgtacttatgccagtgtaaggaatgttcccccaattatctctgaatggttaataaaaggcagaatggccagtgtatatgcagagaaaacaggaatgctggacttctgatcccacccaggggaacacgttcaccacaaggcagatgagtgtccagaagaaggccacaaggcaggtgtggaacaaaaagaaggaggaggaggagaaggagatcaccttgaagtcgggcatgggaacgagtcaccattggagttctctgagcacagacagctacaacatagcaagccgaggagacactaaatgcaagcaacccaggatgtgttgctgagaaatggctaagatagcatagagggttaagactatttgttcaattgttgtgcttaaagcttgttgaataaatctataggtctctatctcaattatttgggaata

SEQ ID NO: 621800 - DNA, 251 bp, Homo sapiens
ccccccccccccccttcccccctcccacccgggcagctttggttttgggggggtggggccctttgccttccttaaatgttggcagccccgtgggccccccctccggccctttggggttttccctagtgtggcccaatccccccctttttttgggggggcccctttttttggttttggggtttgggggggtcccccccccccggggctttcccccccttcgggtggggcaatttatttgtggggggcgggga

SEQ ID NO: 621801 - DNA, 416 bp, Homo sapiens
  misc_feature (348)..(349): n is a, c, g, or t
caccactcagagataagtaccgtatttctgtgtatccttctattaactctttacttctgttgccttcattttttaactttaataatgctactaaaagacaatacctaaaagtaactgtactaacaaagtgctaacaatgtgaaaatatatagtcccatagtcatgtcccctatattaatactcccacagaagaaaaaattgcaaaacaaagtctgatgtccttaatctattaacatatttaaatgatataatggttcagttttccatgaaagtaaaatcattagtgggaagtaacgtgttttaacctatagttctctctcccttaattacgacacacacggcatggcnntgtcagcctgcttgctattcctcaccgcttcttaagaaaaatcagttacattattgatattttttaa

SEQ ID NO: 621802 - DNA, 200 bp, Homo sapiens
gctgatggaaacgggactcagaaagttgtttactgaaatagaagcaagagtgttagagtgaagtccaagtttctcttcacagaatcagtatgtccagtgtgtacagctctcttcagttcttcgattctccagttattagagtttagcttcctggtactctttgcccgcttacctctagtttcagtaaacacatgtttcct

SEQ ID NO: 621803 - DNA, 115 bp, Homo sapiens
  misc_feature (79)..(79): n is a, c, g, or t
  misc_feature (87)..(87): n is a, c, g, or t
ctcagtgactctggcttctatctctgtgcctgggacctgggtgacaattcacccctccactttgggaatgggaccaggntcactgtnacagaggacctgaacaaggtgttcccac

SEQ ID NO: 621804 - DNA, 223 bp, Homo sapiens
tcacagactggcctggtgcccacgccaagttctggcgcaagccagaggctgtcagcagacagatgccaggcaggcctggtggggtccttgtgggacatcggggtctccccttctccgggctcgcgtgtggtgactggtccagtgacgggggatgccgtgcacggtaggggcagtgcgcgacgagtgcgcggtgccttatacgctccttgacagcgatgtatga

SEQ ID NO: 621805 - DNA, 678 bp, Homo sapiens
  misc_feature (484)..(484): n is a, c, g, or t
  misc_feature (596)..(596): n is a, c, g, or t
tgtaattcggcacgaggtgattctggcctcatcaaatgagttagggaggattccctctttttctgttgattgggatagtttcagaaggaatggtaccagctcctctttttacctctggtagaatccggctgtgaatctgtctggtcctggactttttttggttggtaggctactaattattgcctcaatttcagagcctgttattggcctattcagggggtcaacttcttcctggtttagtcttgggagggtgtatgtgtcgaggaatttatccatttcttctagattttctagtctatttgcgtagaggtgtttatagtattctctgatggaagtttgtatttctgtgggattggtggtgatatcccttttatcattttttattgtatctatttgattcttctctcttttcttctttattagttttgctagtggtctatcaattttgttgatcttttcaaccggctcctggattcattgattnttgaatggttttttgtgcctctgtctgcttcagttctgctctgatcttaattatttcttgccttctgctagcttttgaatgtgtttgctcttgcttctctagttcttttatngtgatgttagggtgtcaattttagatctttcttgctttctcttgtgggcatttagtgttggtttccctttacacctgctttt

SEQ ID NO: 621806 - DNA, 292 bp, Homo sapiens
aagctggctttcgtcggtgggggcttgaactagggatagacgcaagcctaggtagttcagattctgtatcgctgagaactatgtctcattctagaacattgtcactactgttcgagctcgaccccattacgctgtttcaaattgtgtattttttactgtattctataattatattttgttcacactaatatcaaatcttgctctccttggtttgttgtgctgtctcagtccgacgtttacggacgccagctttctccctctggggtaccttggtcctaaatgcctcctgcat

SEQ ID NO: 621807 - DNA, 708 bp, Homo sapiens
  misc_feature (20)..(20): n is a, c, g, or t
  misc_feature (70)..(70): n is a, c, g, or t
  misc_feature (91)..(91): n is a, c, g, or t
  misc_feature (136)..(136): n is a, c, g, or t
  misc_feature (164)..(164): n is a, c, g, or t
  misc_feature (194)..(194): n is a, c, g, or t
  misc_feature (217)..(217): n is a, c, g, or t
  misc_feature (225)..(225): n is a, c, g, or t
  misc_feature (237)..(237): n is a, c, g, or t
  misc_feature (243)..(245): n is a, c, g, or t
  misc_feature (248)..(248): n is a, c, g, or t
  misc_feature (255)..(255): n is a, c, g, or t
  misc_feature (269)..(270): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (292)..(292): n is a, c, g, or t
  misc_feature (298)..(298): n is a, c, g, or t
  misc_feature (304)..(305): n is a, c, g, or t
  misc_feature (308)..(308): n is a, c, g, or t
  misc_feature (311)..(312): n is a, c, g, or t
  misc_feature (322)..(322): n is a, c, g, or t
  misc_feature (333)..(333): n is a, c, g, or t
  misc_feature (337)..(338): n is a, c, g, or t
  misc_feature (353)..(353): n is a, c, g, or t
  misc_feature (361)..(361): n is a, c, g, or t
  misc_feature (364)..(364): n is a, c, g, or t
  misc_feature (372)..(372): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (409)..(409): n is a, c, g, or t
  misc_feature (413)..(413): n is a, c, g, or t
  misc_feature (426)..(426): n is a, c, g, or t
  misc_feature (428)..(428): n is a, c, g, or t
  misc_feature (442)..(442): n is a, c, g, or t
  misc_feature (446)..(446): n is a, c, g, or t
  misc_feature (453)..(453): n is a, c, g, or t
  misc_feature (456)..(457): n is a, c, g, or t
  misc_feature (460)..(460): n is a, c, g, or t
  misc_feature (480)..(480): n is a, c, g, or t
  misc_feature (486)..(486): n is a, c, g, or t
  misc_feature (488)..(488): n is a, c, g, or t
  misc_feature (491)..(491): n is a, c, g, or t
  misc_feature (511)..(511): n is a, c, g, or t
  misc_feature (521)..(521): n is a, c, g, or t
  misc_feature (523)..(523): n is a, c, g, or t
  misc_feature (554)..(554): n is a, c, g, or t
  misc_feature (563)..(563): n is a, c, g, or t
  misc_feature (608)..(608): n is a, c, g, or t
  misc_feature (619)..(620): n is a, c, g, or t
  misc_feature (684)..(684): n is a, c, g, or t
cagggtgtcttctttcagtngctaccattaagcatacggcgtatccttgttcggccataaccacattcanccacttgttatatttcatttncagaaaagcgtcattcattgcactcggtttgtccaacaggagtgntatgcagagggttttttttgcaacattnaatgcgaagggcatttcctgccatcctggnaaaaggtcaggccgtagtgccanttaaatanagccaagatcanaaaatnnnggnggcattnggtctactgaatcnngagatncattcncgngnatacncggggnaaaggnnaangtnngcccttgggnaaggggtgggncatnntttaggggggcttcngaaggccncanacatctgngcngtgngngaaggaggcgcgttggcagaggtctttngatnacaattctatgcngngtcagctaggggtnagcngggggcnggnngcngatggtaaagacataccccngcgggncngtngtggttgagggtgggcgctngggagagtgngngaacgggaaccacggagggtgtccccactgnattcatacnatgtccgcacatacctgagctgcctttctaccagggacatttganataagcacacnnagtactgccagtcacatgtggtagagtgttcgctctgtaactgtgtgtggcaaagccaagatancctaccattccaataaaaaaaagc

SEQ ID NO: 621808 - DNA, 121 bp, Homo sapiens
ctacagatgtgtgccaccatacccaatcataattattattttaaagacaggatcttgctctattacccaggaggtcgagactgcagatgagagcataatcacgccactgaagagataccga

SEQ ID NO: 621809 - DNA, 406 bp, Homo sapiens
  misc_feature (125)..(125): n is a, c, g, or t
  misc_feature (268)..(268): n is a, c, g, or t
  misc_feature (380)..(380): n is a, c, g, or t
tgcctcaaaaaaaagacagacctcaacttttaagatgagatcagggaaaacaagtgagtcaaaaccctgttgaacactagcaaagcctttcccttttcatttgatgtattgtgtgtattaagacnccttttttaggctgggcacggtgtaatcccagcactttgggaggcggagacagaaggattgcttgagctcaggagttcgagaccagcctgggcaacgtggtgagacccccatctttacaaaaaatttttacaaattagctggncctggtggcacacacctgtagtcccagctattcaggaggctgaggcaggagcatcacttgagtctgggaggtcgaggctgtagtgaagcatgattgcaccactgctttctancctgggcaacagagcaagaccctgtc

SEQ ID NO: 621810 - DNA, 196 bp, Homo sapiens
  misc_feature (36)..(36): n is a, c, g, or t
  misc_feature (66)..(66): n is a, c, g, or t
tcatgaggttagtgaaggagcatctctactagatcnaacttcttctgagcttctcactttctcagnctgtctttgagtcaggcttgattctctctagctatgaagtctagatgcatcttcttctaaagaaggtggtttgtcttctagaaaacttgttagtgcagcgacttcaccaatggtctagtcagatcttctg

SEQ ID NO: 621811 - DNA, 271 bp, Homo sapiens
tcctgctgttggccatatcgctcatcatgttctattcactgcgtgtatcgccccgagttgctgtgcgataaccggtatttacacgcgatacgacgatgtcaacccacgatccagtacgactacggtaataacgagctcagctactaggcgacggcatacgctgctccccagtgcacgaagacgagaccgtcggcgcaccacgatgccagtgagtcgcacgcgaccccgcccccagacatcgtatagcatacatataacgaagttcatcaat

SEQ ID NO: 621812 - DNA, 1071 bp, Homo sapiens
caccatggagaaggctggggctcattggctgtggggagccaaacgggtcgtcgatctatgtacccctctgctgatgcccccatgtgcgtcttgggtgtgaaccatgaaaagtatgacaacagactcgagatcatcatgattgcctcctgatagaaaccaatggatttaagaacccctggacacaggatcattcactatgatagactttcgtgtagtcggttgaaaggactacactgaccactggtctgatgctcaatcactgtgacccgtagagacgtcgttgtgaatgggcccatcccgagttagaagggatgtgagtagatagtgcctgggagggtggtctccgaggaatagtcattccgcgtgcctctactaggctgctggcaatggctcggtgcgtggtagggtcctctcgcgtgacgttgaccttggagacatctcatcgtggcttggtcttcctgtgttccccacatagtcgagagcgtgttcattatgttgtactctagagctgccggctagaaacaaatctgggccaccaatatagactgaccactcacatcaaggtagggtgaaatgcagagcgttggagggctcatcgcgtactacctgcgtgatcggggtgactacttctgagtcgacgcaggtgtgtctgcctactgtagttctgacagttgacagccactcctgccatctttgacgctggggacctgatggttggccctcgagtgaccgcttgtgtccgagcgtgcttgatcctggttatggcaggcttgtgcgttaccaggaagagggtggtgcacatgcatgtgccacctgggcctgccagagggagtagcaccgcgtggaacgacaccccgggcaagatgggcagggcaaaaggtggagctcgatgggtggggaatccttgacggattaggacggcatggactgattcccgcctcaggtgcctgtaacactgtgaaaggggggggccaagacacggcatgttgtcaaaaaagaagcccggtgaccctataacacaggggaccaagagacgggagccgcaccagtgagggcgcaacggcaaaaagc

SEQ ID NO: 621813 - DNA, 421 bp, Homo sapiens
aaaaaacaattacttgctccagagttcactcatttgccctaaatatctagaccttaccccagagttaccacacaatgcatgctgtgtccctgcatcaccaaaatacaactcaaactcctcatacacactctgataaatagacatacctgacaatgtacagcttggcatcatagcaggactggctctacaacagatttattctacaacagacacactcaggctgtagagacacctaatctttctttaaggtattcagacccacccttttgggcacagtcacagatgtgatccaggataccctcacccatcccacaatactgatgcaacccacagcgtacaaacacatcctacagcataacactctaagcccacagtgctcagtgtcaggcacacatttgccatacagatttacttcacaccg

SEQ ID NO: 621814 - DNA, 354 bp, Homo sapiens
cccccggggaatgaaaatgggaagaaaaggtgtaaaaactccggcttttttttccttagcaaaccttataaaaatattggactggtaaaaatgatatgaagtgaattatttggataaagactaaaaataacacagtattgaatgcttactatgtgctaattacggctgttatgtacttgggactttacaagtgtgtaattctcacaatcttgaggtggatacagctcggatcactattttacagatgagaaaacggagtcacaaagaatttaagttaacttgctttaaggtcccatagcttaattaataccaatattgaatgatgtcattcagtagtatagaatgtaagtgcct

SEQ ID NO: 621815 - DNA, 238 bp, Homo sapiens
accgcttgtacatgttcttctgtgaataagtgcatgagaccatgtacttggcatcaggtagacaggatacatgtcttcctctgccatttactagctgtgcgacctcagacaagttagttcatctctctgggccctgtatgtactgaacaacttaacggagcatcttcgttggccagacactgttctgagccccagtgttgcagtactgaacacagtcctcttgatctccattcagcct

SEQ ID NO: 621816 - DNA, 142 bp, Homo sapiens
  misc_feature (86)..(86): n is a, c, g, or t
  misc_feature (117)..(117): n is a, c, g, or t
aagagttctgtggaagtctattcgtgggacaaagtccatatcacaaatttattgcctttaagtcatttggagaattggatcataanccattactggtggatctcactgttgaggaangccagaggttgaaagtgatctatgg

SEQ ID NO: 621817 - DNA, 824 bp, Homo sapiens
ggggcgcggcggagaccgtggggcccccggttgcctgcccctcgggagccaccatgtggtgatacccccggactgagcgaggaagaggaggctctgcacaagaaatccaacaagctcaagacaacgacacaggcattgctggctctgaagaacgcaacagtagcagcagcacaaccagcccaaggtggtgtcaaacgctcactatcagagcagcctgtccatggacaccagccaccagcaacagtagcaggcacaacgcagctggtgaagtcaggagcccaatcagtgccatcaaaggctgagaccaagaaactcaggcttcaaacgccggttctcgaaaccccttgaggggcacgttaaaggacccgagaagggaccagtccccacatttccaagccgtccagaggccgcatatctgctggatggctgacctgcaacgagtcatccagactggccccagaggacacatctctggtcatgaggacgttggtgtctctaggtgatccgacttcgaagaactaaggaccatgatgggcaggaacgcggcagagggcccaagggggctgtgatgggtcccccatcggaaaggttttgacgtggggtaatgaaagaactgtcggtggttgcccacttccttcagcctccccttcccctgaagccggcagcgggaccgtagcctgcgagggaacgggacagagcaccgagatcgaagcggatcgaaccgggatcgtacgagccactgacggacagggtccggaatcgcccaggatcacacgcaacggacaggctccacgggtcacacccgacacgcggacctcgcgcgg

SEQ ID NO: 621818 - DNA, 114 bp, Homo sapiens
cacgagggcgccccaaaccctcctcctgctgctctcgggagccctggaccggaccgatacctgcgcctgctcacactccatgaggtatttctataccgctgtgtcccggcccgg

SEQ ID NO: 621819 - DNA, 1019 bp, Homo sapiens
ttttgtgtccgtgctcttttttttctctcctttttcgactccccgtttttttgtgtgttctgttccccactgtgtttgtttcccccggtgtttatcccataccgttttttcctgtgggccatagtcttctctgggccccaagactcctgggcattggcccactgtgcgatctctgaccactgtggtagaagccccgattaggttcccttccccttttgtgcccctttggcccaggggtcccaaagtgggattttggttttatttttggccccgagttgcgctcctttagcccttgtgtttatccccagctcccaggacccctctcagtagtacctcgccagggatccaccatgtattgcaagccaactgcttcgaggaggtcaaggacccgtgcaccctggcagagaacctgggggccagtccgtctatttccctggagggcaaacccttttgagccccttttggccccctgcctggagcatttggccagcccctacacctgcccttgggggttccaggctgtcccccttctctgcccagaccgcgagggcctgtgggggatccccacccgggggaggcccaatcccttcaaccccacgttgcccaaccacgagccccccacccccctggagttttccttttccctccaatcccttgacggttttggccttccccaactgcttttgattttttgattccttttgggctgaagccagacccagttcccccccaggccacccccagttgtgggggagaccctgtattttttttaaccaacaatcccccattctccccacactggtcctcccccttcccactgctgcccaacttttaaccgcccatagtgaattctgtggcttgtctgtttagtttctgtgtataaatggaatgtttgtggagatgaacccctcccctgtgcccgcgctggttccttctcccttttcccccggtcacggctactcatggaacccggacccagtaagggaccttctgattaaaacaaaaaaagaccaataata

SEQ ID NO: 621820 - DNA, 248 bp, Homo sapiens
cggcacgcgcaaaaaaataattacttgactgtaacgcctaaggaaactgatctcagaggtaaggcacttttgcccagggcatagcgggagtaattgatggaccacagacttgaatatagtatcttaaagatccaatttcctatgctttccagtatatctagaggataaccaatatagattctgcctttgaattagatagctaatttttctgtggaacattatggattgatttggggcaagaatcttaa

SEQ ID NO: 621821 - DNA, 108 bp, Homo sapiens
taggcggacagacgtctaagcaggaaagctattgaggacttgcgctcacaagagaacactctctctgaccaccctctcctccctatcccatctaggtattggctctag

SEQ ID NO: 621822 - DNA, 151 bp, Homo sapiens
cttctggcattcctgtcaagtttctgccacggtgtcttctcctgggtctgttcctgcaagtctaggcacattccagccaacacaccacagcacgggcagcggcccaaggggtcccgcagctcgcacattcgtcacatccatggtccatcag

SEQ ID NO: 621823 - DNA, 145 bp, Homo sapiens
ggtcctgtgaaagggctgtcctactggtttgaggccttacagtattgtatctcacatttctcccctacctggggttggcggggacaggcactgaactactgtgagtcagtggtgacagaaaattcgtggcttcactactgctcac

SEQ ID NO: 621824 - DNA, 1210 bp, Homo sapiens
ccggctctttggggcgcccccccaacagatgtggcgcgcgcagtcttcttttttgtcgtggtggttccccccagaactttttccggtattcacaatcctccgcgacatcacccacatgtgtgttttttctgggagtaaccccttggggtaaagccccccgtctgctcctggctccgtccccccgggggtgccttccgaaacacgatgttatgcccttggcgctggcaaccacagaagccgttacaaatccggaagggaggtatatgtttgcccgatcccaccgcaagcccagaatgtgtgggccagtgtaatgtttggaaagccccgggttttgcccccagaccccccacacgcggcccttgcgcggacactttgtggttccacattgccccctaccgcgttgtggggtgatatatagttcacccgctcccaggtgtctttatccgggatatagggaaataggggcccacgccccttgccccacgcgaagttgagatggagaaagcgcttttgggggccacaaaatatatggtcccctgccccgcacatgtgtgtgagaagacacacgctacacacgggagaaggtgggagagcgctaaccacagagttatgttataagagaggttgaatagagttagacccacttgagcctctctcttggggagattctcgagatgaatagagaggagaggagaaatttgaaaagaaagcaccaagagagggggctaaaggtgaaaagagaactgttcttgcgaccacatattggagatccacacaagagaatctctccacaaaacaccctcgcacactcttgttgggccacatatgtcttgtccacttctctatctatagaattgtggagaacacctctgggagtgaatgagaccacgaatatgggcgagaaattaagaaggaggtggcgctcacgaagccacttcacagccacgaccgggcttatgttctcgggggctcacttctataacactagttccacgctgggaataccggagaattatagaaagcttcacaaataccacgtgtgtatgttgaaagatgataaaagttggaaccacgatattgctggagggagcacgatcacctgcttttgagggactatatgtgcacgtccctggaatgtggctgctttcaacaccagatttataaatccctcctggatcctggcatttaaacttaaagattgaaagattta

SEQ ID NO: 621825 - DNA, 152 bp, Homo sapiens
cctcatcagcactgcgcccgtcgcggaataccagctccacactagacctggcctcccacttggacccatcagtgtactgatatccgtcctcatggttctgcttcaggtaggccaggctcttccttcaggctcttcgatctgcatctccacgg

SEQ ID NO: 621826 - DNA, 384 bp, Homo sapiens
ccagctgtgatggcttggcacacacagtgtaaacgggcagtgtcaacacagagcagggcatgtatgcgtagttgagaacggtgaataggcagtatgaatcagaccagaagatagtcgggctgcacaagttttcgggggcacagtctaagtaggtctggtgtctggaatgagactggggcctcaataaaaacgagcgtctacacaggagctcaactgggctgtaccctgtcacattccgcaggacaggcctgcaattctgagacagggaaagtggtcaagagtcattgtccggtccttcttaggtggctagcagcttggtgaggtgtgtttttcaaacagcactttagtccattctcattttcttgcaagatggaggcacgtaag

SEQ ID NO: 621827 - DNA, 426 bp, Homo sapiens
cagcatatccagagcattgcagcgtagtatatccccgggggtgtcgcggagacagtggttaggttacgacgtacgggaattgcctctgtatttaagcctcatgtggggacagctcatgagtgcacgacgtcttgtgatgtaattattacaccgacctgggggcttcaattgggacgtacctactcgacttgtcacacgtcaacggacgtcgccggtcgcctggttctacggaactaatgggggacagtctgtacggacgttgaacgacttacgtccgccgatagtcggtgtactcgtcggtacagtcccacttggtggccactagatttgactggtaacggggagggactcgttgaccctcgtctgtaatgtaacggactgcgtacgagactggacgggcactgacggacctacggatgcttggcg

SEQ ID NO: 621828 - DNA, 235 bp, Homo sapiens
ggtgcgcttccgccccgtgttgcgctcccgttcactctcgactgccggggacaggcgggtatgggcccgacactacagcgccatccattttaaaggctaggttattcggcaggggaggtgagtacacactccttaacggattgcgacttacatggccagccacctgctggctatataaaccaacaacctttttgggatctgatgaacgcaaccaccgggggaggcattctagaca

SEQ ID NO: 621829 - DNA, 457 bp, Homo sapiens
caactaattgtgcaatgggggttagtcaatccactttaaccttgcatagccaacatatctctcgcctcttaattggccatttcatatcataattcctgccctaccagcttcagaagattaagtatcaagtgagataatacatgtgaattcgttttggacatttaagctgtgacaagatctcgatatgaagatttccctttaatattttaaaatgtgtactaacgtatatttatgttgtacttattcttgctgctgctactgctaattttaatatgctcagtttcttggtagatctagatgagcagtattcaaaatgtcatctttctgggaattagccatcattaatactattaatattcaagagaaattttctctttaataatttgtcaaataaaacagctttcactttttgacctctgaagccagagcttcggcataataaccatcatatattact

SEQ ID NO: 621830 - DNA, 341 bp, Homo sapiens
  misc_feature (5)..(5): n is a, c, g, or t
  misc_feature (73)..(73): n is a, c, g, or t
  misc_feature (99)..(99): n is a, c, g, or t
ttttngtgttattctatccaggagagctcatgaaggaccctgtcagtgtggggggcatccaaaacacattaangccagattcctagagaaagctgtttngccgaaacaaaagtgatgtctggtggcatcacaggctttctttaatccacttgggctcagtcgtaatggcaaagctaatgaacacagagggatatttgcaggataaaagcaattagaacaattatgagggtaattaactggcccaacacactcgtcaacacatctagcaggaccgccagaatctgagactccaaaacccaaggtttttcttttctgttgattccaaaatcctggatggattt

SEQ ID NO: 621831 - DNA, 963 bp, Homo sapiens
  misc_feature (1)..(1): n is a, c, g, or t
  misc_feature (106)..(106): n is a, c, g, or t
  misc_feature (146)..(146): n is a, c, g, or t
  misc_feature (189)..(189): n is a, c, g, or t
  misc_feature (196)..(196): n is a, c, g, or t
  misc_feature (283)..(283): n is a, c, g, or t
  misc_feature (320)..(320): n is a, c, g, or t
  misc_feature (355)..(355): n is a, c, g, or t
  misc_feature (387)..(387): n is a, c, g, or t
  misc_feature (484)..(484): n is a, c, g, or t
  misc_feature (490)..(490): n is a, c, g, or t
  misc_feature (540)..(540): n is a, c, g, or t
  misc_feature (546)..(546): n is a, c, g, or t
  misc_feature (578)..(578): n is a, c, g, or t
  misc_feature (583)..(583): n is a, c, g, or t
  misc_feature (591)..(591): n is a, c, g, or t
  misc_feature (625)..(625): n is a, c, g, or t
  misc_feature (649)..(649): n is a, c, g, or t
  misc_feature (674)..(674): n is a, c, g, or t
  misc_feature (720)..(720): n is a, c, g, or t
  misc_feature (763)..(763): n is a, c, g, or t
  misc_feature (770)..(770): n is a, c, g, or t
  misc_feature (779)..(779): n is a, c, g, or t
  misc_feature (796)..(796): n is a, c, g, or t
  misc_feature (800)..(800): n is a, c, g, or t
  misc_feature (824)..(824): n is a, c, g, or t
  misc_feature (829)..(829): n is a, c, g, or t
  misc_feature (832)..(832): n is a, c, g, or t
  misc_feature (847)..(847): n is a, c, g, or t
  misc_feature (851)..(851): n is a, c, g, or t
  misc_feature (855)..(855): n is a, c, g, or t
  misc_feature (866)..(866): n is a, c, g, or t
  misc_feature (870)..(870): n is a, c, g, or t
  misc_feature (935)..(935): n is a, c, g, or t
  misc_feature (937)..(937): n is a, c, g, or t
  misc_feature (944)..(944): n is a, c, g, or t
  misc_feature (957)..(957): n is a, c, g, or t
  misc_feature (962)..(962): n is a, c, g, or t
nggagacaattcaattgtaaatagaataagtataaacaaagtaactaggtaactccatattgctgagagaaaaatggaactcacattgtccaattagaatagtgtnctgcaaaaatatttataaaacttctcaagaaactgccacngtcattttatatgaagaaaagtgtatttttcaataaagcattnataaatnagcctttgtttggttatattgagaaaagggtagtttcctgcataaatggcaaagaacaatcatttattggtttattttgtctctccnaaacacataagtcattcatcattcaaataccggactncattagaaaccgttgtaacactctttctccctccngccataaaaatacagtaagtcatttgcttaanaaaaacaacaaaacactaggaacaagtgtcctggtttcttctcactgaactaaagacattcctcagtcattccagtctgtaaatcagtaagacagtncaggcnacaaatcagtccaggctgaagactgagaatcaaatgacctcccactcaanagtgcngagccatggaacctgccctctctatacctctncattncctaacanatatacaactgaaaccactcatttataaactatnaagtagtgctgaattctgtttgcnctcttagtttaaatgaatgcaactnacctctagcattatattcagaaaaatacttacttaagcctcaaggnccccaataatttggagttctgaactagaaaaccaccctaaganacttctnaaagaagtnatgcatttcttagaganaggnttccaaaccctgccgtcagaaccnatgcntanatggaaaacactggnagtnagtnattgttcacanagtnttactctccagggagtcctctgccattggtcagcctgaaccaggccagaatttagcaggaaagtncntggggcnccagaattaccanccctna

SEQ ID NO: 621832 - DNA, 842 bp, Homo sapiens
  misc_feature (19)..(19): n is a, c, g, or t
  misc_feature (43)..(43): n is a, c, g, or t
  misc_feature (52)..(52): n is a, c, g, or t
ggcttcattccaactcacngcccttcatgcagccctgcccccngctacactngccttccccaaggcatccttcccagctgcagggcctttttccatagtctggtcccacctgactagaacactttttctctgcatataactgtataactcccttcctcatctcctttatttagatctttgttcagatatcatcatatcagagtgtccatcattgactaccctttataaaaataatacttaatcatttgttattcccctttgatttgtttttatgacattgactgccatctcacatatatttgtgtatttgctgtctgacttctgccacaaaaatgcaaactttttgggagttagcactttgcctgttattcactgttgaatttccaaccactccaactgtacctgagacatgatctgtgctggaataaacagttatcgagttatcactaacaataaaccttagaaaccatttattatgatatgccagtgactgttctgggtgttttgtgtttactgactcatttatttcttgtaacatccttataaggaaattgaggcacagagaagtgatagctgacagtgaataagtggcatggcccaaattcaggcataggtgatctttatctagagcccatgttccttatgcttctctaaaaagaaatcatctctgtaaaatgctcgtcacaattcctgtcatacactaaatggacagaaaatgttagttgatgatcaccagcagcatcagaatgctggatgttaagagaatggatgtggagccaggctgcccattgtttcatgttgcccctttttccttatctttaatatgggagcttcccccaacc

SEQ ID NO: 621833 - DNA, 307 bp, Homo sapiens
ctagcttacctgttaaaaataataccttttggccaaccacactttaacgggttcataagaaaatcccccccctagaagtgcgggtttgaccctaaattccccggccggggtcctttttccaaaaaaatttttttaggaggtaatacccttttaatatttgatttaaaaaatggcctccttttacccctaccatgagccctacaaacaaagtacctgcccataatagttatgtcatccctttttttaatcatcacctagccctaagtgtggcctatgagtgactacaaaaagggtttagtctgccccg

SEQ ID NO: 621834 - DNA, 843 bp, Homo sapiens
taacagctttgtgttcttaattggcctctcccttgggcctaagggagggaccagcaccatgtccttctggaaacccggaaccccccagaggccaggaaggcaaggcctgggcccgccaggaacccactgcttgcaccactaggcttggccacggggaaacaccccagcacctctggctcctattgaggcttgaacgtgcctgcttgactcctgaccacaggggccacagtggcaacgcctgtgcctcggctctgctggcggcaaagtgttcccacggcctctcaccatgtggtctcccacgcctacgcgcccatctatagccacccacagccgccgcctccacgacgcaacgccgcatctacacacgacaagatggccccacccacgaacacacgcccaaggccaatgtgtcgtccccctctccgcagcgactcccctctctggtcgcccagaaaaaacaaaaaaactcttctccgagaactctccccataatcacatgagaaaaagctgtgcgccaagcgcccttcgtgcccccaactaaaagcgccgttgcacactgtactaccactcccaccacttcctactacttccacagaaggacggaggacaacaaccccttccccagtgggggcgcccactccagtagcggcggtctcccaaggcactcccccggagggatgcgtgcggaccgcttcccgtcgggacctgcttcctccaacagcggcgccacctctcacacacggggcgtcctctctctcccccggacaccctccttgtgccagcccggctttctcctccctctataccgccgcatccccagcgcccctcctctacaaaatcccg

SEQ ID NO: 621835 - DNA, 310 bp, Homo sapiens
cagcatcatctgcaaccatgtctgcagcctcacctacagccacatcttcaggtgactgtgtataagttgacgtgggcagagcttgatcaaaagtgggaagctgcactggtccaggttctggcacaaagggttccacaactgattgttccaggagctccgtgtccacttggggttgcaggtctccctgtggctctgccacagaagctagcctcagagccagattctcttgcattctggaggcatcctgctctgcagttgctgcacagtctttctcaagctttagctttttggcctcctgctccgtcgacgc

SEQ ID NO: 621836 - DNA, 206 bp, Homo sapiens
tccgtaacgagcgcctccgtaacgagcctccgtaacgagcgcttcgtaacagcgcctccgtaacagcgtccgtaacagcgcctccgtaacatcgcctccgtaacagccctccgtaacacccccgtgtctgcataaacgagcgccagcttgtggagtcaggggctgtaaaggagggttgtacacggagggcgtgttacgggaaggct

SEQ ID NO: 621837 - DNA, 901 bp, Homo sapiens
agagcagctcggttgccaagaacagtaaccctggccacatggccacacgatgctcagaaatgtagcgaccacagcaaacacaagcagccccatgagcactcgatccaagtccttccacgcacatgcccagtgacaccgcggcaagcccctgtacccccgtatgcgtccccaagcacaaggtcccataagccaggtgtcagtggaccagccctgtggtaacacaagcaaagtaacatccacacccagtgcccgtcaatacacaacctaggagagagccgcacagtaaaacacaagaatgaggggtgaacacgagacgcacgaatggcaggagtgacaaggaaatacaacctggactcagcgaaaggtagacagacaaacactgcacccaacagaaagacaaacagcaaagggcgatggaaggaacagaggaccacaaaggactaacaaaaaaagcaagcaaagcgaaatgtacaacaaaaaagagaagcgaagatagcataagacacacccacacccagcgcacacgccacacaccaggctttacacaagttaaccgacacgaagacagggcatactgccacgcaccccacggcgcaccgcctcaaaccaagaacaattccaaaccgcgcacaagtagtggcaggaccagggacaaagcagtgaaacggagatgacaccaacaacgacagcgaaccgaggcagcagcaactaacagcaagcacgaaaagcaacaggccgcagcaaatagacaacgaaccacattactgacgtagacatgaggcgagaagagggaacctcccacaatacacatagcgagtagcacggaagcaacagcacactgaacagcacaagcacagatcacagaagagcagcagaggagaggacccagccagagaaccca

SEQ ID NO: 621838 - DNA, 443 bp, Homo sapiens
gtctcagtaaaaaaaaccaatggtctctatgtgaaatgtggagagaactgagagtgaggtgtggcagaagcatgtgtcggagcctggaggagtgtgtggctatccggcttattctcagtgaagagatggtgctgtgcggtcaatgatgcagctgtaatgtgacctgtcggggagggaagggacgagggaagggagcagaaaacgagttttctaagaagggactctacctgagtgcacggctggtgtcttggttagcatgacacagaggtttagcatggcgtgtttctcttcaaagcctccaccagtgtcattcttcagagcttctgtgtatggatagtgcttgcaaaagtcttgcacagcactcagcccattgatgatatccttgtgttttccaaagtagatctcgtacagcgtacttctgatattaatataccattgtcctc

SEQ ID NO: 621839 - DNA, 132 bp, Homo sapiens
agtaaggaaaaagtaagaagaagacgaagaaacagcacaagaaacatagtaagaagaagaaaaagaagtctggatcaagtcacaagtcaagggtaacatcaagaaataaaagcaagaatgagtttgccgaga

SEQ ID NO: 621840 - DNA, 473 bp, Homo sapiens
gaaaggagcaccctgtggccaagcggggtttggagttcttaactaaagggttctgacagactcaggcctgccaaaagggttgaacacacaagttttgtacacattgtttaattaaatgatggggccgaatattccggcattcccacttggaccccccatccccactagtggcccaattcttgtttgtttgacagattctcactctgacccatgcacgcacacttctgctctggtcctggtcttatactctcatgttggagcgtatccaaacatgtggttttgattctaacggaaaaaccagcctactggtgcaatcccgccaagaaaatatgtaacagcgcgttagaaagagtttgactagccagacatggtgcttgtgtcaatttctgcaccccggggagtcattaatttagaggcgccgcatcgggtggagctacagctttgtttcctcagtgacggtgatttctagctcg

SEQ ID NO: 621841 - DNA, 128 bp, Homo sapiens
tcgctattgttatggatcacagcccaacacacgatcgcagtacgctactacgacgacggctccggcgcatcctcgctattaccagatgaatgccatcaaccgcaccgtagaggctgtggcgcgcggcc

SEQ ID NO: 621842 - DNA, 177 bp, Homo sapiens
ttctcatatagacacacgatacttactcagctgtgtaacaccagccaagttttaaactatactactgggtcttaagttaccacatctagaaatataggggataataacagcatctgcttcatgggttattgtgagaattatattatttcataccaaataactatttggaaacatata

SEQ ID NO: 621843 - DNA, 121 bp, Homo sapiens
tccgtgtcggggttggcgccactgggtacccaggtctttggcactgctgtgcacagctgctattggcgaggtgcatccttgtatggctgaaacgcagtgcatttatgggttctcacgcatc

SEQ ID NO: 621844 - DNA, 132 bp, Homo sapiens
atggtatctgacagcagcgttgatattgcggaacagctggagatgcgcactctctcagactacacatcagaagagtcaccctgcacttgtgttgcgcctcggagtggcttattgagccttctctccggcagt

SEQ ID NO: 621845 - DNA, 570 bp, Homo sapiens
aaatccgaatccaaggtttcccaaatcgtcccgcacatccacaagcacataaacggggggctggatgatgtccgatcgcgtataggtttagggactaaggtgatttatctttgcggtaaatttctattcgctatcgattgtcgttgtgttttaacctttaataaaagtatctacttatttttacggggaggagtaacgaggtttgagcttagcgagaagagggtactcgaaatagagttgaatatgatggtctactatttgcctccgattgtgtatacgggctcccggaccgctggtggcttcgattgtacgctctggcgcgagcagccgcctagggtacgctaatgtttgtttctagtggttgggggttgcgaaaagaaaggaggctgagggggaggcggctttgagccgggaatatctagaggggaagagggaaagacttattcttcccgttactctttatagtttggaacggggcgagttggggggggggtgtacgaccggtttcttaacgtttacttctctttctcctcggctcagctagccttaataaggtacgagtggtacctc

SEQ ID NO: 621846 - DNA, 482 bp, Homo sapiens
  misc_feature (174)..(174): n is a, c, g, or t
  misc_feature (249)..(249): n is a, c, g, or t
  misc_feature (256)..(256): n is a, c, g, or t
  misc_feature (293)..(293): n is a, c, g, or t
  misc_feature (332)..(332): n is a, c, g, or t
  misc_feature (338)..(338): n is a, c, g, or t
  misc_feature (340)..(340): n is a, c, g, or t
  misc_feature (350)..(350): n is a, c, g, or t
  misc_feature (373)..(373): n is a, c, g, or t
  misc_feature (384)..(384): n is a, c, g, or t
  misc_feature (462)..(462): n is a, c, g, or t
  misc_feature (466)..(466): n is a, c, g, or t
aattcgcggccgcgtcgacacggctgcgagaaagacgacagaaggggatcggcgctttgccacttgtacccgagtttttgattctcaacatgtccgagactgctcctgccgctcccgctgccgcgcctcctgcggagaaagtcctgtaaagaaagaaggcgggccaaaaaaggntgggggtaagcctcctaaggcgtccggttcccccggtgtcagaagttcatcaccaagcttttggccgctctaaanaacgtanggaagtttctctgggtgctctgaaaaaaagcgttggntgccgccggctatgatgtggagaaaaacaacagccgtantcaaantnggtcttcaanagcttggttgagcaagggcaatntggtgcaaaangaaagggaaccggtgcttttggttcctttaaattcaacaaaaaggcaaccttccggggaagcaaagcccaaggttagngggngggaacccttaaggcc

SEQ ID NO: 621847 - DNA, 464 bp, Homo sapiens
accataagcgcgttctggtcctggtgtcggaggtgcaccgggtgaagctctctgcgtcgtggtgtcctgatatgcgagcgtgtgaagcgctctgcgctctgtctgtctgacatgtgcacgcgtgttaagctctactgcgtgctggttgtgtgatatgcaccgtgtgaaggctctcgtgggtggtggttgtctgatattgcccgtgtgacgtgctgcgcgtccaggtgtctgatatgcaccgtgtgaatctctactgggtgttgggtgactgatatgtaaccgtgatgaggcgctctgcatcctggatggtcggaaatgctaccgtgtgaaaggtcgcgtctggattcctggtgtcttgaaatgcagcgtgttgaggctctcagcgttctggggtctgaaatagacggtgtgaactgctttgcgttcaggtgtcagatatgccctgtgtaaatcgctctgcttga

SEQ ID NO: 621848 - DNA, 338 bp, Homo sapiens
  misc_feature (294)..(294): n is a, c, g, or t
  misc_feature (297)..(297): n is a, c, g, or t
  misc_feature (338)..(338): n is a, c, g, or t
aaaaacaaaacaggatgggcgcggtggctcaagctataatcccagcactttgggaggctaaggcggatggattgcttgagctcaggagttcgagaccagccttggcaacatggtgaaacccgtcgctacaaaaaaatataaaatttagctcggcatggtggcgctcgctgtaatcccagctactcaggaggctgaggcaggagaattgcttgagccctgggaggcggagattgccatgagcagagatcgtgccactgaactccagcctgggcgacagagcgagactctatctcnaanataataataaccccccaaacccctcattataatttgaaaan

SEQ ID NO: 621849 - DNA, 447 bp, Homo sapiens
acgatgaggcagacgatataagtgatgaaaaccagagaaaaggtgaatgaccaggcaaaactgattgtgggaattgtcgttggtctcctcctcgctgccctcgttgctggtgtcgtctactggctgtacatgaagaagtccaaaactgcatcaaaacatgtaaacaaggaccttggtaatatggaggaaaataaaaagctggaagaaaacaatcacaaaacagaagcctaagagaggagcggattggatagcctggtggaggcttcgtttctgggatcccactgcaccgccatttcttcccagatttatgtgtataacttaaactggaaaaaaagaaaaagaaaaatatgactattagatttccaggtatagaactgtgttctttgagagggaaaagaaatatggtgtttccttttagacacaaacaataaaattattttgaaggca

SEQ ID NO: 621850 - DNA, 445 bp, Homo sapiens
  misc_feature (4)..(4): n is a, c, g, or t
  misc_feature (33)..(33): n is a, c, g, or t
gttnacctttggaaaagttacggactgcccctnggtgcctaaaaaattaaaatggtaaaataccggtttacccctgtttttgattgaaatggagaaaagtggcagaatcctgggaggagcaacccggagagaaattaacagcccaagttgacctgaagttctggtagtagaacatactggccccaggagaggtctaactcagagataaggggggagttatctgagttaggaaaaagtattctaatgaagactactgataagacaaggtttacagtaaactgtggttgatatcaagtgaatgttattgagaagacatcaaattgcaccatagattttatttgctttataacgcaacatatgactttcctgtaattacttaatgcctcctagatgttaaattcagcacttttgtgaatttttttgtttaaaaataaaaaaagaaaag

SEQ ID NO: 621851 - DNA, 124 bp, Homo sapiens
tagatcgagctggtaccgtacatgacatctgcaggaacattcagtcggatccatcgttggttagcttgctgcacgggttgtaggaaatgtctaatttgtaaatgttaatagatacctgtggaac

SEQ ID NO: 621852 - DNA, 1285 bp, Homo sapiens
ggccatctatcagcttggcgcttagaggttggaggaactcgacggagataccaagaagatgctggccttggtgactggaggcctgggggagagctggcagcgtgtttccttgtactcaatggctaccttgaggacctggcagacatacggatatggatatcgcgtctatgaagtttggtgatcttattcaatccatgcacagattagtcgaagtggctagtgcgaggtaggagcgaggcgcgatagactgtggctgacgctaacgtgacaaccccctgcgggagtaggaggcgcggctcctgaggtatagtgcgttccctgtgctagcttcttacggaccgccgtgagtagacatgacacccacagaagcggacgattgaacggtgggctggacatcaaccaggttggtcgctggtccagtagcccatacgtaaatgccccagatgccccgtgcgtacgaaggaaatcaaaacagcgccggttcaacacccactgacggcgtgatggctcccgtccaagggcttcccgaaggaacgtctcaagtctggcaggacttctaagcgttggtgagtacttaacatcggaggtcggctccatgggaaccgtgcaaaacgtctgtgcatgcagagagcattcctccatggggtcgctgatagtcgcagagactggaggtcagcttcatattgcacgtgcgcaaagcgcagcatgccggtgcattgaacatgacaaggaaggttactttccagcagaggtggggcaccgcgcacggactacccagggactaatcaatcccgggccgcttttccaacggttcgctcccaacagttcgggctgcccgaggacccctttgttgaagaaacccgtaggttctgcggaagacggtttccccaggacaaagagtgggagccattcccaggcttgcaagcgaaacaacccaaaccgcctgggaccctcttcacccatacccactgaaggcttccattgccgagattccctgggagtgggcacgtcgccacgcacagggttggggacttggggggaccaaaaggcgccctcggggcgaagcagctcagcgcacacgcaaaaggagcccttgatgctgttacacacccatagcctaacaaacctgggtcgcattggccctgacgggccctttggaagcgaccttggcgcccggtggttccccctggctacgcaagaaaggacttctttgtacggagggaaccgtgcgaggactaatctatcattcgccctccaaccctatgcgagcacctgggagcccctg

SEQ ID NO: 621853 - DNA, 449 bp, Homo sapiens
  misc_feature (41)..(41): n is a, c, g, or t
ttccactgcatccaggcgagagcctgcctttccacagtgtntactacgaggatgagtacgatgacacctaggatggcatccaggtggtccccaatgatgcggactttgatgacgagatgatcacccgcaggccattcaccatcctttaggtcctgagatccaaagtgcctagagaagggcaggagaaggatgacgacgttgaggaagacgatgctgacgaggagcctcccaagcctgaccattttgttcaggaccctgcagtgctgagagagaaggcagaagccaggcgcatgccctttttctccaagaaagggcaccggcatgacagctcaacagcagtggccggcagcccccgtggccttgggcagatccgcgagacaacccagcgcagacctggtgtatgtttgtttgttggcctcacgcttgcacaatgaaggcttgttcacaca

SEQ ID NO: 621854 - DNA, 154 bp, Homo sapiens
cttcggcatctagtcagttgaaatcgccattctctcactgagagaaattgccaagagagaaacatcacgtgacccctactatgtgcctagagaaggaagtgggtcaagtcctatactaggttccttacttagggtagagacctagtagtccctt

SEQ ID NO: 621855 - DNA, 484 bp, Homo sapiens
ttactagaggatccctgtggagacggggtctcatatgaggcatgtaacgatggagctgtgcctgtggaggtgttgtgaggcagtaggtcatctgcggagatgccgtgagtagggtatgggctaaataggccattgtgagtcatgagcttggtctgtagaggctgactggagaaagttctgggcctggaaaggctgccgggaggtaggagctcctgctgtgtggctccttgcggctccatggctcaggggttggggacccctgctccaagtgcactcagaaacgacccttctttccacaccagtcttcacaggtggtcacgtgcagcaaccactttagctcccaaggcatgtgcctcaagatttcgttgtcacccctctgggaatccatgtatacaaaaattgcaaaatataaggtggggatatgtggaagcacctgtaggtctagccacgtgggaaggttgagatgggaggatcgttcagcctg

SEQ ID NO: 621856 - DNA, 139 bp, Homo sapiens
cctaaattatataatcttgctgaataataagatttcatcgtttggtgtgtatacttggggactttatatagaaacatttcatcggaaaatatttctaatttggatttaattcttttctgtgctataatatattctaggc

SEQ ID NO: 621857 - DNA, 285 bp, Homo sapiens
  misc_feature (107)..(107): n is a, c, g, or t
taggcggatcatgagcgcaggagatcgagaccattctgggctaacacagtgaaaccccgtctctactaaaaatgcaaaaattagctgggagtggtgacacgttcctngtaatcccagctactcatggaggctgaggcaggagaatcacttgaacccggtgaggcggacggttgcaggtgagccaggagatcactgccacgtgcgactccaagctgtgggtgacaggagcgcagactcgcatctcaaagaaagaacaagaaaagaaaacaagccagggcaagacaa

SEQ ID NO: 621858 - DNA, 114 bp, Homo sapiens
tgggctaagtaattaatttaattaatttggtaaagagggagtctcactatatggcccagggggggctcaatctccgggctcaggtgattctcggaaaggccagcacaagggggg

SEQ ID NO: 621859 - DNA, 314 bp, Homo sapiens
  misc_feature (58)..(58): n is a, c, g, or t
gcactgtgtgtattagtgattacgggatttatcagtaccaaactcggcagtgaatttncaccacagctcagtgaaggagactttgcggtacaacagttacgttcaccaagtacaggcttagaagagtctttacgtattcagaagaatactgaaaaacttcttttaaagagtttccctgaaattaaggcagtatttgccagaacgggtacagccgaggttgcaacagatgtcatgccacccaatatttcagatggctatatcatgttaaagcctcgttcagaatggccaaatcctaaagaaagtttagagggggg

SEQ ID NO: 621860 - DNA, 143 bp, Homo sapiens
ttcaatttctacactaaatttaagagattcaatattagagtttcttgtttctttaaacactacagagtgcaaatcaggttctgtcacaacagattgaatattgagcagttctttaagagaaacaaagaaactctaaaattgaa

SEQ ID NO: 621861 - DNA, 280 bp, Homo sapiens
ttagctactgtaagtacattcaacctttatgactaacatagatacgatggcgatcacagctattccacaatcataatggccctcagacagtaaacatatccttgtcttaaacttagtgccactgggcaaggcggctcatatctgtaagcccagcacttttagaggctgcaggaggatcacttgagcctagcgattttgactccagccgtgcgcctcataataagaaaaaaccaaaacaaaaaaggccccgttccatcctcaattgccttgggccttctcc

SEQ ID NO: 621862 - DNA, 686 bp, Homo sapiens
gcatcaagtactccttcaccttcgagctccgggacagtgggcgctgatggttcctgctgccagcctcccgagatcatccccacaggccaagggtagacagtggctgtggcggcttctggaccatctatggagcctagcacccctgaatcaccccgtaggtgagtcgtgagcccgtttgacagccccttcgttgttggctccgtctctggccccatccaggctaacgcaagagtaaaagttatgacgtgtaccacggaacagaactcctggggcgtgtgcgagtagagagaaaaatataacacatataatcatacacaaagtttgtgggtcggggcagtggcaagggtctcccggggagtaaaggtgttcttgactacacccacccttttgtggcgggcgcgggaaggtgcgcacatccaatgcgatccgggtgagcagaaggtgtgccggaaaagctgcgatacgcacaacaaaaagcacgcccggagaggtaaaaaaagagcgaagggggcagtggggggttcctgcccgcaggaacaaaccagactgccgccgatggtgtccatggaaaggctgcttaggaaccagcacccacagaaggggatcaaggagactcaactgggggtaatatcacgcaagggggaccggacgtaaaccctagatttaccatgagccccccgtggggg

SEQ ID NO: 621863 - DNA, 396 bp, Homo sapiens
atccccacatatagggtgatgtcccatagatatacggtgatgtcccacagtgtatagagagatgatgacccgacatttacagagttcaatgtcctcccaattatatcgctgaagtccgccgaaatataggtgaatgtctcccccagaataacgtgtaaatccgcacaatcatatggtcgaagttcttcattgattcgtgccctgtccccgcccgttacgtgggctgtgttccccatttaactgggcaatgtcccctcatagtgtgtcccagttatacagtattgttcccccattataaggtagtatccccagttactagatagtgtcccccagtaacaggataatgtcccccaattgcagggcaatgtcccccattatagtgtccccaagttataa

SEQ ID NO: 621864 - DNA, 176 bp, Homo sapiens
tagctgttgactggatgtctggttacctggttacaaaattatcagagtagtacaactatgagtatatataaaggatattaaaactacactaagtatcatattgattcgattcagaaagtactttgatatctctcagggcttcagtgctatcattgtgagcaatctgtcaatcataa

SEQ ID NO: 621865 - DNA, 367 bp, Homo sapiens
  misc_feature (81)..(81): n is a, c, g, or t
  misc_feature (150)..(150): n is a, c, g, or t
  misc_feature (214)..(214): n is a, c, g, or t
  misc_feature (216)..(216): n is a, c, g, or t
  misc_feature (270)..(270): n is a, c, g, or t
gacacttataattcactcccatttaataacagcagaatacacatttttttcaagcatatatggaaaattatccagaatacnccatacactaggccataaaacaagcctgaataaatttcaaaggattgaactcatcctttaaaatgaacnaagtacattctctggccacgtgaaatgtaattgaaccaataacagcaggaaatctagaaaattnanaaatacatggatattagataacatactcctaaataaccaagggatagaagaagnaaagggaaattgcacactattttgaggtgaatgaaaatgaaaacacaacatacaaaacttatgcagataaagtagtatttaaagggaaatgtataac

SEQ ID NO: 621866 - DNA, 805 bp, Homo sapiens
tcgagcacgaggattctctcagagcatgtattctttattaacaattactcgatagcagaacatttgattccattatcattaccatggtcttgtcaagagtgtctctttcctgggtctcttgagttgcttctatatgccttctcctcatttatgctcaaatgcatcgaagaacatcacatataacagctattgtacctccttagaacagcttgtggcctagatgataatgttagctattccacggcgatagtctgtcagatatttcgatgaaatatactcctccattcacattattctgacacgtctacatttaatcctttctttgatgcgtcaatctgcgactatggttgtttatgtagcatttaatccacatgctgaatctgtattagtctttgtgtccaaatcagtgttgctccaagtatttgaagacaaaatcagttcctttctcagggttggtccagttttggggttcgccttctccatctccctcagtcctctgccgctcctggaggatctgcaatcctgtcatgagctgatactctagcaggttctgtgctggtgttcctttgaatccagctcgccctaggcacatgagtggcccctggaggaagcaagaggatggagaggagctacattggagatggccatggaatagggactaccgcgccatcccagagctggacgcctatgaggccgagggactggctccggatgatgcaggacgaaaagcagtagacgacacacgacacgggagccagaaaaacaaccactcggcctttgaccggaaagggacgaagacatgccc

SEQ ID NO: 621867 - DNA, 868 bp, Homo sapiens
  misc_feature (569)..(569): n is a, c, g, or t
  misc_feature (571)..(571): n is a, c, g, or t
  misc_feature (587)..(587): n is a, c, g, or t
  misc_feature (590)..(590): n is a, c, g, or t
  misc_feature (604)..(604): n is a, c, g, or t
agcggaggcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccaggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaantnataggtgcccagctanganctgaatgccatcancctccccagggctctgcagttttctcgtggtgaacccttgatggatttgtcgttgcttgagaaatggcgatgatcgacatggggttcggaagacagacttttcatccattaccgaggacgagttcatgcctgttgaaactcatagctggtgtcttcgctgtgcttctaatttgtgcatttccactctattacttagcgaatcttccaggtcactggcctgacgtgaaaacccaagcttcgcttggtgacacgacaccgtgagca

SEQ ID NO: 621868 - DNA, 199 bp, Homo sapiens
  misc_feature (71)..(71): n is a, c, g, or t
gatggggtctgtgttgttgcaagtgagtcactggactcactagtaagaggagcgtctcgtggtccctcagncatttatatcagtcattatttctaccagcatacactcgaggacatattttctttttcccttattttttttttggaagacagagtcctcgatctgtcgcccaggttgaagttgcaggggcgcggtctca

SEQ ID NO: 621869 - DNA, 484 bp, Homo sapiens
ggacagtatatataaaaatggtattatataaaaagcgtggcagcagccaggtgcagtggctcacgccagtaatcccagcacttgtgggaggccaaggcaggtggatcaattgaggccaagagttcaagaccagcctggccaacatggcgaaatcctctctctactaaaaatacaaaaattggccggacgtggtggcatgcacccgtagtcccagctactaaggagactgaggcaggagaatcacttgaacctgggaggtggaggatgcggtgagccaagatcatgccattgcactccagcctgggtggcagaatgagccttcatatcaaaatacaaaaaacagaagaaaaaaaaaaaagagggggccagggcggttggatgcagcaggtaaggaagacggggatgctaatgggggcaggatagcagggcccagataacaggaggcctcaggggccgggtaagggatgctggcggggatcctcta

SEQ ID NO: 621870 - DNA, 417 bp, Homo sapiens
agacacaggctcaagatggggtagagggggtgctatagggtaaatactgggccctatttcaaagatttttaggggaattaattctagtgacgatgggcatgaaactgtggtttgctccacagtatttcacgagcattgaccggtagtatacccccgagtcgtgtagcggtgaaacgtggtttggtttagaccgtccgggacattgcatctgatttttaacgcctaactgtggggacacgctcatgacgtgcaacgacgtcttgatgatagtaattattactacgacatggggcgcttcacatcggagagtactcactcgacttgtcaagcgtcacaggactcgcagtgtcgcctaggttctacggaataactgggggacagtatgtaggcagttgcaagactagtccggccgtagtc

SEQ ID NO: 621871 - DNA, 356 bp, Homo sapiens
gcacagtgacagtcataagggatctgggagccaaaagacctaggttggcaggtctcattctggcggctcagttcacttggtgccatggggcaaacggtttcaacttctcggtgcttcagaattctcatctataaaaggaggataataatgtatcagtattacctcagatagttattggaaggtaaggtatagtaaatcagttggtaacacattaagctccatataaaggtaaatcactaaggtggtaagggtccttggaacgtaccatgtatcccgagggtggcagcaaatgtgtggctttccatttatgtccttaaccattgggtaggtggttaagggatcccaaatgatttttg

SEQ ID NO: 621872 - DNA, 297 bp, Homo sapiens
tctgtagtaagctacacaatcacagctctctaaacctataggaggaggatgggatttattgccatggtatttgtttcttgtatttcttaccttatttaattaacctatacatattagacctccgatggtctgcttctgactcattagctaacagaagcaatacatattaggaaatatttttgcatcaaaccaaatatatcttgtgctcatttaagctatataccttcatctctcctaatagatcagttttttttatttttttttttttttttttttttttttatttatcttaggggg

SEQ ID NO: 621873 - DNA, 827 bp, Homo sapiens
ggaggtggaggttgcagtgagccgagatcatgccactgcacactccagcctggacgacagagcgagtccatctcaaaaaaaaaaaaaaaaaaaaaaaaaatttgtgataagggggaaggaaggcgggaaagtgcccctggacctgaaaggtttggcggggttcagggaaaataaaggagcacttgttgccagaaagtctccagaagcaatgggatttgtccagttcttcgctggaaacattatagggttgttttggggcgattagaaaagtttggaagggttattagatgccttcgtggggcaactcagaagagattgagaaagaaggtgcagttggggttcccagaattccttccccaacccagtgccaaagtattaatttcttctatttaaatatcctgtgaatttcacctttaagaaatttattttgaacaaaaagggcggcgggggcgccgacagggggacacttgtgttgctttaagaaaaacaatttctcagtttacagatagacactactgcggaacaaaagcccggtctgcccctggtgtttgacacagctgcctggcacgggtgtgaaagaaactttgggcggcagtgatcttggcaaaccccccttattcagaaacccgtgcgttaaataggggcacacaaaaaaccattgtgttctaggtcaccgacaggggctcccttgaaccttttgtgttgtgcctgaaatctacactggcgagagcttcccattaacaacccggtcgggttacaatttttcttgtaaccaggcagatgtccgacaatacgttcatacaagaggtccaagcctgaccccggga

SEQ ID NO: 621874 - DNA, 449 bp, Homo sapiens
ttcattacggcaatcatccgtatacaatataaaaaatattacagcttcaccttacacagtgccttaattggttctttgctgttcttatcctttctgtgtgagaaaagaaattcactcttattgccaaggctaaagtgtaatggcttgatctcacctcactgcaacctctgcctcccacgttcaagtgattctcctcaaccttcaaagtagctgggattacaggcttcagccaccacgcccagctgattttggtactttaagtagaggcagggtttcaccatgttggtcagtctggtcttgaactcctgacctcaggtgatccacccgcctcagcctcccaaaatgttgggattacaggcatgagccaccgtgcccggcctacactttcatttcttatgctgcatcttttccctcaaaactatcatcagtgttacacaatgaaacagtct

SEQ ID NO: 621875 - DNA, 105 bp, Homo sapiens
tgctctacaggatcttccccgactagcccgacagggcagtgggatactcaggtgtgggatgtagccgcacatttatgacccagctaggacagacacacaacaggt

SEQ ID NO: 621876 - DNA, 277 bp, Homo sapiens
gtttgaacagcaacatgggggttggccaagcacaagggccttacgccagggggccaaaagggaggcaagaaggaagttgtttgattaattttcctaagacagatttgtattatgtcaaaggaaactggtatgtttaatataagccatatttgacagagggttgtcaacaggagacacaggcaccacacacttgactatcatgggtttcacagggtgtgtgtgttttaccgtgacgtgtttctgattttgtagaagatacccccgcctttacttttga

SEQ ID NO: 621877 - DNA, 145 bp, Homo sapiens
aggaagagggtgacacatgaacaaggttgtgggcctgagatcaggaaaggggcggacacgtgagaacaagattccaagaaggcaaagagaacaacatgtacaaaaataccaagtcccaagagagaataatgtatggcaaagagtg

SEQ ID NO: 621878 - DNA, 321 bp, Homo sapiens
  misc_feature (283)..(283): n is a, c, g, or t
gcccacctcctgctgcccaataaccctgatgttgtcactctcatatttaaaacccataagtgcctgccgggagcggtggctcacgcctgtaatcccagcactttgggaggccgaggcgggcggatcacaaggtcaagagatcgagaccatcctggccaacgtggtgaagcccagcctctactaaaaatacaaaaattagctgggcggggtggcacacacctgtagtcccagctacttggcaggctgaggcaggagaattgcttgaacccggaggcagaggttncagtgagccgagattgcactacttgcacttccaggact

SEQ ID NO: 621879 - DNA, 280 bp, Homo sapiens
ctgcactgaaatcatgaatcgtctacttcactagtcacgtaggagtggcaaattgcctgtaattattccctcaagatattttcactctggattgtgtacgttttctccttttctctcaggaagtgccaatccttcgtaggtttggtatcctttaacataatcccgtatgtcttgcaccactcttgttcatttgcatataattcttctctttcagcacagaggtctcgcgtccgaccatccaggtccagacgttgcagtggtcatgagtctatgatcttac

SEQ ID NO: 621880 - DNA, 119 bp, Homo sapiens
  misc_feature (106)..(106): n is a, c, g, or t
gacaagcatgtacggcaaaggcaagagtaacagcagcgccgtcccgtccgacagccaggcccgggagaagttagcactctacgtttattgattatctgctccatgnaggagctcagaaa

SEQ ID NO: 621881 - DNA, 900 bp, Homo sapiens
  misc_feature (1)..(1): n is a, c, g, or t
nctcggggtaaatataaaaccgacgccgttcttttttgtgaaaccccccccacattcttcccctctggatgtagacggaccaccaccaccaacccccgtgtgggtgatggacccccccccactatggttggataacacctcgcgggggcgcgtagttccctacacccctctcccgcggagcgtttttattcctatgtgtcgccgcgcgggagcgcgtgtgctaacacacacttttgcaccaccccagcggggagcacgcctgatttgtggccactcttgcggcacaatttttggggggacacacactcataatgaagaaccaccacactgttggttgccacacacaagaagagacgcggcgcgtgggtgattgccgcgcttcgcgcgcgaattttcctcgcgcgggttatttttgtgttgagagcccaccgggcgctgctcgcgtagatatcactcctctgcggctctcacaccactctggttgttaatatatgtgataaccccacctcccgcaccccccaacttaattgtttctcagccgccggcgtgtttaccaatgtttatccgggggtcgtcttattttttacgacctgcctctctccacgccgctctggagggtcttttcgaggttgttcgtccctgttcaccccatctctttcccgcggagttttccgggtccacacatgttgttgtagcacccgacgggttctccccggaggttcctaacgtcctattatttgggctcaaaacttccttccaccaaattgtgttctactcccccccaaattttcctcccttaaacccaaaacacaccttgggttgaaacccccccccattaggccttttttaaaagggggttttaaatttttttttttttccctttttttggggggggtttta

SEQ ID NO: 621882 - DNA, 108 bp, Homo sapiens
tggcaagctacgtaccatcctgatttagaacttcccacaggctaacttaagacaccaaataaacactggtggagtattggtatcccgagacaaagaaaccttgcacga

SEQ ID NO: 621883 - DNA, 968 bp, Homo sapiens
actaaagggcctacctttgtgagctcaggggcctcgtaatccaccgccactacagagggtcccaccctgggggtagactctttcagagaaggggtgccattggttcgtaaaggcccacctgtattgtaaaggttcttagtccgtaacacctctgttattggtcgcgcgatggtggtctctaaatgggcccgtaatcagtaaacacgccagttggctgtccaccacatagaaaggctagcccgccgttccgtaagaaaccgcccctttggcggtaaaactaaggagccctgcgattgttgccccctcttcgtacagaacggagcgcgtgtcgccacccctatgtatccaccccccgcgatttatgggcatattcatagaactgggtccccctcgccaaggggacaaaacgccaacaattctgggggaaattatgttccccaaggcccggaagatgtttgagggaatttcttgccgcttctcacaaactttcgcggtgctcttcttatcgcaataagtggggcaacaaggtccagacacaaccaataggatgtcttggtcaagaaaggcaccacacaacagccaagcacgccgggagatggcgggcgcacatttccacgtcccagagtctcaaggtagctcccgatgaaatgttgactgcctctatttgtgcggggcaggaccacatctcataacaaggactgagtacctgtgggaacacaccccttcttgtaaatggggacaaaaaagcacataatacggtatacccaacaaagtggttattttttgcacagaaaaaaagaatacatattacttctgtgtcgttgtataacaaaataccggcgccacacaacttctcttagaagttcatcagcccggtgacgctgccttacaacagttaccgggttgttttcagggtaggaaagagccccaaacggccattttgaacaaaaaaacggtccaaaaaaaca

SEQ ID NO: 621884 - DNA, 1213 bp, Homo sapiens
atcaaggggacatatgtgtcgtagtgcttttcacgtctataaaagtgttctatatttaccacgtacagcactgggtcttgataaagactgcactcagaaaccacactggacatgtccagtgtattttataataagctgctacatgacagacaggtaatcccactgaggtgaggtttctgcgaatacagaatccaagaacgagagtagaacatatgaaccacataatagacaccgaatattaggcgaaaatgacatataacatgcctggttccttggtagacgttcattcatactttttgccgacatgtgcctagccaaatcacttgcttgtctaaaagaaatgtataatagccaaagagagaaattatgtccctgatgtacagaagttagaatgtttcgactccaggcagcagtttgctcagtgatctgtgaacaagttatccaattgcctctacattgcatcagtttctctagctgcaaaatggggataatactatatacctacctcacagtgggagggcaggagattttgaggccctgaggtcttgaggtgggctgtgagggccaacgctgtgacacaaagtccatgggttattattcaagaatgcacaggccccatcggccttttagaaagacaagacagggagtgcttgtttgatatttcaaggaataaagccggagctctgaattgtagtccaccttaaaagagagactggatggagaatattgtcaatatgtatgagaaaataggtatgttaacctttaacaggtactataatagggttaaaaagactgattaagtcctacaggttaagtcagctatctggcgtcttcattagaacgtcgtggccattcgacttattgaggaagggagttcgttaaaatatattttcgaaagggaccctctcatttgttcaaaaatttaccatttcctacatgcagagtgtgttacataagagagaaaaaacaaggaaaaacggaaagtgaccgaacaaagggagggccttcgtatgtatcacacaacacaagaggaggcctgggataatcttgagcaacacaatgctgcgaggcagagtgtgctagatattaaaagacaactcagtgtggatcgatctatgttaaaagagatattgattataccacatgagtgatgtgaagaacggagatagcaataacaacagatagataacagacagtcctggtagatgtagat

SEQ ID NO: 621885 - DNA, 214 bp, Homo sapiens
tcccactttatcgcgttgattagtcgtagttactgcttgaacacttgtttgtggtgtatactttgtccattgcagcattgctcgggggcacatcaggttcatgtgcattcaggcagtcagggttcaggcatgcagtgggcaagcaagcaaagcagcaggcaagtaacagtttaattcatgccgtttttggggttgcaggtgcatgcatggcagg

SEQ ID NO: 621886 - DNA, 2604 bp, Homo sapiens
attgccctggtggttccgcctcgtgggttagatcccaaattacgcccgctctcgatccttaataatgggaaggggcttccacttgtcgccctccgcctcctgcacctcagtgacttccctgaccaaggaggaagaattggcgtgcagcctgggtttccctcaatggccaccattccgctggcacaatgtagtgccctgccccgggcctcagtttccccatctgtggaactgagtgtggcctcgacgtcaaaaatgtggactctggtccggtcgcggtggctcacgcctggattgtgagaaagcaagtgaaattactcgtggaagtgaatggactgctttgagtcttcaaggcgttaattttccaaacgtttgaattctatccctggtctgagagctagggatgcagcctagcaagggaaacaggtaactaatatagaacagcagtacctgcaaatatctgtctctgtgaggatagatcaaatccaggcttggtcactcaccacccctgtgatcttggacaacctcttaacctctctgggcttcagtttcatctgctaagtgggaaagcagtggtgtgtggtgattaaaagcttcagctttggagctggatggtcaacatggaatcctgggccttaaactcagtgtctctgagacataggacaaagtacagtcagctgtccatgtttacaggttccccatctacggattgaagcaactgtgggtggataatatttgtgggggaaaacagtaaaaaataacagttcaacaataaaaataatacagattccgaaagcaatacagcatagcaattacttatatagcatttacattgtattaagtactgtaagtaatttaaagatgattttcaatatactggaggatttgtgtaggttaaatgcaagtattctcgcattttgtaagcacccaatggttctccttgcctgcttcctagacagaaccaatttatcaagacaggggaattgcaatagagaaagtttaattcacacagagctggctgaacaggagaccacagttttattattactcaaatcagtctccctggaaattcagggttttcaaggataatttggtggctgggggggctggggattagagagtgttgataggttggatcagagaggaaaggagtcaaagctgtcctcttgcactgagtcagatcctgggttgggaccataggaccagattagccagattacagggctgggtggcgtcagctggtgcattagaacacgggttctgcaaaatatctcaagcactgattttaggttttagaacagtgatgttactcccggaagcaatctggggagggtcagaatcttgtagcctccagcttgcgtgacctcctaaaccataatttctaatcttttagctaatttgttagtctacaaaggcaggcccgttcctaggcaaggaggggatttattttgggaaagggctattattgcctttgtttcaaagttaaactataaactaagttctttccaacattaattccacctatgtccaggaatgatcaaggacagcttggaagttagaagcaagatggagtcaggccagatctctttcactatcataattttctcagttatgctttttacaaaggtggttttgattttacataagggacttgagcatcgagaattttggtatccatggggactaaggtaccaatccctcacagatactaagggatgactgagctcaagttttcagcttcagtttgctcatctataaagcaggtttaataataacactttgttgataatgttattctgaagattaaaggaagagtaaacgtaaactacttagaagagtgtctctggcacattgtaagccctcaataagtgtgaactaacaccactaataagttctttataaactgcctaataggtagtcaaataagaggggaaataaagccctaaggagtaatatttgtgttttgtttgccctacatggttttgtgaaattttctattcattatcaatatttaaagttggggttttcaatctttgactgggcatggtggctcattcctgtaattccaacactttgggaggcccagctgggaggatggcttgagctcagaagtttgagatcagccatggccaacatggtgaggcccccatctctacaaaaaaaatatatacgcgcgcgcgcgcgcgcacacacacacacacacacacacacacacacacacaaaaattagccaggcatggtggtgaacacctgtggtcccagctactcaagaggctgaggtgggaggacagcttgagccaaggaggaagaggttgcagtgagctgagattgcatcactgcactccagcctgtgtgacagagccagactctgtctcaaaaataaataaataaacttgggacatttcacataaaaccctactgtagctgactgctctggaaaagtggggaagtctgacgacagtgggccagccttcccccatggcagcacttgttcagaacttgggagagaccgtccccttttgtgaagcatgtgcttccctggtgtgtggagagataaaagaatagaaaacgctgggaacaccagcacttcaagatcaaagcgtcaag

SEQ ID NO: 621887 - DNA, 253 bp, Homo sapiens
  misc_feature (34)..(34): n is a, c, g, or t
  misc_feature (44)..(44): n is a, c, g, or t
  misc_feature (64)..(64): n is a, c, g, or t
  misc_feature (71)..(71): n is a, c, g, or t
  misc_feature (101)..(102): n is a, c, g, or t
  misc_feature (109)..(111): n is a, c, g, or t
  misc_feature (115)..(116): n is a, c, g, or t
  misc_feature (125)..(125): n is a, c, g, or t
  misc_feature (180)..(180): n is a, c, g, or t
  misc_feature (198)..(198): n is a, c, g, or t
  misc_feature (202)..(202): n is a, c, g, or t
  misc_feature (208)..(208): n is a, c, g, or t
  misc_feature (222)..(222): n is a, c, g, or t
  misc_feature (237)..(237): n is a, c, g, or t
gggctgtctagataaatgtggaaattattggcangtagattgtnttaagccatgagaccagatngaggganctattcagaaacaaagaaaaggtaaaatgnnctgagcnnngganncccccaggnttagggcctagggatatgagaaggagcagaaaaggagcctaagaaaggagtggtntaatgaaagaggaaaatnaganaagttnattccctgggagtngtgaagaaaagtttnaggaagatggaatagt

SEQ ID NO: 621888 - DNA, 150 bp, Homo sapiens
taccaactcagaggcctgtacgtggccatccaggccgtgctgtccctctacgcctctggtgcgcaccacgtggcatatgtcatggactctgagcgaccggggtcaccctacacgtgtgcccactctacgacgggctacgcgcctccccac

SEQ ID NO: 621889 - DNA, 447 bp, Homo sapiens
attgccctggtggttccgcctcgtgggttagatcccaaattacgcccgctctcgatccttaataatgggaaggggcttccacttgtcgccctccgcctcctgcacctcagtgacttccctgaccaaggaggaagaattggcgtgcagcctgggtttccctcaatggccaccattccgctggcacaatgtagtgccctgccccgggcctcagtttccccatctgtggaactgagtgtggcctcgacgtcaaaaatgtggactctggtccggtcgcggtggctcacgcctgtaagtaatcccagcactttgggagaccaaggcgggccgatcacttgaggtcaggagttcgagaccagcttggccaacatggtgaaaccccgtccctactaaaaatacaaaaagtagccgggcgtggtggtgtgtgcctgtaatcccagctacccggga

SEQ ID NO: 621890 - DNA, 221 bp, Homo sapiens
ctgtttttttttattctgttctgttctcttctattctattctattctatactattctattctattctattctgttctcttctcttctattctgtcttgtctgtctcattgtgttctactctattctattctgttctgttctattctattcccttctgttctattctattctattctgttctattctactttattctactctgttctgttctattctattgc

SEQ ID NO: 621891 - DNA, 107 bp, Homo sapiens
tagctagctctgaatagtgtagcagcacagcagtcttagcaagacagcagcttgcctctcgatagatctaaagcttgatagagcaagtctcagcctctagtcctata

SEQ ID NO: 621892 - DNA, 444 bp, Homo sapiens
  misc_feature (416)..(416): n is a, c, g, or t
gggaattaaatacatttaagaactgtgttggcttggttcagaaaggtgggaaaacctaaagtgggggcttccaggctataggtaaatttaaacattttgtggctgacaattgggtgagtttatttgaagacctgggattaatggcaaggaatgttcaggttaaggtaaagctttgtggagaccaagttttattgtgcaccggtatctctcagacaccagacgtcagagagagagcaggttgtaaaatatgtcttagacctaaaagggtatgtggctcttagttgattgtctcctggatctgggaaggaaggaaagaaaacaaagaggaaatggggttctttatagaatgtggatttttcctacaagagacttttcagggcaatttcaaggtatggcggtatatttttgggtcattntgattttcttcttgttatgccaggtctg

SEQ ID NO: 621893 - DNA, 132 bp, Homo sapiens
taagagagaggaggagaagaacggcttccacccaacttcatccactcgctggactcctcccacatgatgctcaccgccctgcactgctacaggaagggcctgaccttcctccttgtgctgtccagctgtcca

SEQ ID NO: 621894 - DNA, 286 bp, Homo sapiens
  misc_feature (87)..(87): n is a, c, g, or t
ccccttttttccttttttgccccctttacaaaggggaaattttaatcttggataaaaaaaagcctgaatgagtcccgcccctgtatncgttttgttttttcccagggggggggaaacaaaaacaaaacaaattttatttgggttttttaaaagccaggcccttttgggcccccaaccctgtgatggaaaaaaaagccgtttgaaacccctttaaagttgggttttggcctctggaatcaaaaggaaaaagttttttttggaatttccaaccctttttttaatggta

SEQ ID NO: 621895 - DNA, 480 bp, Homo sapiens
tgttaggcacatgggactcgtgacacatcagtgcctgccagcgccttaatgaacagacaatgacccgtttactgacaacctattctgcctgcccaacacaaacaagctgggtacacaccggggtcacatctatgacctttggcgatagcaaatgaagggaccacacagcccggggaggtactatccctcctggattcttaaaaaacctacaaatcaatgcataacgatactacactgctaattgtattgcagaaaaggctgaagactcgatggtctgatctgagacttaattgcctgacttgcgaagtccatcaagttgaatatcacgctggaagatgcaccagagatgaccatttccaaggctttaaacggcagcggtaggacaaaaccggctgcactatgtcgacaagaaggccagttactgaatgcatccccagcagaatgacactcgcatcagcatcgctaattgtacacagactg

SEQ ID NO: 621896 - DNA, 541 bp, Homo sapiens
  misc_feature (520)..(520): n is a, c, g, or t
  misc_feature (533)..(533): n is a, c, g, or t
agattgtctcaggaggggaccgggtgggtcgaaggggacacatatggtcatccttgatagatacctcggtaacggctccccagtgtggtggtgtaagatgaatcgatccatagtcagaccttttccttttggccaattggaggggtgtgaagtggtattggttggatttggcgtattccggataaggggggaggtggagaatattttcaaatggtttggtgggccattggtgtggtctacggcgaatggtctggcagttcatatccggtgctcatttccttagggaggggtaacttcagtggttttcccttaagtattggtagttctcggtatattttaaatactaatcttctatcagttacatgtgtgtagtgaatatcttccagctggtgactggtctttgcatttggtgactctgattggcatggctataagagaataccggagactaggtaatggttaaagacaagaggttaattaagctcatggttctatagactgagaaattcaggggcatggntctggcttctggncagggttg

SEQ ID NO: 621897 - DNA, 456 bp, Homo sapiens
ttattttattctttgagatggagttttgctggggttgcccaggctagagcgcaatggtgcaatctcggttcaccacaacctccacctccggagtgcaagtgattctcctgcctcagcctcttgagtagctgggattgagggcatgggtcactacactcagctaattttttgcatttttagtagagatgaggttacaccatgttggtcaggctggtcttgaacacctgacctctggtgatctgcccgcctcagcctcccaaagggctgggattacaggcgtgagccactgcgcccggcctgaaattttaatggctagtcttcgttttgaacagtgcacattatagatctatcccccaattcatcctctattttcaaaatgagtttaaataggtctctctctttttcacaagctagaaagtatccttccgcctgaggaagattcagattgcatcttat

SEQ ID NO: 621898 - DNA, 1006 bp, Homo sapiens
  misc_feature (106)..(107): n is a, c, g, or t
  misc_feature (127)..(127): n is a, c, g, or t
  misc_feature (145)..(145): n is a, c, g, or t
  misc_feature (197)..(197): n is a, c, g, or t
  misc_feature (213)..(213): n is a, c, g, or t
gcggcaaggatgctctccgggcgctcaactttgcgtacacggtgagcacacagcgatctaccatctttcccctggatggtgtggtgcgcatgctgctgttcacgannactgtgaagaggccaccganttcctcacctgccacggnctcaccgtttccgacggctgtgtggagctgaaccggtctgcattcctggaancagagggattatccangacctaggtagagtctggtgttgtattcactagtgaagctgacggtgtcgagtcggggaaattgtgagctggagggccattgcaccctcgcggctcgcgtcgtcatgcctccgtgtgtgcaaggttcaacgtcccagaacaagtgcatcggggagagcctggccgcaggagctggccgtcaggagccagagagccggctccgacagcagtgggcggagggagaggagaggagtgtggtgtaggaggccggcatgcacctcctgtgcagtcttgctcacagtgctctgacaggccgctggtccctcatcatgggctctgcctcctgtcctggtggtgagcccgtctgtaggcggccaggcctctgtgccagctgtctgtgcgagctgaaccaacgactccagagtcgcgtgtccatgtactctgacccaaggtactctccagcaggacctggcgtcacgtggacgcaaccgaagctccttacaaggaagccccgcgcaacggacccgcgacgcgacgtagggcgccgcggcgtgcctgactgaagcaggatggccgacgcgggagtgtccatactgcctgccccgcaggcatggcacccagctgcagccagcgacaccctcgatggccagtgagctcaccaggcgcacagacacgaccacgcccaccgaccgcactccacacccccctcgcgccaccccctcttactaccgcacgtcccctgacacccacacccaccatccccacaccccccccatcccacacacgcgcgcacagcacaaaccccacacaccac

SEQ ID NO: 621899 - DNA, 844 bp, Homo sapiens
  misc_feature (844)..(844): n is a, c, g, or t
ggctgatgccattttcagcctcagcacgcctgcacccaggcgctcattaaaacagcatgtgctccccactgcctcgtgtgtctgtggcgcgctgtcggggttcgaaccgatacaagaaccttccacctacctggtgctttggcctcatctataagcttttccactgtcctgaaacaagatagagaatctgagcgggcagttcaatttggccctaaagggcgtgccgcgcgaaagatctgatagtgtcctggacagtgtcgctgtcatatctaccattgatgacaagacagcacttgtgccgaacagcatgaccaacacatgcattgtcaagcggaatcttttatgttctgtttgtcttcctttaagccaaacatttgccgtctactctgttcataaacaggcataacatcaacatcatttgtttcagtttcgaaaacacaaacacgaccaaaaaaacaacaacacgcacaacccgttgcccgcgcgccctcggcccccgtaagaaaacactttctgcaacacccacgtctccttctgcggcgcccgcgacggcgccccacgggaagacagacagcggcaccgccgcgtccccactatagacgcggctcgccactaaggagatagccgcccgggcgcacaagacggagcaaaggcgcgcacagggataatccgccacccaattgaaacaaaaacgccacgcagcgggggggaccacccgaaacggactctctgcaacacaactctccagagaggaggagcacctacagaaggccaacccgacgagggagcccacgacgacggacactcccagacgccacctgacactttcccacagtgaccccgn

SEQ ID NO: 621900 - DNA, 934 bp, Homo sapiens
caaagacctcgagagaatgatgttacggggatatacaagcagcggatcgaaatggaagaaggagactataaggaaattctagatgtcgggcaaggataagaccgcatgtgaatgcctcaaaggtccccgaatacatccagcccatgcagattgtatagacgcaggctgtaggctgacaacctaatgagtgcgactaggactcgttgagtgaaagtgttatccttcagtccattcttgttggctctggcatcctctactcgactatatgtgtacttgccgtgaatcaatgccaacgaatatgacgctacaactctgagtgattgctaaaaaatgttacccgccaagtccgtaagagaccggggacatatgtatacctgcgtcgctgttgaagaacaccttcatacaaagtccagctgtgaaagacgcttcaatgagtaggtaagtgatctctatatgcgtcttccaataatattgaccatgttacatcagtgcaatactcagaaaacggcgggttgaaatccgtcctcaccagtgtgatcctctgtacaatgtgaatatcttgtgaggagttccctgacattctggccgaagtcctctagagccaccgttcttggactcatggcgagaagaagcaaacgtgtatctcctcattcggatgtgtataacttgtctcggcgcctgggagatgtatactcttccactctggaatactgcagttgcctgagcccatcagtcctcaaatttttctgcttctgactttggaccctggtaacagggaaagtgacaccgaaaaattgacggaaaggtgtcaaaaggggccactttggatgtatatctcggatggttcagggtcctcctaatgacacttgtgtctaagcaagaggtctaggtacacgagggactaagggcccggggacaaagaggttgcagaaaa

SEQ ID NO: 621901 - DNA, 121 bp, Homo sapiens
tctgttcttgtgtatcctcgtgctgcagcacgtgaacaactgtgcacgcctgggcgcctgtggttgcgaggatgggcgtacctgcacggtgaccatcgactggttgcacacaccagaggcg

SEQ ID NO: 621902 - DNA, 106 bp, Homo sapiens
  misc_feature (72)..(72): n is a, c, g, or t
tagctggtacctggaattctgagcatttgatgtagaagcacccccaatgaattgagcccccatgatcacaantaccgatatttaacactggaattcctggggtgat

SEQ ID NO: 621903 - DNA, 350 bp, Homo sapiens
acaaaaaaaaaaggggactcggattaaacgggataacaggcctggcgggacacctggggccagctgggttaaactctagatggcactggtcggtcccaccccacttcttccaccccactgcttccttcaccaacaggcaagtcctttccttcccggccagccagatagatagacagatgggaaaggcaggcgcggccttcgtggtcagtagtccttggatgtgaaaggggcagcacagtcatttaaactggatccaacctcttggcatcttacaaagttaaacagctaaaagaagtaaaataagaaggcaaggccggtggaatgtacagtgcatatgggctggcacccgg

SEQ ID NO: 621904 - DNA, 708 bp, Homo sapiens
ccgacccctaaaaccccctcctaatactaactacctgatcctacccctcacaatcatggcaagccaacgcacattatccagtgaaccactatcacgacaaaaactctacctctctatactaatctccctacaaagtctccttaattataacattcacagccacagaagtaatcatatttacatatcttcttcgaaaccacacttatccccacctgtggctatcatcacccgatgaggcaaccagccagaacgccttgaccgcaggcccatacttccatcattctacaccctagtaggctccacttcccctgactcatcgcactacattttacactgcaccaacaccctaggctcacttaaacattgctaatactcactgctcatggcccaaggaactaatcaaaatcccgtgagccaaacaactttaataatcgactacgcttacaacaaatacgcttgataggtaaacgatacctctttacggactccaacttatgcatccctacagtcgcatgtcgaaaggccccccatcgctgggtcaaatagtaccttgccgacagttactcttacacctagcgcggctatggtataatacgcctcacactcatttctcaagcccctgaaaacaacacatagctaaccccttccttgtaataatccctaatgaggcattcatcataacaaggtccattgacctacgacacacag

SEQ ID NO: 621905 - DNA, 257 bp, Homo sapiens
ttgactctagatcgatccccgttaagatcgagcgatgagaatgtttcatgttacttatactaacattactacttctatagggtgatcgatagttccaacttcggtcttaggagttcagttctatctttgggattacttaggtcgtgcttgtagaactctaacgctttcttaattggtggctgcttttaggcctactatgggtgttaaattttttactctctctactaggtttttttcctagtgtccaaagagctgtt

SEQ ID NO: 621906 - DNA, 459 bp, Homo sapiens
agactgtagtatctcactctcagcaaaaaggcccccatcaccagaaacttgagggaaagcttctaacgtgtaaaagaccaagacagagagcagtaaatgaacacaggaaagaaagagcaatgcagagaacagtagaaaacatctccaaaaactaacttcttcacagaaataagaatattgtcaggataaagtcctttattgatcaacaactagattgtctccaatttccaactgccacaaacaaagtaggaaatttctgtaggatgaagatcctgaagtgtgatggagttgactaagtggtggcagagtgctctccagaattgctaccccaatctacacttccatcatggtactctgcagttcctgtatgattatcatatacctgccacccttagcagtatccagcttttcaattctgactttactgagaggaataacgccatattttatattttcaaa

SEQ ID NO: 621907 - DNA, 646 bp, Homo sapiens
  misc_feature (61)..(61): n is a, c, g, or t
  misc_feature (66)..(66): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (124)..(124): n is a, c, g, or t
attcattctgaatgttgcttgaccttgttgatttagtcttcatttttcctatttcctttanagctntcnancntttcttttnccttttcttttgacaaacaactagaggggcaccatgctcttntcttatccttttacttctttggcttgacaaaaataacacagcataaaatgcacctagcattatcatgtttgctcttgttcctcttctgataaggactaaatgtataattaaggaaaatggtgttcacaacagtacctagaaagtaactggttcacaatttttgctcaaattaaattttatttattaaatgaaagaatagattaatcttgaagtgagaaaatgaaaatataaggagtgactttagcaaagaagaacaatggttcccaaatgtatatcaccaatccttttctctcattttctttagccccacctctttaattgcttataggctatttctagctgaacttttatgatgttgaaaacaaaagtctccttccttccttcctttcttttcttttctttctttcctttctttcccttcttttctttctttctttcctttctttcccttcttttctttctttctttcaagtctgcactccagcctgggtgacagagtgagatccgtctcaaaaaaaaaaa

SEQ ID NO: 621908 - DNA, 422 bp, Homo sapiens
ttctcctgtctccagtacccccatcagccccatcttcggtcctagtaactggcacttcatgccacctgtcagtgaggtagtcccaacccagggagctgaccctctgctctacgaatcactctgctccgtgccagcccccacctctgttcagaaatgggaagactccgcccacccgcaacgtcctgacaatgcagaccttgcgattctgtatgctgtggtggatggcgtgcctccagcgcgctggaaggagttcatgcgtttcatggggctgagcgagcacgagatcgagaggctggagatgcagaaacggcgctgcctgcgcgaggctcagtacagcatgctggaagccgtggcgccgcacgccgcgccacgaggacacgctggaagtagtgggcctcgtgctttccaagatgaacctggct

SEQ ID NO: 621909 - DNA, 319 bp, Homo sapiens
aaccccccctggggggcccttgggggttttcccccaacgatgcccccctgttttgaatggggaaaagttccctgaagggttcatagggaaaaacccttttggatgatttttgtgggggggttttggaacccctcaaggggtcaaaaaataatatccttagggaattttgggaatgtcccccttcccctcccccttttttttttgcggggtcccattgtttaatttaggggggggggatggggggttttttggccatgttttttaacttggcggcctgttttaaattttaataaaggccataaattaatttttgggccca

SEQ ID NO: 621910 - DNA, 402 bp, Homo sapiens
taataaccctttcaaccccaatttccaatcagaaaatctttgaacccacctatgatctggaagcccccgccttcaagttgtcccaccttaccgggctgaaccaatgtgtacaccttacatgtattgactgatgtcttcttgtaacttctgtccccctaaaatgtataaatcaacctgtcacccagccaccttgggctcatgttctcaggacctcctggggctgtatcatgggccttggtcacttatatttggctcacaataaacctctttaaatattttacagaattcgattcttttcattgacaccatcagcctctattgtctaggattcttaggaacagtggttatttctgcaggtattaacctcctcttaaccaggattctattggatgtttataaggc

SEQ ID NO: 621911 - DNA, 120 bp, Homo sapiens
gtctcaagcacctagtgtgctgagccggtactcatcataaggattgtatcacggtggcgcagagcaccgtcaacgacgcggacatacgtgacaacaccacgatacgtgtcatagaccgag

SEQ ID NO: 621912 - DNA, 808 bp, Homo sapiens
gacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgtcgcgatcccggaccgaagacgctcccgatctccaagacgacatagatccacatctccttccccttctcgactgaaaggaaagaacgagatgaggcaaaagaaagaaccaaaagaaacaaagagcaaagaacggcagattactgaggaagacttagaggggcaaaaaccagaggaaggacatagaactgatgaacgttaatgggattgtgcctcctttggactccacaaaaaggtaagaaggtggatggctctgtaaatgcctatgccataaatgtctctcagaaagaggaagtacaggcagtacatgactcgaaaaggtggattcaaacagaccttgtgatttcattgcatgagaatggacgtgttgaaggatgattttttttccccctcatctgtggtcagagaggtggatttcgtatttggtatttaacttggcatttcaaaaaaacaggatctcaggttctcctttcttgtaaagtaagaaactctattatgatatatgcagttacttaccttgcttaaagaagaacggttaatattacatttttctttaggaactatcattgtggggcgtcaccccattatttggcttattctgtgaagacgcatgttctgccgaagccgtaggatctaaaactgtagtttgggaact

SEQ ID NO: 621913 - DNA, 125 bp, Homo sapiens
acattgtggtgagcacctgtagtctcaacactttgagaggccaaggtgggcagatcacctgaagtcaggagtcaagaccagcctggccaacacagtggcacgtggatccacaatggcacgtggat

SEQ ID NO: 621914 - DNA, 143 bp, Homo sapiens
tgtgctgctgacttgaacagtatctcttcaccaagttcttttttcacccattagaagctgtcactatgcttgggtactttagggattcttctctcccaggaggggttggatgagaacggtgggcttggatggtggcgctgaaa

SEQ ID NO: 621915 - DNA, 145 bp, Homo sapiens
ggccttaaagagatgattaatataaatggggtcattaggcaggaccctaattgaatatgacttgtgtccttctaagaagaggagattatgacacacacacacacacacagagaagtgtgtacacagaggaaagagcaagtgatga

SEQ ID NO: 621916 - DNA, 231 bp, Homo sapiens
taggtcactgaagaggtccagcactggcttataaaagggcttggacaaaacttggtgttttcctaggtcatgttggcaaacaagcagagaggagaaagctaaagaacagagagaattttgagaattggaaatatagcctagcagaaacaccagaactaaaggggcagaattttataggtcacgataagcaacagagagaggaaaatgaaggttggagacaggagtcgacgc

SEQ ID NO: 621917 - DNA, 366 bp, Homo sapiens
ttatcctaacatagctagctaaggataagcctagccatatactagaatagtaacggtcagccctctagggcagtagttagtatatataggtaccaagtcagtattcactgtaattaaggtaccttttagctctccctattgactactttctagttctaaactagtgttacaacaacatcatttacaataataacggcatataataaaagaagctagtagaaaactagaggtagaaaggaaaggtgccactaaaggataataaagtaactctcaatttttgcctcattactccttataattttagataggattagactaaaaataccttatagtactagtacctatcactaggtccctataaactag

SEQ ID NO: 621918 - DNA, 113 bp, Homo sapiens
agcagaggaaacttccaaccaaaagatgactaaagaaatacaacgttaaggtatctggtatctgcatgtaaatcttcagctggtggatggtgacttttgaagaacaaaaggcc

SEQ ID NO: 621919 - DNA, 717 bp, Homo sapiens
ctagacctgagatatagaaagtgttctgtcttagtgaatttggagagaatagatgcaatcagcaggttggattcatggtctctaaggtctcttcaggtgttaagcatctgctgttatatgtttttccaagcagacctgatacacaaagctttggtgtggctgatagtgttggatgagaattcatgttatttgagcctttcttgctgacatacacatatagcatgtgtctatagcagactcacaaagccattatctttctcattgctgtcttctgagctttctgatagctcacaattaactgaaagaatctgctgcttctcacacaatgcctgtgtgagctatggccaactcactgtgcggcattgtaacatgcccacttactgtggggaagtgtattgttctttactgggatatctcgtaagtacaccagtcacctcaaaactcccatgtcttagttacttctactgaggtgaaatttactctccctataatttactgtgttgaatgtgcacacgatgaaacagctctctcacactatatctctagtgtccctctgtgataaacacacctacccataccagtaactgccgatcctgatctgttgttgtcctcatacgatatgttgttactcttaatttgaagctccctgcttatgagcttaagcgagttgacactcatagcaccacggagcaatactccatgggcctgtatatgtac

SEQ ID NO: 621920 - DNA, 962 bp, Homo sapiens
  misc_feature (658)..(658): n is a, c, g, or t
ccagttgcgcttgtcctacctggctgtgactcgaacgtgccaaattcatcatgggggactcttcagtgcgaggatcagctggagagcgagcttctccccatgaggatcgtgaagcctagtaatgacacattatgtgtctaagctttcccagccatctactatagaacaagcaaggggatcagggccatgatagcggaacgggctagccttatgaaagaaccagggacatcatttgaaagaagcttgatcttagtgaggactcgaccgtgagaccttacaaagccggattccggcagtagtctcctctatactcgctctttgtgctgatttcaggtgcccctgtctccagtttgtgctccatctcctgggactgtagcaggaccatcaagcagtcatggttagggttcaagggccacaggatgtgccccctactgccactgtgaatgtttctgtggggctggcacagctgtcctgcatcgcatatctcatcactctttcctctggatactgctaaagtccggttacagatccacctgagaaacgtcaggggccagtgcggcgctatagtcagcgcccagtaccgcggtgtgactgggcatcattctgaccatggtgcgtactgaggggccctcgaaggctctacaatgggctggtttgnccggctgcagacgccagaatgcagcttgtgcctctgtctgcgtcgggcctgtctgatttctgtcgcatcaggttcttccaccccatggctctgatgcattccccaggcttgggcagctggctcctacgcaggcacgcacccccaggtgtcccgtgggtgtggctgtgggccccccccggtgtgcaagggccgggtccacgccacgccgggctgggtgcgcggagatccacagggccgccacggcgaggacccttgccgctgcacggctctggccgggagggccctccatgtttcgcactctcta

SEQ ID NO: 621921 - DNA, 520 bp, Homo sapiens
ggtgcaacttcttagaccacgagaggatggatgtgtttgcgacaactcatcttctactggctacaccgtcgccacaagagacatgcagtgagaagagtacccacttgcatgactactggtcatgtcgctgccctgtcggaattgacaatctgccgaggggtagagtttgtgtgcttggcgccactgggcgtgatcgcagaagtgacactgttgattctgctgatgcggaggaggatgattcggatgtctggtggggcggagcagatcacagactatgcaggatgggagtgaagactgaagtagtacgaatgtagcagaggatgcagaagtggctgacgtggaagatgaagaatccgatgatgacgaggacgatgaggatggtgatgaggtagagaaggaggctgaggaaccctacgaagaagccacagagagaaccaccagcattgccaccaccaccaccaccaccacagagtctgtggaagaggtggttcgagaggtgtgctctgaacaagccgagacg

SEQ ID NO: 621922 - DNA, 749 bp, Homo sapiens
  misc_feature (386)..(386): n is a, c, g, or t
  misc_feature (568)..(568): n is a, c, g, or t
  misc_feature (605)..(605): n is a, c, g, or t
cattatggccgggcgcggtggctcacgcctgtaatcccagcacttcgggaggccgaggcaggcggatcacgaggtcaggagatcgagaccatcctggctaacatggtgaaactccgtctctactaggaaaacgcaaaaaaattggctgggcgtggtggcgggtgcctttggtcccagctactcggaggctgaggcaggagaatggcgtgaacccaggaggcggaacttgcagtgagccgagatcgtgccactgcactccagcctgggcgacagagtgagaccctgtctcagaaaaaaaaaaaaaaaaaggctgcagagccacaagccagtcacgcttcttttattataaattacctagtctcgggtgtttctttataacaacacangaacggcctcacacagccctcttgtcctgatgcaaggtctgacactgtcgaccaccttcttcttgatactctatccctgggcctttgtggcttggtcttttctgattcttctcttcatttgactggccctttccatctcctcttttctctgcctaattccttctctttctttttttgagacnagtgtctcgcttctgtttgcccagcttgtgttcaagngcttggatcggcggttactggaagcttagccttcccggcctcgagcagcctttacgcttcagcctcccaagtggttggggtccaaggtgctgccacaacgcctggcttttctgggttctgggacgggcttttaccgcggtggcc

SEQ ID NO: 621923 - DNA, 309 bp, Homo sapiens
  misc_feature (204)..(204): n is a, c, g, or t
  misc_feature (252)..(253): n is a, c, g, or t
atcgacctgctcaccctcgtgcacacacacatacactcacacacttatgcacatacacattctctcacactatcacactctcacacactcaacatcaaaaacacaaacaaccaaattaaaaaatgggcaatggtccaggcgcagtgggctcacgccttgtaatcccatgcactttggaaatgccgaggcggggagtggatcacnctgagtgtcaggagttctagaccatgcctggccatacatggttgaacnnccctgtctcgtattaaaaacctaaaaaggcagggatgacgcatgtggtgatcctct

SEQ ID NO: 621924 - DNA, 201 bp, Homo sapiens
cccagtactagctgctgggaatcttaattaaaaatgcagtccaccgatgcagaggtcgcagcccgccatgggtgctccatcccccaggtactgatcacagtacccaatagttcattttcagccctggcctccttctctcccttctcccccaatgacttcccattgtctattgttgccatttttatgtccaggagtacccat

SEQ ID NO: 621925 - DNA, 899 bp, Homo sapiens
  misc_feature (43)..(43): n is a, c, g, or t
  misc_feature (72)..(72): n is a, c, g, or t
  misc_feature (94)..(94): n is a, c, g, or t
  misc_feature (115)..(115): n is a, c, g, or t
  misc_feature (249)..(250): n is a, c, g, or t
  misc_feature (261)..(261): n is a, c, g, or t
  misc_feature (263)..(263): n is a, c, g, or t
  misc_feature (266)..(266): n is a, c, g, or t
  misc_feature (268)..(268): n is a, c, g, or t
  misc_feature (296)..(297): n is a, c, g, or t
  misc_feature (302)..(303): n is a, c, g, or t
  misc_feature (306)..(306): n is a, c, g, or t
  misc_feature (310)..(311): n is a, c, g, or t
  misc_feature (313)..(315): n is a, c, g, or t
  misc_feature (318)..(319): n is a, c, g, or t
  misc_feature (321)..(328): n is a, c, g, or t
  misc_feature (330)..(331): n is a, c, g, or t
  misc_feature (336)..(336): n is a, c, g, or t
  misc_feature (339)..(339): n is a, c, g, or t
  misc_feature (357)..(357): n is a, c, g, or t
  misc_feature (388)..(388): n is a, c, g, or t
  misc_feature (395)..(395): n is a, c, g, or t
  misc_feature (448)..(448): n is a, c, g, or t
  misc_feature (454)..(454): n is a, c, g, or t
  misc_feature (456)..(456): n is a, c, g, or t
  misc_feature (465)..(465): n is a, c, g, or t
  misc_feature (470)..(470): n is a, c, g, or t
  misc_feature (474)..(474): n is a, c, g, or t
  misc_feature (480)..(480): n is a, c, g, or t
  misc_feature (510)..(510): n is a, c, g, or t
  misc_feature (516)..(518): n is a, c, g, or t
  misc_feature (527)..(527): n is a, c, g, or t
  misc_feature (529)..(529): n is a, c, g, or t
  misc_feature (547)..(547): n is a, c, g, or t
  misc_feature (550)..(551): n is a, c, g, or t
  misc_feature (572)..(572): n is a, c, g, or t
  misc_feature (576)..(576): n is a, c, g, or t
  misc_feature (593)..(593): n is a, c, g, or t
  misc_feature (870)..(870): n is a, c, g, or t
tagtgaatgtggcaataacaaaaccaacacacagctttaaatngcaagcatatgacacaccggttataaagnttttccaactctactgatttantctttcacaccagctactgtngaggagggcttccgagggaagccacgtgtaaacgggtcatctgtactagtggtgagcaaaactaattacatgagaactatcaatggccatatgacttgctttcctaggcaatccacccaaaacataggtgagtnnccaaatctcangngtncnttcatgtggatctatagttctagttttnnttttnnggnttgnngnnnttnngnnnnnnnntnntaganatncaaacagtatcggcaganggcaaccttaaagcacctttaaaatctggancctttcncacaatttaacccagtaattctcaaacattactgttgaaaagaatcacctgangagacngntaaattggnaggcncccnaaatcngcaattttaagataagcactccgggtgatncagtgnnnattagccancnatccaatttcagaacacngtnnaaaatgcattaaaacaattcntacntcccacaaacaaaagtnaaggaatctgctgacagtcactgtgcttttgtcaatgtcaagggaccaatatgggaaggcaggcaggaaggggcctcccattcctaacacactgatctatagaagccctgtgcaacagcctgtcaagtgttgtttagggagtaaatacaattcaataagagttgttttagatcacagaacagcatccaaatcaccaacaggccaaccccattcatcccaggttaatgaactttgttgggtcgaagccagatgggacactgctgttcaaacaaaacangggtaattgtgggtcctgacttgtgaaga

SEQ ID NO: 621926 - DNA, 316 bp, Homo sapiens
cctctcctactgtatctattcagacattggatctcctagattcagtcttcaaaatccctatattttctctcctctttcctaaacagcttcaacaaacccttctgaaccctttgaggattctgggatatacagaaggttggttctaggctttctccactgctgatttaggattccacttttctcctgtctgctaccacttcttcatctgctttatatttttcaaattttgttgttctgtctttcactcaactaaaattatctcagtgctatccatgtggcaggccctattctaggctcctaggatacagtagggaga

SEQ ID NO: 621927 - DNA, 225 bp, Homo sapiens
cagggccgcgggagttcgccacaccgcgcgttggggctgtggttggccgccggctctcagatatatttttgccatcatcggatcagtttggagatatattagaaggtgaagtggaccattctttctttgacaattacctttgaaggaggaaaggaattttaactcttaccttagtttttgccaagcaaaatgatgccccaagggaagggtttggttaggttccca

SEQ ID NO: 621928 - DNA, 420 bp, Homo sapiens
agcgccctagacagccgccccacacccctgggaggcccagcaggtgcccgcgaggcaggtgtgcagctcgccatatgctctgctgagcgtcgggtttctgccagcatctttcaatgacctaccaggtgagataaagtgagtggaaaggggcccgtgccaacctgtggctgcacaggccacttctgggtagggacagccctgaaacctgggcagggcaggcagaggagggacaaatgtcagggtggataattgctttaaaaatcccctgcattttagaaacagggaaggtttatggctaaattagatatataccttccaaatgcactgtctgtctctgcagagcccagatttggagctggaagcctaagatagggccccaacttttctccccgtcatggccacctggggagccttaaaaaa

SEQ ID NO: 621929 - DNA, 290 bp, Homo sapiens
gtattgttcattcttgaccatctccggggattataagaaaatattaagtggggcatggtggcacgcctatagtcccatctacttgggagagctcacctaagcctgggaggtcgtgactgcaatgagccttgctcatgccactacactccagcctgcctctggagtagctgggactacaggtgcccgccaccacgcccagataattttttttttttgtattttatagtaaagatggggtttcaccgtgttagccaggatggtctcaatctcctgaccttgtgatccacccg

SEQ ID NO: 621930 - DNA, 115 bp, Homo sapiens
cagcaatgataatatcaatgacacctgtccgagcgtctgcggggtgccgctttccaccctcagacggatgatacatctcaatgaacaccttcagtggagtactcggagctccgaa

SEQ ID NO: 621931 - DNA, 632 bp, Homo sapiens
tggccggtgccgcctataacacttttttccacccgaacgtagaggccttgtggacagagcagtgatgtatgactccctggggccgcgcgacgtacacccttttgttaaccgaaaagctgaggaaattccgtttccgaaaagagacagacaatgctgccatcataatgaagggggacaaagaccggcagatggtggcgctggaggaagaatttcagaacagtttcccccgaggagctcaaaatggagttgccggacagacagcccaggttcgtggtttacagctacaagtaccgtgcatgacgatggccgagtgtcctaccctttgggtcatatcctctccaggcctgtgggctgcaagccggaacaacagatgatcgatggaggggaggtaaaacaggctggtgcagaccagaaagctacaaagtggttcgaaatccgcccactgaagacttaatgaggcgtggttccagaaaagcccccttctttcgcaatctttggctggggaaccgaatcctggaggccgggccctcaggtgacctggggccttggaacccctaggaaccgcgccaccaaaaaatttaagtgccgtactcgtcgtagtctcgcgcccccgcctggcgcccatctgatcg

SEQ ID NO: 621932 - DNA, 138 bp, Homo sapiens
caagaatgacactgtggaaaaaaaaaaagtctctcactgtggtctcataataaaaggacactccatttcccatctgggccctgctccttaatgttagccccctcctgtggggaggagggggtgaccttcagcacacgt

SEQ ID NO: 621933 - DNA, 396 bp, Homo sapiens
tgtggagcgggggttgaggcaagagaccaaggaaaggaggtatcagtgtgagggtgaagaacaggcagcagagggctgtctctccccagaccagcatgtcaatgcctgaaagcccaggagatcacagcagagggggtgcccaggaggaagggacggccccccaccccttgcctccctggggcaggatgggggcagggcaggggaccttcttgccttccaggagccaaagggaagcctgaggccccagtgccactctggcccaggcatgggcagggccccaggcccagcggcaaactaggccttctggggtctccggccgacttggaaatagtagtaaatgctgatgacgacaaaagggaggcggttgacccaggagcagcaggctccccagggaca

SEQ ID NO: 621934 - DNA, 300 bp, Homo sapiens
aaaaaccccccccttttttttttgggggggggggcccgtttttttccccgccccccccggggggggggaaccccctttttttgggtaatataggcagcacatttttttttttttcccccccccacccttttttttttttgttttttttgaaagagggccctggggccccccccccccccctttttttcccccccctttaagggggtggggggtttttgtttcccccgggggggggggggggccccgggggtttccctttccctttttttggccccctttttttaagggggccccccttta

SEQ ID NO: 621935 - DNA, 450 bp, Homo sapiens
  misc_feature (191)..(191): n is a, c, g, or t
  misc_feature (450)..(450): n is a, c, g, or t
ggcaatccggagccctgggggttgggcagcactcggcttccggtgcaatgtttgaaggtgagttgcgaactccgccctgtatgccggtgctggtggcccggtgcgctggaaccgcggcgacccgtcgagcgcgggacagcggcgagggccgagcgcccggttctccgcggccgaagaggtgtctggggganttgttggggcaagttctggtgcttgatactgccccctgtgtgctgccccgggtgtctgcgtgcccccgagtggtttccaccttaaagagtcaaggcgccatttccctcttcccctccgtccgggactcctggtatgggggatgttccccttggagcttttttttcttggctccctcccgggggtgttcttccccacttctaatttcggttcccctcagggggttacccgccctcctggtttagaccatttggctcaaan

SEQ ID NO: 621936 - DNA, 266 bp, Homo sapiens
cgggggcccagaagataaacagcagatcctccttctgtctctccatggtctcataggttgcatcagtagagggcatagcggcagtccttatctggcagacatcttgacaaaggtggcgtatggatcgtcgacagtctggcccacatcgcccaccacgatctcctttccctcctccaggatgatgttcttcttgtcctcactcaggcagaagagcaccgccttcttgcgcttcttcacctcctctggcgttgaagacttacgcacct

SEQ ID NO: 621937 - DNA, 123 bp, Homo sapiens
tagctgatgctttgaggcacaaggaggagacgcaggccggtattgcatgcagctgtcccagatccaggactgatgggcagtgtggaggagcagctggcccagctacgctgtgagatggagcag

SEQ ID NO: 621938 - DNA, 269 bp, Homo sapiens
ggaggatctgtgggcacagataggaaacagaggcttacagaggtgacaaggcaggtggagcaggctggcctgggttccaaaagtgtccctgtgctggggtgcgaggctgccaaggggacaggagggaggctgggtacttacctttccctggaacccagaacagtgctgggctttgtcttgggaccctgccgcttgtgctccaagcccaaggtcagcttcattgcacacttccttgatttggcccgtctctttttttattcgttttttga

SEQ ID NO: 621939 - DNA, 541 bp, Homo sapiens
  misc_feature (67)..(67): n is a, c, g, or t
  misc_feature (70)..(70): n is a, c, g, or t
aaaagaaaaaattgtattcgggggcccaggcaacagatcccctgttccggatgttaggattccggcnacnaggagcgtggggaagagcttttgtgccaaggttataaaatggttcccggccatttttcacgggttcaaaacctggtggcacggggttttggcctgggttaaagaaaggtggtggccctggtccattcagggcaggccctttggaaacagttccaaagtttttggtgttttttgtcaaaggtttttatgtcctttttccagtccccggaggccccccgggggggcaaggaggggtttcccccccaaaagtggtttgaacccccatcctcaaaatgaagaaattgaccccccctttgcccttcccgttacgggggaccccccctgacccctccctcagttgtcttgtgccccgcccttttccgcacaatcagtccccctgcctggggttcctcccccagtttttacctgggggtgttgccctggcttttttataaaacccgtttttttttccctggcaggggggatcccctta

SEQ ID NO: 621940 - DNA, 413 bp, Homo sapiens
caggaatatgcagtcacgctgattactatgatactggcgatatatatatactcacggatccgctgtaactctagcataacataattatggaccgtagtgtccaacctggagaatgcacatactggacttctgcagattcaaaaataacatacagcaagtatcacattcagtttcagcattattcgtaaacctaaaaaacatgccacaatcctcagtacaaattaagagaaacccacccactaaaaagcttatgagacgttaagaaaatcacaatcaacaagaaaagtaatctcatttttaaaactcatcattaaacatggattaagaataaaaggactatctgtttactgtgcttgtgagacatgctccctactgaagcctgttaagtactatcttccagcgatagccaccct

SEQ ID NO: 621941 - DNA, 792 bp, Homo sapiens
ttaggcgtgtagcgcggcagggtcggctcacagtgctgtactggttaacgcctgacaagatggttactgctatggtggcatccattggatgggcgtgcagcgtggtgactttgtgctgtggcacttggctgcctgagccgagcctgaactggcttgtctgtcgagtgcgatacgagttcaagcccgatggagaaggagcgcattggccagttcgtctttgcccgggacgctaaggcagccagtggctggtcgtctgatgataaggaaattagttgcagagaaattgaatatcccttggaatcatattcgtttgcaaagaactgcaaaaggaaaaccagttcttgcaataggactcatcgaatccttaccctgaatttcaactttaacatcgtctcatcaaggcagagtatgcagtgcttgcttgctgaagcctgagactgcaagttggaattgatataagtgaagactagtttgccagggtcgtggttcaattccagaattctttcagtattatgaaaagaagagtttaccgaacgaacagaatgggtaaacgaatcgagaagcgtttaaggcatgcagtggacatcagacttggcatagtggtaggatagggaattggggcacgttaaagggaaaagggcttcagtgaaagaggccaattggatggttgggacttagggacatatggaactttgccagccgggacgtatgaaattgttggagtcttaatcgtcgcaattgtaagacctttgggaattactacgggccaaagggtttgaggtaagcagaaaa

SEQ ID NO: 621942 - DNA, 282 bp, Homo sapiens
  misc_feature (80)..(80): n is a, c, g, or t
  misc_feature (184)..(184): n is a, c, g, or t
  misc_feature (237)..(237): n is a, c, g, or t
  misc_feature (249)..(249): n is a, c, g, or t
  misc_feature (262)..(262): n is a, c, g, or t
taatccctgctacttgggaggctgaggcaggagaatcgcttgaacctgggaggcggaggtcacagtgagctgagattgtnccactgcactctagcctgggtgacagggtgagactccatctcaaaaaaataaaataaaataaaatattggcaggccattgtttcatcaatggtaaacgtgtgtnccccagtgcagagatattttagacgcaaaaatgctttgctacaagtcaagggnaaagcaaccccngaaagaagcaaangatgtttcacaccaataaac

SEQ ID NO: 621943 - DNA, 1507 bp, Homo sapiens
  misc_feature (1135)..(1135): n is a, c, g, or t
gtattcttttttctaccaccggacctcgtgtgtcgtgcccccttcgccctctctttggagccacagtatgatagaacgcatgtgcgtttcacccaaaacacaccggtgcttgaacccctcgtctccggattttccccccgggggtattacgtttggtacacactacatcgcgtcttcccgggcccgttgttgtgccacaacgaacaccaatggccgcccctatctcgaaatatgggcccggcgccataaaaggggggggcccccagaagaaagaaaaacttggggtgataatcacacacgttgttatctaagaagaaaaggagtggggaaatagaaggtggggaaaacggccaactcggcgtatagtggttcccaaaaaaatgaaaggagaatatattgtgggggaagagaaacaggccttctcggttccagccccagggggatcctccctaggggggcacccccaagagatggtgcacttctctcggagtaggttttctcaaaagggggtttctttgtggctttttgaaaggtgggaggtctctttcgcctgtgaattttttcgccacgaaaattggaattgggaaaatgtttggcacttgttttggagaaaatttgtcctaggccctggattttattcctcgaaaggagagtgtttttcacgggggtgtaaaaaaacttcgccccccggggcttaagaacttttcccccctgggggcacatcgggagtttctttatacccccggtggaccccaaaaaatggttgggtttcccacatggggtcacaaagagaatatggggcaccgagcccacactggagctgtggagatgcctttcacacgcttggagtatggtctccaggagcctattccccgaaatgggggtgtatacctgtgggctttctcgcttctcgttttctcgcttgtttggggttttttatactataaaaataaacgcccacacccacacatcacagagatatccggagaagaccccctctctaatatgcgctcacagcacaccacacacacggggtcccgccacacatatctcgggagaagagaagagatgagatggagaaactcacatgagactctcgagagagagggtgcacagagacacacaatgagacctntgagaaagagaggtgggtcacaataagaatttgagatgtccacgagcacggcacattggagaaagaacactatgagaaaaggggcttgccacacttctatatttaatcctctctccacatcgagatggttcttcgcttatagagaaaagtataaaatgctcgaagaagcccacaagtttgagattggggaaagctcactggaggcttcactggtgaaaggcacgtagtttctgggaaaagccacactggggaacgaaaacacaggtgggctaaaagttgaaacgaggctgatggatatgaaccccccagtcccagaatctgtttaaagttcagacttcaaaatagtggccaaataaaaagtgctatttgtga

SEQ ID NO: 621944 - DNA, 522 bp, Homo sapiens
gataattatatgcacagaggagggtacagggatctctcggaaactggttttaaatggtctaaaatggaaactacctaaatacccatcatcaaaggagatactaaataaataatggaatatccatactacggaatactaagcagaacttaaaaaaggagatagatctatctgagcatagacggaaagacctctaagacatttagtggggtcatcaatcccaaacagatacgtattggataacaaaaggtaaaatccaccaaacggataacacgggcatttccggaagcgggacctggactggggagtgagggttagggtcccttaatataattggtaatggctttcatatgtcataggagaataggtcaagtattacttatataactaaaattaatttttaaaagcaaaggaaacaaggtccttacctagatgatcctggtagctctcgggtctggccatctccagtgggagtaaggagatccatatgaaaccttaaatctctcatctcctcggtagtgacca

SEQ ID NO: 621945 - DNA, 311 bp, Homo sapiens
  misc_feature (37)..(37): n is a, c, g, or t
ccacggtagactacatattagacacgaaaaaagcttnaatgtcagaagattgaagtcatacaaatatattctccaaactcagcacaatgaaactaccaatcaatagcaaaaaaacaaaaaacaggcaaatccacaaatgtttaggaattaatgcagtttttaacaaccaatgggtcaaataagaaatcccaagggaatttagaaaatatctggtgattaatgacaatgaaaacacagcataccaaaactgatgggatggcgagaaaaacagtattaagaggaccgtcttattaaaaagggagaaagaactc

SEQ ID NO: 621946 - DNA, 166 bp, Homo sapiens
  misc_feature (11)..(11): n is a, c, g, or t
  misc_feature (21)..(21): n is a, c, g, or t
  misc_feature (55)..(55): n is a, c, g, or t
  misc_feature (95)..(95): n is a, c, g, or t
  misc_feature (104)..(104): n is a, c, g, or t
  misc_feature (129)..(129): n is a, c, g, or t
  misc_feature (138)..(138): n is a, c, g, or t
ttgccgattgncggattcctnaacgggtaaattatcccggggtaaggcgcaaatnaacttttcggtctacttccgttacaaaagccgagggcttngggtatttncccgggccttttcttgttattccgnaattccacnttgaaaggaacaagcggctttgccttag

SEQ ID NO: 621947 - DNA, 373 bp, Homo sapiens
attgcgggactcgggtactccgatatctgtatacgcagaataattgtgtagcgtttattacgttggtggtggtgttcttgagacggagtctcgctctgttgccaggctgcagtgcaagtggcatgatctcagctcactgctacttccaactccttgcttcaagtgattctcctgcctcatcctcctgagtagctggaattagaggcgcctggctacacgcccagcataatgtttgtatttttagtctgagactaatttccaccagtttggccacgctggtcttgaactaatgatgtccggtgatcgcactgcctcggcctttcagtgtgtttaatttgtaaagcatattactttattgcatagtctatgctgt

SEQ ID NO: 621948 - DNA, 327 bp, Homo sapiens
  misc_feature (11)..(11): n is a, c, g, or t
  misc_feature (190)..(190): n is a, c, g, or t
  misc_feature (261)..(261): n is a, c, g, or t
  misc_feature (284)..(284): n is a, c, g, or t
  misc_feature (322)..(322): n is a, c, g, or t
cagggattcantgagatgatatttgtgaaaacattaacataggccgggcgcagtggctcacgcctgtaatcccagcactttgggaggccgaggtgggcggttcgcgaggtcaggagatcgagaccatcctggctaacacggtgaaatcccgtctctactaaaaatacaaaaaaaaattagccaggcgtanggttgggcgcctgtagtcccagctgctggggaggctaaggcagcagaatggcatgaacccgggaggcggantttgcagtgagccgagattgcgnccactgcactccagcctgggtgacatagcatgcctctnttttc

SEQ ID NO: 621949 - DNA, 193 bp, Homo sapiens
cactccttcagttcaggtcaagttcagtgctgttcaagccatttgcatccatggcacattaaggggcagggtaaggcagtcatcagtgcacagctttcaaagttttcagttttgttcccagccagtcactggcggcaggcaactgtgaaagccagcactccagggcacaccctccatcagcacatgcacacat

SEQ ID NO: 621950 - DNA, 799 bp, Homo sapiens
  misc_feature (627)..(627): n is a, c, g, or t
actagttctagatcgcgagcggcgcccttttttttttttggtccttggggggggatcggatgccatggatatatctaaaaggggggataaaacttcttaaaaagctgagaaatcaccataaataaaaaggctaaacagaatggacaaatttatatcaacttaaagatttaaaaacggcccagaagacattaaggactctcacttatgaaatggttgggctttggccactttcctcctggccttggctatatggtagaatcacagaacttacttagagaataaatatgtctatggtcaagagtaacgggtttaactcagtgaccaaggggagtgtacatccaaggtgagtgtattcgggaaacgagggaatttacagttacagtccccatggagtcaaatcccattttatatatacataaaaattaagtccggagggagtcctagctaaatatacagtgcgacggtaaacgcagccaattttttaaagcagaatatgagaacacctaagtatcctcttcatagcagtccctataaggggataaaacacttatttcggtgttagggtcctaatccatatatttttcatagcaccttttgtgggaccctatattggtgctggaaggtgtnggatatgtggaccccagtataagccatgggagtcatgatggtgcccaagtggatccaagctaaaatactagaccagcatcctaggggctaataaatagtctcactggttccaagtgctttaacaggtagtgtctggaacatcttcaagtcctctagggcatttatcaatctg

SEQ ID NO: 621951 - DNA, 684 bp, Homo sapiens
ggacgcgtgggcaaaaaagaaggggcaccccgggagggagcagaagaagcaccatcatcaccaccatcagcagatgcagcaggccccggctcctgtgccccatgcagccggcgagccggcaggcaataatgacggcacagaaggacacaaaacaacagcataaagagagacaaaaataaaaaaaaaacaaacacaaacaaggacaccacatacaaaatagaacaaaacctacagtgcgagagtacgctaaacctcccagtgccattacgacatctgaccaacaagccaacatagaagcaaacatatacaaaacatacgtacaagagtccgagaccgaatacgacacaacaaaagagacagacagtgaggaccgggcgacagaccacttaacaagacgccaacatcttcatcatagatgtcgagagggagcgagagagggcatagttgagataaaagacaatagagaaaaatgagcgaaggactattaaaatcgtacagagcactcatagtagtcgtggagctgctagacacacgataagaacagcagagtagtatagctcaacaagatagacatgcactcaaacatcgatatcgagttaacgcaggtatataaagatgccgagactaaaataaagataatacaaagtaataactaaaaaaatagaacaatactcaaagcgcgac

SEQ ID NO: 621952 - DNA, 140 bp, Homo sapiens
agcagagtcttcgtgcgtgtaagttagtttcgcgttggagctagactcagaacaggctcacacatgtggagattaaggataggagaagaggcagtgggagatgcgtgtgtgagggtggggctcagctgtgggacacggcg

SEQ ID NO: 621953 - DNA, 423 bp, Homo sapiens
  misc_feature (260)..(260): n is a, c, g, or t
  misc_feature (266)..(266): n is a, c, g, or t
  misc_feature (274)..(274): n is a, c, g, or t
ctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccatgtaaacaccaaccaaaccatccctatgccanttatcnaatatggntaacccttgttttcctggtatatattctatttccaaaaaatcaacttgtggcatcatttcaaggtctactcaaaagtaacactgtcaaaaccactaatatgtatgtaaaaattgtgctgtatactccaataaagttgatacttggaaaa

SEQ ID NO: 621954 - DNA, 657 bp, Homo sapiens
agcatggacaggctgatgcagtgttgggcgtgtctgtacgactgattcatttttataatagagtcgcttcactttcatattttattttctctaatctaatttagtgagtctaagatacattgtggtatagtttggctctgtcccaaaccaaatctcatcttgaattgaagttcccctaatccccacatgtcatgggagggaccaagtgggaaggtaattaaatcatgggagcagttgcacccatgctattctcatgatagtgagtgagttcttataacatctgatggttttataaggggcttttctccctttacttggcatttctctgtcccggccacccagtgaagagggacttatttgcttccccttctgccacgattgagacctctgcagccatgcagagctgtgagtcaattaaacctctttcctttacaaattacccagtctcgagtatgtccctatagcagcatgagtacggactaataccatattgtatcttacattttaatgtctctgaaattagcatgcctctcaaaatatatgaagtcttacagtcactgctggccaggagacagtttgcaagtgcacatgggttaccttaatttcactggtgctagtgcactgcttagtgaagttttgtacttgtggaccacatgt

SEQ ID NO: 621955 - DNA, 312 bp, Homo sapiens
ccagctcacccgctgtcagctggggtcctgctctggtgggaggaagaggctcacactcttccctgccctctccccttaaccacctctaggcagcggctcccatgatgagcactttgacgactaaagctgagccggcgccgccacgaccttgggcgggtggtcggcctctgccctgagcaggaagtacaaagtctcagcagacccttcctgaggtgccggcaccagagtggtgagactttccacctaacaaacctgtgtctcatgctgacacaggcccgcctttttgatgtatgatatgaactaggacaactc

SEQ ID NO: 621956 - DNA, 272 bp, Homo sapiens
ctagaggacccccaacgatggtctcagctgatccagtgttcgacgtctggcgtattctgaaggaagacatggaaatgaagcgtctaacacttgtatcagctgtgtgtgattggccaggatgtgggacaattacttcataattccaaggcatctaatatgatcaacagtgactcagatcaactgactcaacgatgggatgctttggttcagagacgagcagatacactccgcccccgtgagacacgcggtggcacaacccagggaccacgttg

SEQ ID NO: 621957 - DNA, 521 bp, Homo sapiens
  misc_feature (318)..(318): n is a, c, g, or t
tggaaaaagtcttggaggccagggggtgggcttgaaaccagcttgggggggttcgattccttcctttttggtctaaatttatgtatacgggttcttcgaatgtgtggtaggggggggggcactccatatagtcactccagggtttatggagggttcttctactattaggacttttcgcttcgaagcgaaggcttctcaaatcagtgaaaattattaatattacgtgcgtgcttagagaaagtgaagtgagcctacagatgataggagtgttccagtggtgggtgtagtgcactcggggatagctccgagtaaggtcgngggcattcccggataggccggagaaacggtgttgtggggacagaaaggttagatttacgcgccgatgaactatgatagcggaaagcggatttgaggcgctagtgtttgggtctaggtgtgtcagccgtgagaataggggcaaatcagctgaatggaagcctcctaatgatgggagaaatacaggctcctcatggatgaggaca

SEQ ID NO: 621958 - DNA, 344 bp, Homo sapiens
acaaatggtgctagaataacttgatatccacatagaaaaagaatgaacctcaatcactacctcataccataacaaaaattaattcatgatggatcatagcacagtatgtaaaagtcaaaaccacaaagcttttagacaagagattatatccatgacttaggaattcacaaagctttctcagacagatagacgacaataatcataaaacagcaagaactggtcagctagacttcatcaacaattcaaaacttccactccaacgattccactaagacactgcaacggcacaccacagactcggcgacaatactccaagaacacgtctctggcacaggacatctaca

SEQ ID NO: 621959 - DNA, 293 bp, Homo sapiens
  misc_feature (69)..(69): n is a, c, g, or t
  misc_feature (84)..(84): n is a, c, g, or t
  misc_feature (108)..(108): n is a, c, g, or t
  misc_feature (163)..(163): n is a, c, g, or t
  misc_feature (218)..(218): n is a, c, g, or t
ggagccccgggaggtgtgggtaccgagaggtgtgagtctggcaggtgcacacccaggcagggaaggctnacccgaccggctgtntctgaaagctgtcagaagcctgantggcctgctagagcggtttcctagccccgccgtgcgccattcccttcctggaagncctgactttaaaacctcgtcagtctgcagtggaagtggcagcgactcccattttntgaatgcctttggtgtcgggttttgtgtcatttccttccgtgctttgcctgaggaagtggtgttactgatggaga

SEQ ID NO: 621960 - DNA, 105 bp, Homo sapiens
tgtgattttagcaggttgtgggccctgagctgtgaccctgcacctagattacccatgcaggcctgcactacccttgcggagtttgctgtgatcgtggggttgtaa

SEQ ID NO: 621961 - DNA, 684 bp, Homo sapiens
ttagctcttgtggctcaggatggagtgcaatgacgtgatctcagctcactgcaacctctgcctcctgggttcaagtgattctcctgcctcagcctcctgagtagctcgggacgtataggcagtgctgccaccgatgcctggctagattttttgtattcttgtagatacgagagcgaggttttctccaatgtttggtcagtgctgcgtcttaaagctctctgaccgtcagtgtgatccagcctgctcttaaagaaccaagttggtgggcattacacggctgtgagccgaccacgcctccgtgcacgcgaagactccagcattacttaagacctacagaactcatacattcgcaagtactggtggtgtcgaaggtaagtggattacggacagtaacccagtcttcgaccgccgcatgtcgtgtagactcttgccgatcaggacttggaaggcaacgactgcttgatacgcgtccaagatgtgagcccttgactcttccgaaactcttctttcaacaggccagaagtggaatgaacctggactcgaatttgccagttcctggttggacgttgtggttacactctcatggcttcctgaccaccgcccatggaccacatggtcactagttggtggactagggccttctgagttgacaggacgtctgtccgcatggtcttctgatgtttc

SEQ ID NO: 621962 - DNA, 584 bp, Homo sapiens
agcgggttctcacatggcttcagattctatcaacctcaatagaaatgatctcacacagagaagcttattctctcccaaccttctacggctataatatccacggagtattgttctcctggggatctgcccacaggacaaagtccataaaaagcaaggtccctgtcctggaccagtgtgtgattaatcctagaacgcagttcagccaatcgaccagtcatcaatcgataaccggggtcatggctttctcaacgtggtgctggtcagaagggaatctttgataagaggcccacaggcagggaaagcgaagatagggttgactgagaccaggggatacctagaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtctctggctcggggacaattataagttgcaaaaaggatagaggcatattccaa

SEQ ID NO: 621963 - DNA, 123 bp, Homo sapiens
aattcaagcttctaacgatgtacggggacatgctgattaaagggggaaatgcaaatgcaacagtgacaaaagtacttaaagatgtgtatgcactgaaaaaaccatacggtgtactatataaaa

SEQ ID NO: 621964 - DNA, 103 bp, Homo sapiens
gtactcagtaatgtggctgtgtgcacgtaggtgttcagtaatgcagtgcccggccatgcatgtaggtgctcagtaaatgctgggcgggtgcacagtaggtgct

SEQ ID NO: 621965 - DNA, 642 bp, Homo sapiens
ccctgtcctgcagacctagtgctggttgcagattgcctggagggaaggacagtccctgctggggaagaacagcccggtggcccctggtcacgagactcagcctctgctggagaaagccacggcgctccctgctagcacagaggcctgactgacttttttgcttaacttccatgttctgggtgatggaaactgccaaacctcctgtcagtgaggactctttccgactgccagaaagtgggggtggaggaccgaggctacagctccacactggccccggtcccccagagcatctgcccgagtgtacacactccccctgatgcccgcactgactgctgggagccagactgtccatgcgaaacagcctctctcttttctacacactcaggcacaaagcccccagctctcacatctgtgtccagctccccctcttattgtaagtatgtgaaaaggaaaaaatgcaaacgttggagtctgggctggagctcctccctccagctgcgacttttaactactgtactaatgtacagaggaagctgtaggtgtactaagactctgtgtggcctgtgcaatttctgtaccattctgcaaattaagaaactactaacagattccattacgctacttttaaacagaacgtaacac

SEQ ID NO: 621966 - DNA, 332 bp, Homo sapiens
  misc_feature (257)..(257): n is a, c, g, or t
cggaactttgactttatttttcagattgtactagttttttaattaatgtcatttttcttttccaggatccaatctaggataccacactgaattagtcgtcatgcctaattagcctctggtctgtgatagttccacagtctttctttttcataaccttgacagttttgaggagtactggtcaggtgttttgtagaatattcctcaatttgggtttgtctgatgttttcctcatggttagagtggggttatagattttnaggaagaataccagaggtgaaggtccttctcactgcatcatgtcaggagttacatgctatcagcttgatggtgta

SEQ ID NO: 621967 - DNA, 153 bp, Homo sapiens
agtacccagggtggggggggcgtcaaaaggaatgctggtgtatgtatccaattctgtcccatcagcctggccacccccagctagagtatgggaacggcgctactggtcagatgcagggaggatggagcttgactcagccacctgaaatgcaga

SEQ ID NO: 621968 - DNA, 479 bp, Homo sapiens
atatgatttataaatatcctattctttggattgtcttttcagtttcttgatagtgtcttttgacacacagaagttttaaatttcagtgaagtccaatttatgttttttcttttgttgtttgtgtttctggtttcgtatctaagaacccattgcctaatctaaaatcacaaatgtttatgcttgtgttttctcctaagagttttatagtttcggcttttatatataggtttatgatccatttgtagttaattttcatgtagggcataagtaaggggttggtccaacttcattattttgcatgtgaatatccagttgtcccagaaaaaaaaaaaaaaaaaaacaaaaaaaaaaaaaaaaaaaacaaaaaaaaaaaatacacacaataaaataaattaacaaaataacacaatctaacaaaaaaataacaaaaaacaaaaagactcctatactacaaacaaaacataatattctattcttcc

SEQ ID NO: 621969 - DNA, 883 bp, Homo sapiens
cacttcggtgcgggagaagcaaaagtaggtacagttttgtgccatgtggatgtacgagtgtctgaaatgtgtacgagacttgataataaagaacccttaaacttatgttcatgttcctgtaaataacgtatagtatttatttacgctactgaatgtatgacatgtacttcattcattttacaagattctttccctttctgtccagatatatacagtatagtaaagaagaggaagtctatcactgtagtgataattgcatcagaatggggcacacatgtattgaatttctatccataagtagtccgttgcttgaggctgtagtatcattgagatggttgatatcatgtgggggaatggggttggataaaggcaatgaaactttagtataaacaaatcccagctatatctagcgacatttatatttctcggtgaaatacagatatgtgccttgctggagttagttatagaaggctgtcagtatgtatctacggtgcgagtactaaaatcagtattcatttatgaagtgagtagagtgggtgggtggggttaagggaaatgagacttggaattgtagtttatcccagtttggagtatacatagggttggtcgggtcgagaacctcataagtgaagtgcatagaaaacagcgggtgacaggggagcacgacttcgaacgatcacacaagaatcgatacggagaacaaggtcaacagggcgaccccgctggaaggagtcgaccaccttgtaactggccaccgggcggccgcgccggcgcgaaaccgtgcacacacgggcccgcgccgaacccagggccaacgcacaggagaacaccacccgggggacaacccgtcatacacagcgccccccacaaacaaacaccacgc

SEQ ID NO: 621970 - DNA, 233 bp, Homo sapiens
  misc_feature (223)..(223): n is a, c, g, or t
atttttttttgcaatgcagcattttaaaattttgtgtacatttttagacataatgctattgcagttaatagattataatatagtgtaaacataacttttatatgctttattgcaatttttgctttatggtggtggtctggaactgaatacccaatatctctgaggtatctctgtatacagttgagagttgcatataaatataagaaaaaaattatgttttgtnctattttaaa

SEQ ID NO: 621971 - DNA, 254 bp, Homo sapiens
ggtgttccgtttgtcttgggctagatcgatcaaagatgattctttttgaattctgaatcataaattacacttttttttttcaaattcacaaaattcataggggtgcgagaccgtaataaccactattgcgcaacatcccgtaaatctgcctgttgccatgccaatggagtgactgcactggtcacaataagacaaagcatgctatgtgtaggctggtcgaatgcaaccattgtgcatacactccgtaccctcag

SEQ ID NO: 621972 - DNA, 892 bp, Homo sapiens
cagacgcgccactatgttagcgggtttcgggcgggcaggcgtgcgggaaaggaagccatgccccaggcgagcttgcagctccaggagcttcgtctctgtacgtcgtgcgagaagtgcagcctgctcagttcttcagacgcaggttgaccactacaggcatcacagccattgagagtgtacctgtcctgtgctggtatttcaatttgacttaagccaagctatcccttcaggtacgagtaggaaagggcctctatgtaagggccaaatagtgcgtacctaacttgtagcaaccactgtgtccgtgcaggtgccacaggagctatgagcatggacaatgctgggtggcagcctagggcagtgtagcgcaggtgcgttcatgtccaccttttcaaccgttttcatttagttgtgcacaagtcggaggtggattcgttgtgaggggacaggctgcgcccaggaccagcgtccgcccccgctaagcgtcaaatgcagctgagccttacccctgaatactctgcagactcgcgttcctgaatccgtctatctaaggcagctatagcgatggtccgcagagttgctacaccgaagccctctgtggggcacgggggacggtcatgatgaaagcgtggatttagatgccctgtgtaagttgctattgttcgcaaggataatatatttgtagggcggtcatgagattatatgtggttaaaggtgattgagtaaaagcgcaggtctgttccggcaataaagccctcatttgtaagctcaggtgccagttcgagtggtggagaagctggcaggttagtaaattagtggttggaaaacaaaaaaaacaaaatggagatagcgaagtggcaaaaggaggggttatgggggaaagcaaaagaagatg

SEQ ID NO: 621973 - DNA, 274 bp, Homo sapiens
gctgcaggaattcggcacgaggcgcacagcacctcgcgttgcaaattccagaattctggatgggtgtaactggtcaccagaagcgcattgttgaatgcgttggcaccatcaatttgaccaaggtgtgggtgcaactgcgcacacccagtaccttgcgggtttgcaacaaggcttcaatacgcgataaatttgcgccatgggcatgtacacgggtgcgtgtggggcatgtgaacggcattccagttaatgggcaaacacttgcgcactggtaacg

SEQ ID NO: 621974 - DNA, 713 bp, Homo sapiens
tccattttaaggggggtgcacttttattcaacgggtctcaagtcagggtacaggtaagcccgggtggcctccacccactcccagggagaccaaaagccttcatacttctcaagtggggggacaaaaaggggggaagggggggcacgaaggctcatcattcaaaataaaacaaaataaaaaagtattagggcggaagattaaaaaatatttgggcgtattacataatttacacgaaagcaatggctatcacctccctggtggtgggactggggagaggactggggccattctccttagagagaagggggggggctttaaggaggggcagggggacttcctggtaacaacgctatctcatattgggaatggaactattaaaaaaacaacaatggtggcaactcaaagtcctcggcgccacataggtggaactgggggggaggctcgctccaaccggacgggcgtgtgcaccttcaccggtcgccagttttaaaatcctggagtcaggccaaaaaaaaaaaaaaacccaaaaaaacacaaaaaaaacccgggggggcccttatatggggggggcgggaaaacggggtaatagaaaggggcacggggccaaaacggggtccccgtggccccagcctttttggtccacacgggggggaaaatcgggggggcccccaaagagggggggggaaaaaatcggaaacggcggggtaccagag

SEQ ID NO: 621975 - DNA, 158 bp, Homo sapiens
aacctgggacccactttgccatcactcactgcagcattattcaaggattctatttcctcctcacacctgacgcatatactttctgttcccgggctccttcacctgtactcactctttgttgagtctcccacaattaccattgtccctggcccggactt

SEQ ID NO: 621976 - DNA, 373 bp, Homo sapiens
  misc_feature (33)..(33): n is a, c, g, or t
  misc_feature (47)..(47): n is a, c, g, or t
  misc_feature (59)..(59): n is a, c, g, or t
  misc_feature (138)..(139): n is a, c, g, or t
  misc_feature (161)..(161): n is a, c, g, or t
  misc_feature (203)..(203): n is a, c, g, or t
gaccatgaaccatgcccatttatgacagtaaanttgatccataaatnttgggtgtgttntgactgctccatgaccagccattctgtatctccttctccttaggcccccctatgccctgagccacaaaaatattaaaannaggccaattaataaccctacantggtttctaagtgttcaagggaaaggaagaattgcgcatctntcactttaaatcaaaagctagaaatgattaagtttagtgaggaagggatgctgaaagtggagacaggctgaaagctaggtctcttgtatcaaataatgagccaagttgagaaggtagagaaaaagttcttgaagaaaattaaaagtactaatccagtgagcacatgaatg

SEQ ID NO: 621977 - DNA, 344 bp, Homo sapiens
ggcacgaggtgttgccttctccgcgtggtcaaagagtcattccacgaataaccatagaaatgaaagcagaggcagagaagagaaatagagaattaagaatgagcatactgaaggaagccctcaagaagatggtgtggaactagaaggcctataacaaagattagagaagagacagagtagagaaccaggtacacagacaaagagacaaactacattggcatttaagccaatcgacgaaagtaatattgatgtccctttacgagagacagagccacggagagcagcaacacatacacaattcacacatggatatggattcagatggatatctcagatattgatgg

SEQ ID NO: 621978 - DNA, 3194 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 621979 - DNA, 1160 bp, Homo sapiens
  misc_feature (1160)..(1160): n is a, c, g, or t
tgaggaatgtgttagtgtctggagccatgaaggccttgtgctgaccaagctgctcacctcggaggagctggctctgtgtggctccaggctgctggtctaggaatgtcctaaccgagcgttctctggcgaaaatcgagacaaggaatatacgacgagcaatataacgagccacctcggacggcctgtaaacccactaatacctaggattactctcgttgcggaaaaggcagcgtgtccgtattatcccgacttgtgttcgtcaggtttggaatacaggagctatcttgggccttggctctagagttggtagatagttttacgaacaatacgtataatatgtgaggaacaatagaatataacaacagaaataaatggcggaattggaacgcggaagaagaagcgcatttaacacacagcagatggaataacgcgaattggactactaatagatgcttaagcatggcaaagataacaaaatggagagcgtgaatgatacacgcatgggcaatctaactgcactacagcaaggcctcacttgcaactgatactgacactgctctcactactgcgcagcgcgcgctcccacaaaaagctacacacacacggcgcacctgctctaacagaactggacttaaattacgccccctcttgctgcgaataactgcgcggcagacagggcatagccaaactttaacaacttcactttgctgcgctcacacaaccaaaacacccacgcggggcctaacgccttgcgccatatgctatcaatacactctgacttgcggcattcgcataacggccttagaactggtggcaaaccaacgccaaccccacaacctcttgcgcatgggcaaggcaactgcccgctacttaatttttaacaaataaccttaccacacagtcgccgctggcggctggcttaacaacctacgcgcggcgcaccttgcttaaggcggcaacaacgcacaaccttacactaactttatttggaagcgcaaaaaggcgcttggcagtaggcactagcagcccactcttaaactaagcgcgcgcgactgggcttgcgcagaaaaaacactggtcagcttgtggcatttttacacttacttgcttaaacttaacgcgctgccaaccagacaaaacgcataacttacttcctgcgn

SEQ ID NO: 621980 - DNA, 995 bp, Homo sapiens
tccggcactgtgaagccgcatattgtcacagttatcccgcgggtgaatggcacatcgttcttccccaccgcttgtctggtgtatcaatcatgcaccccctccctgagcattcatatggatgtggtcgaccgtcaattaccacctcgcttgtgtggcactcgagtgctcacaggcgtatcggctttggcaactatcgtgagtagaggttgtagaactgacccaatgattgcagtggtgcatggggtcttccccattcctcctgacacccccggggtcattgggactagcagagtggcaagctgacaatggcttgctactctgagccttgctagcaatgggaagtagcaagcaagcaacggggcaaaccgtccatggacatgggacagacaatggccacacacacaccaccacgatacaggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 621981 - DNA, 118 bp, Homo sapiens
agccgggccaaaaaaacccttaataccttttaagaatgccacctatgccttcctgccagatgcctttggagcaggtgctttctgggctggagctttttgacccttctgtcgtcttctc

SEQ ID NO: 621982 - DNA, 393 bp, Homo sapiens
  misc_feature (11)..(11): n is a, c, g, or t
  misc_feature (26)..(26): n is a, c, g, or t
  misc_feature (59)..(59): n is a, c, g, or t
  misc_feature (92)..(92): n is a, c, g, or t
  misc_feature (104)..(104): n is a, c, g, or t
  misc_feature (129)..(129): n is a, c, g, or t
  misc_feature (185)..(185): n is a, c, g, or t
ggagcccttanaccgccccattgaancccctgggggctcagtgttgttgcgagaactgnttgcgcaggcaatgttgctgatgctaccctctnagcccaggccanacctctgctgcatgcacttggggcngcccatgcctacatcatgatgtttgttcatacttgcagagttggacagagtgaaantcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 621983 - DNA, 2146 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagttagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 621984 - DNA, 218 bp, Homo sapiens
aataagacggtaccattggtcgagagaaattaggtctacccgccgcagtactgatcattctatttccccctcttttgatccccacctccaatgtatctcatcatgcaaccgacgtaatcagccagctcatcaagtgtctatctctaaactaacctctggtgataaatgataacctatacacacacactaacaggacgaacctagatctctatatacta

SEQ ID NO: 621985 - DNA, 587 bp, Homo sapiens
  misc_feature (158)..(158): n is a, c, g, or t
  misc_feature (483)..(483): n is a, c, g, or t
atgatgtttccgcctctcacaacaggtggacacaccaccatatttgtataaaattatacggtgtcttttttgccgtcgggccaccccttcgtcggagcgaataaggagagcgcaccatcaacaaaaaggataatatcttttatatgtctctttggggnggcgctcatcatataatcgtgtgaaaatagagatctcacagcgagatagagagagatgtgtataatgagccccacatatattctgtatacacacagtgttcacagtgtatattctctcacacagagagaccacatcttacacacccttctctatagagagtggagagtgcacacacatcgcacggcgagagttgtggagaatgtctcacagagaggtgggtgttaattattccacgtctcttgcctctaaccctctaatatctcgtgttcaccaagagtaatttattgtactaatagctctttttattttcttaaagaggttatngggagtaaggagaaatgtaagtgtttgctcttcatttactaaatgattgtaaacttgagtttttcatccaaataaaattcccttgttttaaagtttctgaccca

SEQ ID NO: 621986 - DNA, 2893 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtgtgatctgtccgcccaagggccagaaggccgggagcacggggatgggagcgcccgcaccctggctggaagatgaacttcccgtaagcacgtaattcctgcaggtccggcagctacacctggagtgtggggcctggtccctccccatgcccctcggtggggctctcttgggcccctcactcccactggcaatgtcacaagggctccccaggcccctccctgcctcgggcagcccccagccctcctccttacccaacctcccatccagaaccttgctgccagggcctcccagctcgctcctgcgccaaaggccagctgtcaggtgctatgcggggtcaccagcagagtgcccgctggcaggtgggggcttccccgcttccggggtctgccccaggactcctgggtggacctcccccacccacctccgctgactcctgcaggcactggggagctctgctggaattgggggtttaaaacttcattagcagatttgtgctcttccatactgtttgtttgtttgttaggtgaaatacagtgtggtgagctgcactggtgacaacagcccttacctggctggggaggtgtctccagcgagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggttgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttttcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 621987 - DNA, 960 bp, Homo sapiens
  misc_feature (200)..(200): n is a, c, g, or t
  misc_feature (203)..(203): n is a, c, g, or t
  misc_feature (206)..(206): n is a, c, g, or t
  misc_feature (331)..(331): n is a, c, g, or t
  misc_feature (359)..(359): n is a, c, g, or t
  misc_feature (378)..(378): n is a, c, g, or t
  misc_feature (387)..(387): n is a, c, g, or t
  misc_feature (399)..(399): n is a, c, g, or t
  misc_feature (404)..(404): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (461)..(461): n is a, c, g, or t
  misc_feature (464)..(464): n is a, c, g, or t
  misc_feature (472)..(472): n is a, c, g, or t
  misc_feature (478)..(478): n is a, c, g, or t
  misc_feature (506)..(507): n is a, c, g, or t
  misc_feature (509)..(511): n is a, c, g, or t
  misc_feature (513)..(514): n is a, c, g, or t
  misc_feature (517)..(518): n is a, c, g, or t
  misc_feature (524)..(524): n is a, c, g, or t
  misc_feature (529)..(529): n is a, c, g, or t
  misc_feature (562)..(562): n is a, c, g, or t
  misc_feature (570)..(571): n is a, c, g, or t
  misc_feature (597)..(597): n is a, c, g, or t
  misc_feature (599)..(599): n is a, c, g, or t
  misc_feature (618)..(618): n is a, c, g, or t
  misc_feature (626)..(626): n is a, c, g, or t
  misc_feature (632)..(632): n is a, c, g, or t
  misc_feature (636)..(636): n is a, c, g, or t
  misc_feature (648)..(648): n is a, c, g, or t
  misc_feature (655)..(655): n is a, c, g, or t
  misc_feature (659)..(660): n is a, c, g, or t
  misc_feature (663)..(664): n is a, c, g, or t
  misc_feature (666)..(667): n is a, c, g, or t
  misc_feature (669)..(671): n is a, c, g, or t
  misc_feature (674)..(674): n is a, c, g, or t
  misc_feature (680)..(681): n is a, c, g, or t
  misc_feature (685)..(685): n is a, c, g, or t
  misc_feature (692)..(692): n is a, c, g, or t
  misc_feature (697)..(697): n is a, c, g, or t
  misc_feature (703)..(703): n is a, c, g, or t
  misc_feature (709)..(709): n is a, c, g, or t
  misc_feature (716)..(716): n is a, c, g, or t
  misc_feature (718)..(718): n is a, c, g, or t
  misc_feature (725)..(726): n is a, c, g, or t
  misc_feature (750)..(750): n is a, c, g, or t
  misc_feature (758)..(758): n is a, c, g, or t
  misc_feature (766)..(767): n is a, c, g, or t
  misc_feature (771)..(771): n is a, c, g, or t
  misc_feature (774)..(774): n is a, c, g, or t
  misc_feature (787)..(787): n is a, c, g, or t
  misc_feature (791)..(791): n is a, c, g, or t
  misc_feature (798)..(798): n is a, c, g, or t
  misc_feature (820)..(821): n is a, c, g, or t
  misc_feature (824)..(824): n is a, c, g, or t
  misc_feature (838)..(838): n is a, c, g, or t
  misc_feature (846)..(846): n is a, c, g, or t
  misc_feature (857)..(857): n is a, c, g, or t
  misc_feature (870)..(870): n is a, c, g, or t
  misc_feature (877)..(877): n is a, c, g, or t
  misc_feature (933)..(933): n is a, c, g, or t
  misc_feature (949)..(949): n is a, c, g, or t
  misc_feature (955)..(956): n is a, c, g, or t
gtcttcagctgcctggtcacgtggcaaacatctggcggtgacagagtagccacccagaggagacagagtgtccatcaccgcaaaactcctacagcagaagtagaacgtgggcaaggtcctcatcgtggactgggacattcaccatggcaatggcacccagcaggcgttctacaatgacccctctgtgctctacatctctntgnatngctatgacaacgggaacttctttccaggctctggggctcctgaagaggttggtggaggaccaggcgtggggtacaatgtgaacgtggcatggacaggaggtgtggacccccccattggagacgtngagtaccttacagccttcagagacagtngtgatgcccattgcccacnagttctcanctgatgtggtcntagtntccgccgggtttnatnctnttnaangacatcttttttctntaggtngataatctntnacngacaaatntttttnacactttaccagggaggttattagggtnngnnngnnggnnagttanttgtntaggtataatgattagattagtttagagggatnttttattnntcttattctttattttttttctcttntnatattatataagttaatgncttttatnagagantttntgaggcccctgngccgctncccnnctnngnncnnntcncccccnncctngcgctgncgcgncccccnttgcgntatgttncnccgttcnncgctggtctgggccggtcccgcgngagggccngctggtannccgnggnggccgagactgtnagcnccatggncttgctgtcggtgggggccgannganccaggctgcggcanccgggaanaccgccccagncaggcaaaagagnccatggnaccggagcataccctgtaacgcccaggcgcccaaccctctgggctactcccatgtnattttgtttttttttntataannaaaa

SEQ ID NO: 621988 - DNA, 188 bp, Homo sapiens
  misc_feature (71)..(71): n is a, c, g, or t
ggtagagatgggggtctcactctgctgcccagactgctcttgaactcttggcctcaagtgatcctcctgtnctggcttcccaaagtgctgggattacaggcatgagccaccgtgcccagcccagatctttaaataggaagaagggaaacagagctgatgttcatatctccgagggcatcagtttccat

SEQ ID NO: 621989 - DNA, 2100 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 621990 - DNA, 916 bp, Homo sapiens
  misc_feature (129)..(129): n is a, c, g, or t
  misc_feature (132)..(132): n is a, c, g, or t
  misc_feature (135)..(135): n is a, c, g, or t
  misc_feature (260)..(260): n is a, c, g, or t
  misc_feature (288)..(288): n is a, c, g, or t
  misc_feature (307)..(307): n is a, c, g, or t
  misc_feature (316)..(316): n is a, c, g, or t
  misc_feature (328)..(328): n is a, c, g, or t
  misc_feature (333)..(333): n is a, c, g, or t
  misc_feature (346)..(346): n is a, c, g, or t
  misc_feature (349)..(349): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (706)..(706): n is a, c, g, or t
  misc_feature (714)..(714): n is a, c, g, or t
  misc_feature (722)..(723): n is a, c, g, or t
  misc_feature (727)..(727): n is a, c, g, or t
  misc_feature (730)..(730): n is a, c, g, or t
  misc_feature (743)..(743): n is a, c, g, or t
  misc_feature (747)..(747): n is a, c, g, or t
  misc_feature (754)..(754): n is a, c, g, or t
  misc_feature (776)..(777): n is a, c, g, or t
  misc_feature (780)..(780): n is a, c, g, or t
  misc_feature (794)..(794): n is a, c, g, or t
  misc_feature (802)..(802): n is a, c, g, or t
  misc_feature (813)..(813): n is a, c, g, or t
  misc_feature (826)..(826): n is a, c, g, or t
  misc_feature (833)..(833): n is a, c, g, or t
  misc_feature (889)..(889): n is a, c, g, or t
  misc_feature (905)..(905): n is a, c, g, or t
  misc_feature (911)..(912): n is a, c, g, or t
gcataataaagacacactgggcctgggggccggatgatggcaaatccattcttgagctctcctgcagccaccttgaaggccagctccagcaggcgttctacaatgacccctctgtgctctacatctctntgnatngctatgacaacgggaacttctttccaggctctggggctcctgaagaggttggtggaggaccaggcgtggggtacaatgtgaacgtggcatggacaggaggtgtggacccccccattggagacgtngagtaccttacagccttcagagacagtngtgatgcccattgcccacnagttctcanctgatgtggtcntagtntccgccgggtttnatnctnttnaangacatctgtcatccatctgggtggcgtacgtctgtcacacgctcagatgttttggccacttgaccaggcagctgatgacccatggcagggggccgaggtggtgctggccctgtgagggaggccatgacttgaccgctcatctgtgatgcctctgaggcttgatgtctcggcatctgctcaggtgtagcagctgcgaagccccttggcatgaggcagtcttgcagcaataagcccctaacatcaactgcagttggccacagctagagaaagtcattcggagatcctagagcaatagcacatggagctgtgtgcagaagttgcgccggctggtctgggccggtcccgcgngagggccngctggtannccgnggnggccgagactgtnagcnccatggncttgctgtcggtgggggccgannganccaggctgcggcanccgggaanaccgccccagncaggcaaaagagnccatggnaccggagcataccctgtaacgcccaggcgcccaaccctctgggctactcccatgtnattttgtttttttttntataannaaaa

SEQ ID NO: 621991 - DNA, 152 bp, Homo sapiens
  misc_feature (5)..(5): n is a, c, g, or t
acggntaattactgatgtgattcgaaagttgtagtgcctgcaagtgcaatgttgcgatcttggcactgcaatctctgcctcctgggttcaagcatctactcctgcctcagcctctggagtagctagtattacatgcgcacaccaccacaggt

SEQ ID NO: 621992 - DNA, 524 bp, Homo sapiens
tgtacactttgtccagggctatagacgagagatcgagagtatcaggagattgagactatcctggtcaagcagtgatgaaaccccgtagctagtaaaaatacacacaaaaattggctgggcatggtggcatgtgcctgtagtcccagctattcgggaggctgagacgggagaatcgctatgaacctgggaggtgtaggttgcagtgagccaagatcatgccactgcactccagcccgggtgacagagtgagacactgtctcaaaaaaaaaaaaatgtcagcttaaacttagaatatttagtgtcggctttaagctagtgctgagaccataaccactgtaaccgggcactcaaagagaaggaagactacgagtctaccttcttgaatagttcttgaacttccaagagatcctggacatgccaatcgtaagtatatttggtccccccaatcctagctataaggctgctgggatggtcctcacgcttggtatctccagcaagtgcctggcccaaaatcatacaagatg

SEQ ID NO: 621993 - DNA, 2607 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgcaaaaaaaaaaagaaaaaaaaaaaaaaaaaaaaaaaaaaaaaaaaaaaaaaaaaaaaaaaaaaaaaaaaaaaaaaaaaaggggggggggcaaaaaaaacccccgggggggccaacgcacgcggcgtgctcccccgctgttgttgatgcaaaaaggggggcccccaacgagcggtcgcctagaatacaaacacacaggagccgaggccgcacgatataaaccaccgtcccgcgagggaggaacacgacacgtcacggcgggcagctgaaggggagaaccgagccccctctcggcgcggggggtcgggcgcaattggtcggacgaacagcacaccaaccagagaagtcagcgccgccagacggagaaaacataaacaaaaacgaacagagctcgctgcggcgaacaccaaccagcgagcgtcgtcgcagccgggagagacttgcgcgaccgagagtagtcaacacaagcacaacttaccgcgcgcggaggctagagagacacgcgacgaca

SEQ ID NO: 621994 - DNA, 209 bp, Homo sapiens
ggaagtcctaccccatccaaagtgcgcctcgactcctgggtccctgccccagtcaagcggcggcggatgaactggatcgacgccccggatgtacgtgttctacatggccacagaggagaccaggatagattgcaagctgctctcatcctcggaaacacaaggcgtgctgccgccggggtaggacttcccgttgagcaggacccttgccg

SEQ ID NO: 621995 - DNA, 2531 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgcaaaaaaaaaaagaaaaaaaaaaaaaaaaaaaaaaaaaaaaaattttgtggggggggtggggcagaaaaaattttttaaacacattttgtgtgggggcggggacccgagatagggttaaactgtaacactgggcacaatacgcgtggtcccaaaaggaaaaccgggggccacagaactatggcgggtgtggtgctttctcccaccccaatataaaaaagcgcgcgcgggggcacccgccgagcgtgtttggtgaaccaaaatccgcaagaggggaggttccgcagagccaccatcaggggcgctctacacagagggtgcccacaggcgagacctcgatattaaattagccgccccgccggcgtgtgatgcaaccacaatacaataagaatacaccgaacacaaagataaaagcaaataacagacaaagagaac

SEQ ID NO: 621996 - DNA, 1762 bp, Homo sapiens
  misc_feature (2)..(2): n is a, c, g, or t
  misc_feature (4)..(5): n is a, c, g, or t
  misc_feature (1741)..(1741): n is a, c, g, or t
  misc_feature (1746)..(1746): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatgngaagngcgggggaagccaccc

SEQ ID NO: 621997 - DNA, 148 bp, Homo sapiens
ctatgttctcgatcttaaatgttttgttttggttttttgtgtgttggttttttcagatggagtttcactcttgtgcccaggctagagtgcaatggtgcaacctcggcttactgcaatctccgcctcctgggttcaagtgattctctgg

SEQ ID NO: 621998 - DNA, 3293 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 621999 - DNA, 360 bp, Homo sapiens
cacgatacgggcgactcctgacattgctgcccgaaagaagcgaaattttattctggatcagactagatgtgtctgctgctgcccagtaggagaaaacatgtgcctgtttgcaggcttccagcgaaaagctgttgtattttgcccaatagatgatagactataatctaagaacacagacgatagcagatagttgaggggaaagacctaccagaacatgcggtcctcataatgaaaggatactttaccctccctacgaggtagctgagtgctttgatgtaatatcctatgttgaacttcatacggaagaagcccaaagactcttggagcaatattaggcagaaagcatataggctcttccac

SEQ ID NO: 622000 - DNA, 230 bp, Homo sapiens
cagtactggtacttgtgtggatcctgccacagacaggaagtctgaggtgctcttggtcaggttacatgtctgtaggcctggatcgcttatggggggttcagaacctatagcgggagttgaatatacttcttctgattacatgacatcttgcgtggctgtaattcctttacttacttgaaggccattgttactccgtccagagatgtctctgtcatgaacaccgatttttt

SEQ ID NO: 622001 - DNA, 572 bp, Homo sapiens
  misc_feature (290)..(290): n is a, c, g, or t
gggaaactctatagtaggaggctcacaatcatggaggaaggcaaggaggagcaaagccaatgtcttacatagtggcaggcacagagagagcttgtgcaagggaactctcatttataaaaccatcagaactcttgagatttattcactaccatgagaacagcatgggaaagacccgtccccatgatttaattacgctcccactgcatccctcccatgacaggcgggaattatgggagctacaattcaagatgagattggggtagggacacagtcaaagcatatcattctgnccccaaaccctcccaaatttcatgttctcacattttaaaaccaatcataccttccccaaagtcccccaaattcttaactcatttcagcataaacttaaaagtccatagtccaaagtctcatttaagacaaggtgagttccttccacctaggagcaaatagtttccaaatttgggagaaatcacgcagagagaaacaaatatgctccaaatttggttcacaggggttaagctgtccagtagctcacacgaaaagttccttgactctgagcatcctcgatgagg

SEQ ID NO: 622002 - DNA, 166 bp, Homo sapiens
aaaggctccaggattcgtagatacaaataaattggtcaccaatggtactgaacctacgagtacaccgactacggtggactaatcttacaactacctacatactatcccccattattcctagaaccatgtgtgatctacgaaatccatgggtacctgagcatcgaat

SEQ ID NO: 622003 - DNA, 461 bp, Homo sapiens
actcggatcaccgccagtcgcagccatacctattcgttggtggggcaaatcgaagagtactctgagcgtatacacgtcgtaattattaacaattggtagccactgagagacgggagatgaggctgagagaggagagcggaaaggattgggggatgtcactcactgcttaatcacatcattctgtgattacaaattcctcccaatgagacatgcatcatttttatgattgagaacactagaaagagctatcttttccgtctatctggtgtaatcaaatgtgacagaatgtctagctttattgtttggagccaattataaaaaatttcatgtttgatatcagatccttaggacatcagaaatggacattcagaagaaattgtcctcaagatgtattatttatttgataaattcttaccaataacagtctggatttcctttattattgcctcttcaacattaag

SEQ ID NO: 622004 - DNA, 101 bp, Homo sapiens
taccgcaaatgtgcccaatgtggacgggctacagcttggttgtatacattttagggagacctaagccatcactcagtacatgtaagaggtacattgatttg

SEQ ID NO: 622005 - DNA, 304 bp, Homo sapiens
caattaacagcccagagtagtctatcaccatcagcggttatattatctgcctgggctctcggaacagcaggacttgtagtaggagctgcgtcggcggtgacagtggacttggagagcgcgtgtccacagcaggaggacaggttgcaccgtcgatgtgcagccagccgataaagttgactggcttgtccatgctctcgatgcctccccctcccccattccctccatatttctcccaatgaaacctgactcaattatttgcatattttgacgcacctgctgcagattaacactatttatgccagat

SEQ ID NO: 622006 - DNA, 479 bp, Homo sapiens
gcgactaagaatctacaagccctagctggcaaggtgagcacatcgtctttaaacacggggcttgcaacttagctcacacctgtaccaatcaggtagtagagagagctcactaaaatgctaattaggctatcacaggaggtaaagaaatagccaatcatctattgcctgagagcacagggggagggacaatgatagggatataaacccaggcatttgagccggcaaaggcaaccccctttgggtcccctcctgttgtatgggagctctgtattcattctattaaatcttacaactgcatactctctggtccgtgtttgttctggttcgaactgagctttcgctcgccatctaccactgctgattgctgttgttgcagacaccaccactgacttccacccctccggatccagcagggtatctgctgcacttcaaatccagtgaggcggggcccattgctgctcccaatcgggctacaggct

SEQ ID NO: 622007 - DNA, 1166 bp, Homo sapiens
gggcgggcgcaccatggactcgggtaaccggaggagtatcgagcgtcaagcggctggcgcgtagcctcgcgtggcagcacgcgcggctcgcgccgcgactgccgtcggcctgggccacgtcgttgggggctggggaggactacagggacccatcaacgatgaacgcattactgcgcagcaatggaagagcggcagccgaggagcatgctggacatcgcgctgttgatggccgacggcgttcgcgagcgtggaagggcgtcgtggaacagggccccaagcttcggccgttctatgtgcgcccgtgtgtggtcctcatctccaatctcccttgtgctgcagatcgggccgtgggggtgctgctcatcttccgttgtgaagtagcgagccttaacaacccggacgaagcagcgccaagcatggacgttcctcaaacaacctggtccacgggacctggtgttcatcatcgtggtagtcaacatcttgcatcacggccttacggggtccatgaagcccttgatggacatggcaccccagcagtatgtgacacccaggagcctggatgctagcctgccctgcaagctcagctgtcgcgacccaggagtcgccatacctgtgaaggtgtccacctccctgcacatggcagtacccagactgtcagagcccaggctggcctcatctgcacatgtccccggatcagcctttgctctgactgcgggcaagcaaccacgcaggaggccacgtctggtctctcagcaggtgttcccaggaggcagtacccctggacatgtgggctggcaacaataggccagacggtcagacctgggacagtgaggagagcttgtgccagagaagggtctcgaacccagtcaggcacacacagcacgtccgggatggctggattctgacagggcccaggcaccggggccagaggaccgttgccgacaggaccaggggcgaagttctccctgtccccaaggaacacggcccggccccacggggggccgtcacggatgccctggaagcccaacctgtcactccaacccggggcagtagccgcaaaggtcagtgcacacgagcacgactgacacaaggcgggtgtgacgaaaggcgcacggtgtgcgcctcatatcaccgaggcggcacccgggacgctaaaaacgcaagaa

SEQ ID NO: 622008 - DNA, 649 bp, Homo sapiens
  misc_feature (174)..(174): n is a, c, g, or t
atgtaacctgtgacacctgaataatgttctttttggaaccgcggtgacggctggaatgggccggccccggtgtgtctttccgctccagcgcctgggaatcccggtgtgttccttcttgtgaacgggcggaaacgttcagaaatcatttcttggtaaattcgccgccaagtgggnttaagaccggcgtcgcttagatagacccacccaatcgcgcaggctgttctcttcgagatgttctccccccggaagctgatgtgctagtgctcccaaagtgatacttgcggaccaccgttctggggtacctgtcagttatcccttgtgtttccaaagaatgtggttgctcggtgtttttaaatgttggtagttcccccagggatgagaggggccttcttttagatagcctcctggggttatttcgataaatattatgtttggcaatgatgatcttttacaagacgaaaatacccacactgggtcaataatgagagacgcacggtggtcgaggtaagatcttgtggcatattcaccaagttactgaggaaagagtttctcggagatccccagtcgtccacggctcggttgcaaccctccggaaaatttttctttacagccccccgggagaacccctttcccaagcccaaccaaaaca

SEQ ID NO: 622009 - DNA, 876 bp, Homo sapiens
tcatggcgtaattgaagaaaaccaacaattaacagcagaaacaacagccaacaccactagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgacttttgtttcctaatcttaaaaaaatttttcagggcagtacatttttctcaagttaatgtctaagaaactgcattgatgtagcacaaattcccagaactctcagttctttagggatggactaaatagctgggtatccatcacttacaaaagtgtcttgaatgctatagagctaatgttcaaaaaatatagttaatattgatcttttaaccatttttccacaactttttgaagtctcctgaattatgtccatttataacggggcaaaa

SEQ ID NO: 622010 - DNA, 976 bp, Homo sapiens
taactctctatactaatctccctacaaatctccttactaataacattcacagtcacagaactaatcatataaatatcttcttcgaaatcacacttatccccaccttggttatcatcacccgatgaggcaaccagcagaacgcctgaacgcaggcacgtacttcctatctacacctagtaggctccctacccctatcatcgcactgattacactcagaacacctaggctcactacacagttctactactcattctcacatgtccatgaactagtcaaactcctgagccaacaactgaatatgactagcttacagaatagcttaccatagtaaagatacctcttaacggactccacttagtgactccctaaagcccatgtcgaagcccccgatcgatgggtcaatagtagttgccgagtactcgttagaagtaggcggtatggatataatacgcgctcacactcattctcaaacccctgactaaaacacataacctaacccttccttgtactatccctagtgaggcataatcataggaagctccatagtggctacgacaatgagacctaaaatcgcatcatagcatagtccttcagtcagccacatagccctcgtagtaacagccattactcatccaaacccctgaagttcaccggcggccttcatcgcataatcgccacggattaactccgcatacattctgctagcaaactcaacgacgaacgccagccacaggcatcctaagccgcttcaacggctccaatcgactcccactacagcctaggataccctggagcctcaaacgcggcgtaccccgattaccacgggcaccggggaaccagtccgacagacaggcacaacgcgcgcaagacagacacgcaataacaatgggcacccatacaaacaaaagaccggacgcctccagccccacggcacaaaaaaaaagcggcccgcgtgtcgtccgtatgcccagccgct

SEQ ID NO: 622011 - DNA, 886 bp, Homo sapiens
ggtccagccggtcttccgtgaacagccggtccatgatggccctggtacagcggctgcccgaagcaatctctatttgggacacattgacgtcaggtgtaccaggtgccccctctgaatttctcctgtcgccctgcaagtgccgtgggcgattgctccctttctgatcccgtgtgtccgacagaggtcctcttccttaagagttgtgcaagtgatacgttcgatttccttagcctcgaatgctgtttcctctggtagacccgtgtggtgttcgtcagtctatatcgttatgttcgcagagtgggctgactaacctttctaggtaggcccaggattgatgttttggcttcgacacttgtgttggaccctgcctgaattgtcagtagctattagtccttacaagtgcccaattctggagtccaacttggcacgtgtgtgcccacgagacatcagaagtgcatgagccaaaagggaaactgcacttccaaagtagagagtagcgctgatttgctggacgggtgtattcaacatctaagctaaatctaaactccttgagctagctcttccccgagaatgtaggacaactttcatagtttgggacttgcatgaaacgcgctatgggtttgagccactcacaccagtttcaattgacggcaatttcccataagtaaggcctagccatcatgtagtcattcgcttgtgttccaccaccagcggttcttgctccaagtcagcaaatgaaattagtgggtaccacgtagcttttcaaagaaagacccacttaccagtttgactccggtgtgcgcagttgccaggatccctatcatgaacttgcgatgcaacaattcacccgtgcatgccggaatattccacagaacttgttttaaaa

SEQ ID NO: 622012 - DNA, 1053 bp, Homo sapiens
  misc_feature (24)..(24): n is a, c, g, or t
  misc_feature (51)..(51): n is a, c, g, or t
  misc_feature (119)..(119): n is a, c, g, or t
  misc_feature (144)..(144): n is a, c, g, or t
  misc_feature (178)..(178): n is a, c, g, or t
  misc_feature (212)..(212): n is a, c, g, or t
  misc_feature (285)..(285): n is a, c, g, or t
  misc_feature (294)..(294): n is a, c, g, or t
catgaatcagccataaatattctnacggttaattttagacatctacttgantggattgagagacacacatagctggtcaaacacgatttcagccatgaatcaggcataaatattctganggttaattttagacatctacttgantggattgagagacacacatagctggtcaaacacnatttcagccatgaatcaggcataaatattctganggttaattttagacatctacttgagtggattgagagacacacatagctggtcaaacacgatttcagccatgantcaggcatnaatattctggatggttaatcgtagacgtcgacttgactggattgagagaacagatagctggtcaaacacgcatttcaggcatgacatcaggcatgcctatccggactggtccatcggtagacactctacttgagtggattgagagacgacaatagttgggtcagactcacagaatctcagccagtgacatcaaggacatagagatactccgctgactgcgtcgaccgccgcaagcagcactctaacttggcaggtcggagtcgacgaagaagaccaccatacgctggaccaagacacacgatgccacgcacgctgcaacccgcagggatcatgaatcatacctgcagggcgtcacaacagcccatagaagcccgcacctacgactcgaggcacgggcacaacaggaggaagaacatcggccagatccgcacagctgtggcaccaagactaccgcaagttcccccgccagacaaaaccgtgcagcagagtacactgtcaactaacctaggacagagaacgcaccaccaaggcaaagaagacagcccaagcgaacgcgacggacaggggcggcacagacgcgagacaacgtacgcccaataagacaagacctgcccaccccaccaccggcccccaccatcagagaaaaaaccgcgagccgacaaaaagcagatatacaccgcctacggcccaacagacgggtaagaccgacactcgtaccaatggcagacaggcgcgtcggatgccgtaaccccgcaccaa

SEQ ID NO: 622013 - DNA, 150 bp, Homo sapiens
  misc_feature (53)..(54): n is a, c, g, or t
  misc_feature (92)..(92): n is a, c, g, or t
tgtgaaatggaattccatactttatttccatttcccttaacttgatatatagnnttggtgcagttcttaccaaaatttcagcaagctattcngaagaaatagacaacatgaatctaaaacgtacacagaaattcaaaggatgtagaatac

SEQ ID NO: 622014 - DNA, 254 bp, Homo sapiens
  misc_feature (6)..(6): n is a, c, g, or t
accttntaatgggcacagaaatttcccatgtatttcccccacacaggcacagcctccctcatcatcagcatcccccaccagagtggtatgtttgttacagttgatgagccgacattgacacatcatcacctaaagtccatagtttacactagggttctctcttggtgttgtacatgctgtgggtttggacaaatgtataatgacatgtattcactattatggtgtcatacagaataatttctgtgcccatttca

SEQ ID NO: 622015 - DNA, 419 bp, Homo sapiens
cgtcgcagtagtaactgtcactcatgattcagattgtgaggaccgaaccataacagactgaatacgcagagagcacaatgagtaattggctgcgacagatgtgtacagcacatgctgacaggtaaatcttaacaacaccaaggagaatcatgacactgtgcattgcgaactggtccatgtaacacggactcagacgcgcagatttgtgtcaccataatcggaagttgtactcggtcagatgaacacgcgatatgtatctcaggatgcactgcagcgctggaagaatgcaccgctaacgatccctagatgcggcaatgtgtgaacagaataggtgagacagagtgtcagtacatttggctcagaaactgtgcgaatgacgcgttctacggactagcatacccttggcgtgacactgtttg

SEQ ID NO: 622016 - DNA, 351 bp, Homo sapiens
aaaaaggctttttaaaacccgggttcctagggtttttggggggacgggggcccagggccccctttttgttttttttgcccaggtttccctttccccggagggaaattgggtttttgggttaaggcccctttttgggccattttggggccattggccccctttttccgggggaggtggggacccccccccaaccggggttccggggcttcgggccggggggaattttccgcccccctttcccagaaaaatttaggggggcccgcgggtttgggtttgggcggttttttttttgggaagtttgggccccccccaaaagaaaatttttttttttttaaatcttttggaatggga

SEQ ID NO: 622017 - DNA, 115 bp, Homo sapiens
gattcttactgattggttgattaccaatcctttagttctagtgtctagggactatgcgaagtcagaaaaaaacagtcaccacccaaaagacaatagtgcagacaaggtggtaagg

SEQ ID NO: 622018 - DNA, 99 bp, Homo sapiens
cccaaccagacagctgtttacttctgtgccaccagtgagcagggtgagggtccttacaccggggagctgttttttggagaaggctctaggctgaccgta

SEQ ID NO: 622019 - DNA, 668 bp, Homo sapiens
ctcagctaatcacaacgggagaagggaacactggaaaggcaaatccgactggtcattgaagaaacgatggctcgatggctagcgtagagggaaaggccttccaagtaagacgtaagagagtcatcaactaaatgcatggtgaatgctaataggtatgcactctaacacactggctataataaatgacattttgaggggattagcagactattaaaataagactagccgagtattagatgcaagatgcgcatccgtaatccaaaaatcaaggccaaaatgctccaaacttgtaaaatttggagtacctacatgataccacaagtaaagaaagtcatacgcgacctggtgaccacaacctttgtttcatgcacaaaattagtgaaaatacataagtatcttgaggctatgcatataaggtgcatatgaaggacaaatgaattacgtgattagacttaggagctcgccccaagatatctcattatgtatacgcaaatattctaaaatccccacaaatctgaaatctgaaacaattctgatcccgaacatttcagacaaggaatcaacctgtacctataaagaattatcggtaatgttttagaggccataatttcactggaaatgtgtcaaaaagtcattatttggtagatttatatgctacaattattttt

SEQ ID NO: 622020 - DNA, 119 bp, Homo sapiens
  misc_feature (113)..(113): n is a, c, g, or t
ggggtccttatttccttctttattgagtcagactgctccggggagagagccccgccccagcacataaagaactgcagcctggtactgcagagtctgggttgtagagaactctntgtaag

SEQ ID NO: 622021 - DNA, 112 bp, Homo sapiens
caatttgtacttaaagaaacttatcaaccacacacacttttttgttatattttatatggctctcacctccttggcttaatgctcacaagatcagcatatttcttacagagag

SEQ ID NO: 622022 - DNA, 105 bp, Homo sapiens
ggacccccttttggggggtccgggtcccccccccttttttttcccctttttttttaaaaccggttttttttccccccataaaagcccccggggggggggggttta

SEQ ID NO: 622023 - DNA, 579 bp, Homo sapiens
  misc_feature (89)..(89): n is a, c, g, or t
aaaaaaaaaggcaaagcctggaatacgccaactgggaaaaggggatttgctccaagggcatttaatttgggtacgccaaggtcagttcnaagttgtaaaagcgggccattaaatgttaaaggctccccataagggggatttgggaccggggccccccccgaagttttttttttttttttttttttttttttttttttttttttttttttttttttttttttttttttttttttttttttttttttttttttcttgttttctttttttttcttttgagacagagtctcactctgttgtccagcctggagtgcactggcaccatctcagcttccaggttcaaggaattctcctgcctcagcctccatagtggctggggttacaggtcgcgccactgtgcctagccaatttttgtgtttttagtagagatggggttttaccatgttggccaggctggtcttgaactcctggcctcaagtgatccgaccgccttggcctcccaaagtgctgggattacaggtgtgagccactgtgcccatccccaaagagatttaacatcaccttttaaaaacatcatttggg

SEQ ID NO: 622024 - DNA, 382 bp, Homo sapiens
agactccttcttatcttgtctcttgtcctcatgctgcgccgggttctgctagctgcttccgtgggggggtctcggactcacgctgctctcccattgtcaatctccaccagtcgggtcgcatggcggcgcttggtctcacgcagctcctcactgtagatgtgcgttctggaggtccagtcctccttcatggtcgtgctgcctgttctcagcatccacccgcgggagcgatctcatcctgaagttgcttcttggcctcacctagggctgcctcaagcttgtgcacctggccccgcagatcatgcagctctgccctccagcgtgcgctcctcactgagagcagtgctcagtgcggcctccttggagttcagcagagcctccaggt

SEQ ID NO: 622025 - DNA, 293 bp, Homo sapiens
gttaccttgttggggtttaattcagagggtaacaggccgggtgtggtggctcacacctgtaatccccacactttgggaggccgaggcgggcggatcacctgaggtcaggagttgaagcccagcctggccaacatggtgaaaccccatctctacaaaaatacaacgattagccaggcatgatggtgagtgcctgtaatcccagctacttgggaggcaggaaaaactcacttgaaccctggaggtggaggttgcagtgagctgagatcgtgccattgcactccactccagcctgg

SEQ ID NO: 622026 - DNA, 1144 bp, Homo sapiens
  misc_feature (489)..(489): n is a, c, g, or t
  misc_feature (504)..(504): n is a, c, g, or t
tgtggtggctcatgcctgttatcctagcactttgtgaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccgggtgacagagtgagactctgtctcaaaaaaaaaaaatacggaatataaaatgttgctcctaatgtctgctgttttaggtggaagaaatatcccaccacacagaaaagagatgcttaaaaagcaaacaccccctaccttctggagcattttagacgactttgaaatcacccagacatttgagtccgcagctgtgaaaggcttcctgtactgtacagtgagaaattgtctttatgcctantatctcactttatangaagtctgagaataataagaagaaaaatatgagggatgcccatgatgatcacttgagttggaagactctgataatggcaggcattaagaatctgaaaggttcaaagtaaaatttaaaatgcatggatatatttgccaaaattttccaagttcaaatattgatccaactggaggccatttatcacctttggccctttggaggcacaaaaacttgctattggagcaaagctggtttcccaacgggggaaaagttctctcatggctggcaacacagctgggtattcacttcagaagataatccccctggttaacccaggccttctttacaggggaccttttgaaaaagtgcctcggaggtcacaatcaggggtccactttcaggggtaacacttaaattccctcaactaacccctaagacattggccccacacagggcaagccggatttaaacttttggggcagccggttttcaccgtgccagaatccgacaccctgtcattggaacctgcttttataacttactctgtgtggtcacaccttccacccctctcacagtcgccgcgcaccttcacccgggacgctcctcgccacctctttcttaacctccatccggtctctccccaacttctcttcgccgcccg

SEQ ID NO: 622027 - DNA, 220 bp, Homo sapiens
gggaacgtctctcagttgattatggcaagaagtccaagctgggagttcttccattttacccagcaccccagggtttccacaggctgttagttgagcccttacaacttccattctcaacaaccacaacaaccctggagcactctgattgtgccttcaatggtagacaatgaggccatcttatacatctgtgtagaaacctcgatatcgagcgccaacctca

SEQ ID NO: 622028 - DNA, 269 bp, Homo sapiens
cggtagaaggcatctatcatgtataagagagctctagacgtctctatggagaagtgtccttgataacagcacatgggggcatgaactcgttaagggtaaattttaatatgaaagatcctcatgaattaaatagttgatgcaatttttaacgttaatagatataaaaaaaaaaacaacaaaattaggctggtaaaactgacttatacataaacgggggttaggaaatctagccccagacataaggtcagagatgggtaccggagctcgaa

SEQ ID NO: 622029 - DNA, 192 bp, Homo sapiens
  misc_feature (177)..(177): n is a, c, g, or t
ccattgagagatatcgattgaatccgattatgctatcctaagatcatacgaggaacatctgaattcagcaggggagagtggtaaaaacatggtgtatcaatctaacaaaatatgtatctattaaaaatacttaatgaccaaatattaatgtttaatatacactaagattttcagttnataaaactttctcat

SEQ ID NO: 622030 - DNA, 405 bp, Homo sapiens
  misc_feature (123)..(123): n is a, c, g, or t
  misc_feature (129)..(129): n is a, c, g, or t
  misc_feature (134)..(134): n is a, c, g, or t
  misc_feature (208)..(208): n is a, c, g, or t
tgatccggaagatgaagcttctggccgggaaaacaagacggccgtggttgtggggaccataactgatgatgtcggggtcaggaggtaccaaactgaaggtatgtgcactgcgggtgacaagcngggccncagcngcatcctagggcagggggcaagatcctacttttgaccagctgccctggactccctaaaggctgtggcactgtcntgctctcgggtcctcgcaaaggcccgagaggggtaccggcattttggcaaggccccaagaacccccgacagccaccccaaaccctacgttcggttcaaaggccggaagtttgagggtgccaaaggccgaagggccaaccgaaggttccaaaaattaccctgggttctacttttttaataaaaaagatttttggttgc

SEQ ID NO: 622031 - DNA, 277 bp, Homo sapiens
  misc_feature (10)..(10): n is a, c, g, or t
  misc_feature (73)..(73): n is a, c, g, or t
  misc_feature (77)..(77): n is a, c, g, or t
  misc_feature (82)..(82): n is a, c, g, or t
  misc_feature (97)..(97): n is a, c, g, or t
  misc_feature (102)..(103): n is a, c, g, or t
  misc_feature (116)..(116): n is a, c, g, or t
  misc_feature (118)..(118): n is a, c, g, or t
  misc_feature (147)..(147): n is a, c, g, or t
  misc_feature (159)..(159): n is a, c, g, or t
  misc_feature (164)..(164): n is a, c, g, or t
  misc_feature (173)..(173): n is a, c, g, or t
  misc_feature (178)..(178): n is a, c, g, or t
ccacagttangtagcttacctcctcaaagcaatacactgaaaatgtttagacgggctcacatcaccccataancaantaggnttggtcctagccttnctatnngctcttggtaggntnacacatgcagcatcccgttccagtaggtnaccctctaaatnaccangtcaagggncaagnatcaggcacggagcattgcgactcagacggttaggctggccacacccgacgggagacgcgattattaaccgttggcataagcgaagtttactagctata

SEQ ID NO: 622032 - DNA, 1113 bp, Homo sapiens
gtaactctgcacagctggtgatttactgaaagaacttactctcataaaaccacagccagcgagttctcagagacacaataatgcaccttaattatgagtttaaaagctcttgtcttgtgaaatgtaatcgatccacagaaaaatcataaagtatacatgtaatagcttaatgacttataaatgaagatctgtatacttcccactcgaaaaacggaatattgcaggatttgagtacacaacccgtacctttccaacgacagcctccctcccaccagagcttctgctgagttcacttgaaatcacttccttgcatttatttatacttttattaccttgaggtgcatccctaaccattctagttcgattttgcctggtgtttgaactttatattaatggaatcataggacataattcttatatctctggtttctttcattcaactttgtgtctgcgaaatgtatccatgttgcatgcaacgggggctcattcatcgctggttactgattcactgcatgagtatggacacagtttattaaccattttcactggctggatggaacatttgatcatttctagtttgggggattattattaataatttttggaaccttcttatttgtgtgccctgatgtacatggacatgcattttaggggtgtatacttagggaaatgccggttcatgagtaacacctatcttcaggtattactttttgtgcccttttatgctgaactacaatttacgtgcaataccaatcattcatattaagtgtacaactcagtgagtttagacaactggacaccttgctgtgagtcaccaccaccgagatgatccagcactgtcccaactcccccacaagttctcctttgcaggcaccctctccctccattctgggcacaggcaaccatgaaccactatctgtcaccgtagctttagtataaaaatttcacatacatgggactcaggggagccatacgagtctttcctgtcttggcttctttccgctggcaaaaatgctgggagactttctccaagttgctgcatgaatcactggatcatatgtaacgtggctgaccagaattccacacatccgttactcatccatgcaaatgatg

SEQ ID NO: 622033 - DNA, 1653 bp, Homo sapiens
  misc_feature (199)..(199): n is a, c, g, or t
  misc_feature (1265)..(1265): n is a, c, g, or t
gtacgaagggaccaacattatgtattcgtgtgactcaatacgcgcggcggatacttgtagctacgaataaaactactccatggtagtcgtacactggtggagggagtaccaccgccaactgatggtgggttggaaccacattatgttcttgttgaggtagcactaacacacttctttacctagggaggcacacacgganctcccttgtatagtggtgctgaaaataagtaagaactgtcgaatgtagtgggttattccaacctactcagctggatagggcgctcgcctttaatgttaataggtccctcggggggtcccccccgcggtgtgtttcgtaataagccgtctcggggtcttcctccaagtgttttctccacagccgctgcttttcctctcctttccggcgggataaaaaagggtttgtgacacaactgctgttttcaaaggggggttctccaatccgtctcggtgtgggagacgcagaacatgggtgtgaaccccctcaggggttcgcctaataggttgtacacccttttggccgcggcgaggataatgttttccacagttttaacacccacggggggaacctcttctttgttgagaacctgtcctctcatctctctattttgcctgcggggagaccaaacccgtttcccgcgtcggaggttacaacacgcgcgttccatgccacaacattgtccgcgccctgggggtgaccacccgaatatggtcttgttgtaacccacagaggcttagggcgggttctttttgcacgcgttcgcacgccttttctgttcgtgttgtctacagcggcattggacgtgtttcttggcacattcgcaggtgtgttccacccgccgtcgagggggcccccacctggggcgcccctctgaacttcggcacaagtggcggctgtcagcacacccctctgggtgggttttcccctcacgcttggggcacagaaacgctctgtgggggtttgtcagggcctctgtgtcttccgcgcacacgcgactgtttacacctcgccggtgtcttttccctcggagttcacttgtctgcgtatattgagtaggggggtctctctctctgtgggaatggcccccacgtcgctatacgctgtgatcaccgccttctcacccgcacacacgttgcacaccgcgaggagcaccacagctgtagatgtatgcacaccgcgcgagaattttcgtcacacatgtggcggaccacacacgtgtcacatattcttgacacaccacactcgngggatttcttcccctcgggttcgcggggctctcctcggggctctatggcgcttctgccactgaactcttcctctctggccacgtcttcttctctcgagtatactccgcggagttctctctcacggagcgccacgcgtcaccactttcacacctcgtgggcaacagaagggaacacggtcacgagcaccccacggcccacccccacgagaaccctccactgaactgtgctttccacgcctttcccggcacggttctgggaagtaagggaacagaggctgaaagccttgtttccctcttcacaggggggccaacccttgtttcccacttgtgggagattttttcctggcatcatgccattttgaatataaagccgattttatccaatgga

SEQ ID NO: 622034 - DNA, 1540 bp, Homo sapiens
ttgcgttttgccgcttctgtcgttttcaccttgtttctgttcatctgtgtgtgttggctcgttctgcgctcgcgccgtctctctatttgttctttgcctcttgtctgccgtcgtctctcgttagttgttgctcttggctgttgtgtgtctcgcgtactcgtggtctccctcctgctttcctctcccactttttgttgtttgtctcgtaggatgtatgttctcttctgtcgcgggagaggttcttcttgctcatcatttgtggtgtagctctgtggtctgtttcgcgtaagcttgtgttctcctctagtgttttttccttcgtttcttactctctcgtcgtgcctcacttctgtgcgtcgactttgtctgtggtgcctacgttgttcgttgttggctcgctcatttatgttttgcttctctgttgggtgtgttccctcctcctccccctgttttcttatgtcgtctgcactcttgtcgcccgcgttgtgtgttatctccctgtttctatttgggtcagcaccgacctctcgtttggtctcctgtgcccgggtgacttctttcttctttttgtgtgctccttgggcaccacttcctttagttgggggggttttcacaccatagggtcgtcttcctgcctccctcctccctttgttgtggggcccctcctccctctgttcctcccgcgggggggttaataccctgttggtggttcacgaccctttcactctcgctctccctctcgtgaagagtgtggggtgttttctccctctgggtgtggggtcccacagagatccccgctgtcaccacgattgtgttgtgtaaccgtcggaattgtatgggccgtgacaccaaccttgtgggggggtccccccccatagtatgttttcccgtgggtgttcccgcgcgagctctcacactcttgtttttcacgcgcattttgggggagcatatttttgctcccttgtggggttttctttttcggtgtcacccccacgaggggcccccccccgctgtggggggccccccccacccgctctcacaaatgtgctcacctgtgtctaccccacagagtttgtgcccaaaagaccccttatgttctctccttctgaattggggcgcacacacgaaagggtgtgtccaccgcgtgggggtgtttgagtgcacacaccacaagaaatgttttatgagaaataggcgctcccccacactttcgggcggttcccccgcgggctggggcctccgtgtttgtgtcccgtctcccctctttccaccgccgtcccccccacgccttgtgggacaccccctgttcctcccccactcaacacacacaccccaaaccactctttttgttttttgggccacctacccccgacccccttttgcttcccacaaccccacttgggcttgggggccccggctgggttgggcccgcccctctccccctcccccactatcccctctcccctggtgtgtgggtgtggggaaactctttgttttttgggggtttttttttttggaaaaaaaaaatttttctccccca

SEQ ID NO: 622035 - DNA, 165 bp, Homo sapiens
cggagtgcaatggctggtgagtaataggtgagagtagcagtctatggaggtggctaatggtagtagttataataaatgattataaccgcagggtttactctgtggggtatttttgggcttgtaaaaaaaagggcatatttaaacccttaaaataattttttggga

SEQ ID NO: 622036 - DNA, 99 bp, Homo sapiens
gcggccgcctactactactactgctcgaattcaagcttctaacgatgtacggggacatgcagtgggtgtggatgaataaaaaaaaaaaagttgtactgc

SEQ ID NO: 622037 - DNA, 980 bp, Homo sapiens
cgtgtgtgctgatcgcctgtagtcctagctactcgggaggttgcggcaagataatggtgtgaaccccgaagaagtggcctgtagtgagttgaaatttgcggctgattggtatctagcacctggttgacagactaagacgactttggtctcgaaaataaaactgaaattagtgtggggatatcaatgtgggtgtggcaacgagattgtgtgaaagggttgagtccaaatgtgttggggaatcgcgggactatgtaagttggcctttaagcaatcgcgtcttcaataagaggtcgctgggggaaaactgccaggaagtgtaagtggccgagcaagattcgaatttgtaaacaaagggccgtgagttgcaagaaagatttttttgtgaacaagggatgtcaaaagcggccgtgtttactgggcgggaaacattgggggttgatgaattacagtggccaggaatgtgggacctctatattaaattgtaatgccccaagtgtgttgtgtataaaacaagttaagatgtaaccatttaaatagtctgtaacacaaatcagactcagttaactgtgtcaacatacaattattacatttctgcaaactgttatctgttggtatcagaatacacacacatttagtgggaggtatctctacagggcaatagttagaaaacccaaactggtttattacctcaagttccttcccctgtgattttggaactgcttacctccttactagaatggcgacctttttggactagcttttcatacacgggtcaattgtgtagcaacggctggctcacatatcaacaggggctggttgcctcgggcccgcattggtcatacacagactatcacctacgaacttagttttggcactttaacattttacacgcatttcggctacgagcagcggcgcgactactacaagctgccactgcctaccttggtctaacacggtaggacacttcacattctgcgacg

SEQ ID NO: 622038 - DNA, 112 bp, Homo sapiens
gaaacctaataacgcaacagaagcagcggcgctgatgacgtctttttcacaccgtctgatacaaacacccgatgattaaccgtgcgcatactgcgcggttctgtcgaaagcg

SEQ ID NO: 622039 - DNA, 107 bp, Homo sapiens
atcctatacttcctcaacgctttatacttctcaacgctttataaagcgttgaggaagtataaagcgttgagaaagtattaagcgttgaggaagtataaagcgttgag

SEQ ID NO: 622040 - DNA, 109 bp, Homo sapiens
cctataccatgatccagtcaggtggggctggggctgggtggacaggatcaggattcccttgaaagcccaggcagggtgaattcttctcacactttaaatacttctaact

SEQ ID NO: 622041 - DNA, 955 bp, Homo sapiens
tgtataaggcctgagatggagagtagacatctctcctgagcgtccctgccatctgtggttcataggggtcctatgagaaggggcagggacgatgtggcgctccagctgtggccttccagctctgaagccctattcatcctcctccccagtccagactcacctggaggcagctggacccaatgctccagctccccgttggcgtctcattgccagatgctggtggaggtgggtgaggaggccatcgacgattcaagtgctgagatggttaggtgggaccatgggcagtgggcacaggggccttctggttgcggacgtatggtctgaggtgggcaccggacatgcctcatggattctcaggccgactagagttctagaaaacgttcctactactctggagccccattgtcgagcacccagggcccagacccagggtgtgcgtcccggtgctgcgctgcagggcccacgaggactttcgctagagggaaagtgcacccgcatgatcactcggcagtatggccatctttccagggacacactttcaactgagcttttgatcagacctgacatcggctcgagtggattatgcccgcagtggtttgagcaagctctggagttcacgcaatccgagaaagaactgctggagagccttaaggaggcattacacaccacgcgtactagttctcccagtgccatcttggaagctgagtcacggatgccaagggagaagcttctgtacattagttctcaggaatcggattgctgggcagaaagaaccttactgggaggggcacgggccggcagtcatgggacgattgggacctcaaggcgctgaagagatcgtcaactggaagaggattgtgttatccaggaatggaaagccctgatccagacgcactctcggggcgcttggcagacacagggacgcgtgtgacagcgcacgtctgagaaccccctg

SEQ ID NO: 622042 - DNA, 168 bp, Homo sapiens
gatgtctctgaggatcccttcgattggcgggcacttatgcacgcttactatcttaactaagctttgcagtgccaagcagtattgcaagagttcaaatctgaccaagatgttgatgttggataagtagaattctctgctccccaccgtctaagttgcccgccaatcgaa

SEQ ID NO: 622043 - DNA, 167 bp, Homo sapiens
  misc_feature (161)..(161): n is a, c, g, or t
ccttaaagtcaggacccttccccttagggaggctgggggaaaaaggttaaattttgtatccaggggttttttggggcccttttgggttttttaaaaaatgtttttggaggggtttatgcccaacccatgttttatttcagggccaataaaatttaggaagncttcca

SEQ ID NO: 622044 - DNA, 715 bp, Homo sapiens
gggattaaaatttttaaattaaaaaaaaactattttacaaaaaaaaaaaaaaaggggaaaataaggggaaaaaaatggaaaaaaaaaaaaaaaaaaaacctggtgggccgcttggcccaatcgacttttagcttgggccaggttaaggattgggcccgaaattggggccaattggccaatttcccctaatggggggccttttacaattcaatggcccgaggtttaaaaacgtcggaccgggaaaaccctgggggtacccaatttaaacccctttgaagaaaatccccttttcccaagttgccgaaatgccaaaaggccccgacccaacggcctttccaaaaagtggcccatccaaaagggaaatggaaaatgtaaggctgtaaaaatttggtaaaaattcgggtaaatttttggtaaaatcacccaatttttaaccaaaaggcccaaaatcggaaaaaccctttataatccaaaggaatgccccgaaatgggttcgagtgtggtccaatttggaaccaggatccccctttaaagaacggggacctcaacggaaaaggccaaaaacccgtttatagggcaatggccccaattcgggaaccattccccctaactaagttttttggggtcaaaggcgcccgaaaagccctaaaatggaacacctaaagggggcgccccgttttaaagtttacacgggaaaacccctcaacgtggcggg

SEQ ID NO: 622045 - DNA, 156 bp, Homo sapiens
atgcatgtccagtcaaggagctcactgactgtgaacgcttaggatacataggtacatggaccaacaccagacctaagagcaatataaagctactcaaaacataacaccccacaaataatcaaaaccccattacacacgagaaaacaccctcatgta

SEQ ID NO: 622046 - DNA, 892 bp, Homo sapiens
  misc_feature (565)..(565): n is a, c, g, or t
  misc_feature (882)..(882): n is a, c, g, or t
tatcatagctcactgcagcctcgacttgtgggcccgagggaccctcttgcgtcagccgttctgagtagctgggactatggacatgcccgaataatgtgctttggttaaagagatggggtcttacgtacagttgcatagcctcatctcggagtgctgctactcaagcattcccccagtctcagcctcagcaacgtcctgggattctaggcgtgagtcactgtgcccagcttgttttacagtagtgaaatgaatctgcccatttatactttctgattatcaatgagagtgtgttctataatttggtgcttttcagttgtgatagtttatgcatcacatatcacatttgccatattataccagattgaatgtgtactactcattagcattaaatgcactcgacagtgtgtgtaactaacaccatatttcagaaacttttgtcatcttaaattggaaactctatacctgtgtactctaatccctagtcccttgtctccccaatcatgttgctgcattgagttggcctatgtaggtatttcttacaagtgtgaatcacatagcatgtgtntgtggtggccctggcctattttacctaatgctttcaagtttcatgttatacatgagacttcatgtcttattatgacgagtaatccatttggttgtattcctgggctgtctcctgcggtgtgtgtttcccgtttaccaaatttatcccactggcatgctagaatttaatctttctcgggatgggcttttatgcgcggccccaactctcgggcctagaggaagcttaaagcgcattggggggggcaaaatgggcgcgtcagattgggaagactgttaacactgggcttgaaggccaacgactcacatcgcacacgcggnatcaacaata

SEQ ID NO: 622047 - DNA, 425 bp, Homo sapiens
caaaagggggaatgagacaggttctccttatcacagtataagtcgtgtgcatccatcagagccttcaggggcttcaggatcgtcacctgtgatctcatctctggcaggctcagatcatgagctctcgtcaggtctcctcctataccgtgtgcagtgcagttgcttcaaagttcacaggattggtgtacccgagaggcaggtacttctaatccaggcaccagccaatagcttgcgctgtatacgggcgttatggttgcaaagtaagagcgttcggcagtgttcactagcaagctcatcatgcatggcactcccagtctgttgtggcacctgcatcagtcagctggacaggcaggaccttgtgtctggatcgctgctgtggttcaccaacgtcactctctcagctgtcagtcgacgcccagatcacc

SEQ ID NO: 622048 - DNA, 152 bp, Homo sapiens
aggtgtgtctggtcatacaactctgctctgggttcaagcaattctcatgatcagcctcctgagtagctgggactacaggtgccccccaccatgcccagccaatttttgtatttttagtagaggtgggggtcttgcccatgttggtcatggct

SEQ ID NO: 622049 - DNA, 103 bp, Homo sapiens
catactttgaccaggttggagtgctgtggtaccatcatagctcactgcaggctcaaactcttgagctcaagagatcatcctgccttagggtggactctaaacc

SEQ ID NO: 622050 - DNA, 119 bp, Homo sapiens
cagcagcagacaacagcgacaatcactgaccactgtggtgcttttacgagctacagtcgtaagcgtgattcattttcgtgctaattatggctttaaccttctctaagggcataaaccca

SEQ ID NO: 622051 - DNA, 120 bp, Homo sapiens
tctcgctgtctgtggtcttgagatttttatttttagcatattaatccattctgtacaggtgctactttggagcgctgtgtattccctctgcccccatggctgctggtgtaaataactgca

SEQ ID NO: 622052 - DNA, 458 bp, Homo sapiens
cacgggtgtacagtggaaattacaatcccggtgactacactgctttaaatgtttcataaggtttcaacgagtgcaacagtaacttcctatcccagacagcgtcttactgttattactaaaacagctgtcagctaagcttcgcatacctctttgtacaaccgtttattcaacgctttgggatctgtaaggatgcgtcactccacatcactcctcaaaacgagatctaagaacctgacgtgctccaggggtcttgaagcatcacaagtgggtacttgaaaaacgatgacgggaactgcctgtccaatgcggcaaggttattttacactggcatttaagacagaactgtagagtggctgctctttccccggacactactaaagcagcaatttccccttcttgctttcatccacctctcccaggacccgggtacctccgaagctcccggcccgagcggccgc

SEQ ID NO: 622053 - DNA, 272 bp, Homo sapiens
  misc_feature (3)..(3): n is a, c, g, or t
  misc_feature (22)..(23): n is a, c, g, or t
  misc_feature (58)..(58): n is a, c, g, or t
tanaatcccacccagcagctanncgtcctctctatgcacacgggaagatgtccacaanccccattccccagtgcaaggtcacccagcagccacccattctctctatgcacatgggaagatatccatagcgcccccccattccccagtacaatcccacccagcagtcacccgtcctctctatgcacacaggaagatgtccacgggccccattccccagtgcaatctcacccagcagtcacccattctctctatgcacactggaagatatccat

SEQ ID NO: 622054 - DNA, 272 bp, Homo sapiens
ttgctatggtctgacctggggcctaactgcctgtgaaggacaggccactgtttgtgtcagtgacaagcatgctgctgcatcagattgaggggctggagactaggctgtggccaaggcggtaccaggagctcccactgagaaagagccctctgaatgtacaacctggggcgttccgtatccgatctgttcccggctcccaggaaccccaggagctgggctcctgtcgcttctggttttatccgtgggttaaaagcaaggaaaggaagagagac

SEQ ID NO: 622055 - DNA, 1132 bp, Homo sapiens
  misc_feature (862)..(862): n is a, c, g, or t
  misc_feature (1093)..(1093): n is a, c, g, or t
gaggtgaacagaatgttgtctcaagggcttttgcaccctgtggaagggccccttttggtgaggtcccgcgagcggttaatcctgccaatcacaatctgagggtcacacaacctgggtaacattgcccacggaatagttttagcaccttgtaatagccacattgcaagctaagcagtgtggtccaaccggcaaatcttcacagtcacattgccgcctaacttataatgcttgaacgtgggtgcacatctcgttcgattcgcagccatgtgtaaaggagttcaccaacggtcatttcgtgttagtaaacgttatctttccgtcgagatgaagactggggagtttcttttggcaggccttgttttgtgatggatgattttggtgtggaatctgactggttgtctctgctgtcatctgcataagaagtgccatctgtttttcgctcagagagtggataaccccaaagatgctaactggtgttggatttcttatttccagcgtccttttttgtcgtcttctttctggaccgtctttactctttcttccatatggtttctctaccatattgctgtcactgtcagaattttcactctgaattggttttgtgaacccagatttgggcattttacagctgttcagctagcttcttcttttatcagtcttctcatcctggatccgaggcaaggccggcgcaggaggcttcacccccggaacgagtgcttcggcgtagccgtcgctgtcgttgtcttcgtcgccgctgcagccgcctgtaaagccgccggagccgggcttgaaaacatctccggtctcggtccgtctctcaccacagcctcctcgctcccaggacagcgtcgccccgcgattngctgcgacgcgagcacgtgacacccgcggacacgtgactaccgcgggcacgggacgggcggcgtgaccgccccggcccccggcgcccgaccctcctgctgctcagccaggctccgcgagccgcagggcggggaagcgggacgtaccaagcggcaggcggcggaggggtgcgggccggaactccgccttcgtgctggtcggtctccacgccccactcggactagtgtcaccngctcccccccgcaaacactatccgacaaaggaggcggaa

SEQ ID NO: 622056 - DNA, 725 bp, Homo sapiens
  misc_feature (455)..(455): n is a, c, g, or t
  misc_feature (686)..(686): n is a, c, g, or t
cggcgggcggggccccggcggacccgcgccggggggcactaacggcctgtcactgtcaggcgagctacggctcgggccaggctgggcgggcggcgcgtcgggaccggggggggcgggcagggcgcgtcccctaccttgctctggggagggggaacgggagcagcgcagaactgaggggatctcctccctggcgccggggacaagctcgaaaccgcgcccctccttcctcctttcctgtcgccacgcccccctcacccgtacggacccgaggcaaggccggcgcaggaggcttcacccccggaacgagtgcttcggcgtagccgtcgctgtcgttgtcttcgtcgccgctgcagccgcctgtaaagccgccggagccgggcttgaaaacatctccggtctcggtccgtctctcaccacagcctcctcgctcccaggacagcgtcgccccgcgattngctgcgacgcgagcacgtgacacccgcggacacgtgactaccgcgggcacgggacgggcggcgtgaccgccccggcccccggcgcccgaccctcctgctgctcagccaggctccgcgagccgcagggcggggaagcgggacgtaccaagcggcaggcggcggaggggtgcgggccggaactccgccttcgtgctggtcggtctccacgccccactcggactagtgtcaccngctcccccccgcaaacactatccgacaaaggaggcggaa

SEQ ID NO: 622057 - DNA, 521 bp, Homo sapiens
tttcttgatgggctaatagtaaaaggaagtttacgtggagttttgctgtaggatgcaatcttgtctttactctttcttccatatggtttctctaccatattgctgtcactgtcagaattttcactctgaattggttttgtgaacccagatttgggcattttacagctgttcagctagcttcttcttttatcagtcttctcatcctggatctctttgtacaaccgtttattcaacgctttgggatctgtaaggatgcgtcactccacatcactcctcaaaacgagatctaagaacctgacgtgctccaggggtcttgaagcatcacaagtgggtacttgaaaaacgatgacgggaactgcctgtccaatgcggcaaggttattttacactggcatttaagacagaactgtagagtggctgctctttccccggacactactaaagcagcaatttccccttcttgctttcatccacctctcccaggacccgggtacctccgaagctcccggcccgagcggccgc

SEQ ID NO: 622058 - DNA, 669 bp, Homo sapiens
  misc_feature (399)..(399): n is a, c, g, or t
  misc_feature (630)..(630): n is a, c, g, or t
tttcttgatgggctaatagtaaaaggaagtttacgtggagttttgctgtaggatgcaatcttgtctttactctttcttccatatggtttctctaccatattgctgtcactgtcagaattttcactctgaattggttttgtgaacccagatttgggcattttacagctgttcagctagcttcttcttttatcagtcttctcatcctggatccgaggcaaggccggcgcaggaggcttcacccccggaacgagtgcttcggcgtagccgtcgctgtcgttgtcttcgtcgccgctgcagccgcctgtaaagccgccggagccgggcttgaaaacatctccggtctcggtccgtctctcaccacagcctcctcgctcccaggacagcgtcgccccgcgattngctgcgacgcgagcacgtgacacccgcggacacgtgactaccgcgggcacgggacgggcggcgtgaccgccccggcccccggcgcccgaccctcctgctgctcagccaggctccgcgagccgcagggcggggaagcgggacgtaccaagcggcaggcggcggaggggtgcgggccggaactccgccttcgtgctggtcggtctccacgccccactcggactagtgtcaccngctcccccccgcaaacactatccgacaaaggaggcggaa

SEQ ID NO: 622059 - DNA, 87 bp, Homo sapiens
cctcgataagatgagctgtgttgtactgtaccgtctggcctgcgattatgaagactcttgtagtgcaagggctcatctcgtcttgtt

SEQ ID NO: 622060 - DNA, 231 bp, Homo sapiens
  misc_feature (1)..(1): n is a, c, g, or t
natctctgaaaaaaaaaaaaaaaaaagtggcacactgtaccttttccttttgcaaatttaaaagacgaacccttttactgtgtgtgagaagccactgttataccctccatgatatactgaacgccccagatagccaagatcgggcagaaccccactttccccataactacagagggtgctgttccccctggcgaatatataatttaattcaaacctaccgggggggggatt

SEQ ID NO: 622061 - DNA, 128 bp, Homo sapiens
ttgatatgctgtatacatgatgatttgattgtgtatgtgaaccaccctggcatctcaggtataaatcccacttggcatgaggaattatctttttaatgtattatttaattggattcgctagtatattg

SEQ ID NO: 622062 - DNA, 117 bp, Homo sapiens
aagggcaggtacagaaagctagataggtaggcccgtctacctaacaacgaggcctgcctagactcaaatagctataaccggaccaccataggcgctagactagtagggcagggacca

SEQ ID NO: 622063 - DNA, 427 bp, Homo sapiens
gctcgacccgagattgtgccgctgtgctttagccttggcgatagagcaagactccatctcggctcactgcaacctccgcctcccaggttcaagcaattctcatgcctcagcctcccgagaagctgggactaaaggtgtgcaccaccatgcctggttaatttttgtatttttgcagagccagggtttccccatgttggccaggctggtcttgaactcctgacctcaggtgatctacctcggcctctgtaagtgctgggattacaggcatgagccactgtgcccagccagtgaagtggttttgaaaggtttcaatgcctttgttggatagcttgttgccacatattatacaaagtgggcttggagaatgtgaatcatctgttgcaatgaacctgtaatttaagtagcactcttggtattttcgtcgacg

SEQ ID NO: 622064 - DNA, 142 bp, Homo sapiens
aacctgcaggcacagagctactcctcatattattggcagcaccattaaggatctgtgaatgctaactgctataaatatgtgtctccttgatctggcgccatggggtgtgccagaaatttcggtccagaattattctgtcttt

SEQ ID NO: 622065 - DNA, 387 bp, Homo sapiens
agagcgtagtgctatgagtcttcacagcctggaggaaggagagatagcagtgtgggtcgatcaggcgagagaatgcgtgtgtactcatgagtccctcgtgcgtgtagcctccagtgagcggtatatccgcagcgagtctagtggaggagtcgtactggcgaacaagcctcgtcccagcccgcaggtcacgcgcatgagtagtcaactgcctgtgtaggctgtgagggctcattgccagcagaactctcagagatgtcccaaaagcattggcataggtcctccagtccctccagaagtctgtctgtccatccatgcggtgctggaacaccagccagccgcccccatcagtctccatgtcgcaaaaacacgttcaggggccgctcgcgc

SEQ ID NO: 622066 - DNA, 878 bp, Homo sapiens
  misc_feature (3)..(3): n is a, c, g, or t
  misc_feature (63)..(64): n is a, c, g, or t
  misc_feature (66)..(66): n is a, c, g, or t
  misc_feature (76)..(76): n is a, c, g, or t
  misc_feature (79)..(79): n is a, c, g, or t
  misc_feature (82)..(82): n is a, c, g, or t
  misc_feature (89)..(89): n is a, c, g, or t
  misc_feature (91)..(91): n is a, c, g, or t
  misc_feature (97)..(97): n is a, c, g, or t
  misc_feature (109)..(109): n is a, c, g, or t
  misc_feature (111)..(112): n is a, c, g, or t
  misc_feature (125)..(125): n is a, c, g, or t
  misc_feature (146)..(146): n is a, c, g, or t
  misc_feature (148)..(148): n is a, c, g, or t
  misc_feature (155)..(155): n is a, c, g, or t
  misc_feature (689)..(689): n is a, c, g, or t
  misc_feature (711)..(711): n is a, c, g, or t
  misc_feature (780)..(780): n is a, c, g, or t
  misc_feature (783)..(783): n is a, c, g, or t
  misc_feature (812)..(812): n is a, c, g, or t
  misc_feature (860)..(860): n is a, c, g, or t
tanggttagactttaccaaagtcagaactcgaggttcatgtaagtccttagatcccgctcccnngntctgtctttntcntcnctccttntntttccntccagttcagtntnnttttctgtttttntcttttcctcccagctatagntngggtatnccatagctgggaaatgtgttactcggggctggggtgctgatctgtagcctagtccttcctggtccctcttgaggacagtggggatgggattggcacggcccttaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagtgctcgcagtactggagggagggagtgggagaccggttttccgggctccttgtctctccatggctctccctgaccatgcgggctacctcagggaagccagcttcttcagcgagctgagccgcatccctgccactcagctcacagacccccacccaggcagccccacggcccaggagaaagctcacagctgccccctggcccgctcgagcagcacacatcagtggggtcaccagaaggcatcccgggcgttgatatncccccagctcctcctgcctcangcggttccagcagtctcctaagttctggcaggtcccctcctgggctgccctcagtatccggtgagttanctnatcctcagcctcaagggatctcccttgtncatgtcttcctgatgctcctcctgcactgcttctgctgctggtgcctnattattcttcttttcttt

SEQ ID NO: 622067 - DNA, 570 bp, Homo sapiens
acaccagggcacaaggtaaaggccatacatcaaaaatacaacatatgtcaagaagatatacaacaagactcaatgagatacactactcaaacactaagagaaatacaacatacataatgacattacaactcatatcaatgaagaatttaacaaaaaatacaatcccacctaacattgcatcatggagaggaacttcaatagttatataacacattaaaccaaacacttcatctacttctacctgagccaaataaccattcttctattcaaatctaattaaaaccatggactagaccacacacccaataatccatccaaaaacaaggactagcacctaaattccaaataccatatactgaaattttcacccttactaaaggaacatctcaatatttaaacctttattagattttatacaaggcattctctatactactttatcataattataaaacaattagcacaatagcctacatttatatttattttctattccatacttctacccacattattttctctcaaaatccattcctttaaaaaataaatctaatacagatatcaaattcc

SEQ ID NO: 622068 - DNA, 276 bp, Homo sapiens
gtcggtccttcctctccgcccactcatatgaatataatgtaaacgaatactggttggccgggcggggtagctcacacctgtaatgcagtgcttgggaggccgaggcaggcggatcacccgaggtcaggatattgagactggccaacacagtgaaaccccgtctctaccaaaaacacaaaaatttagccaggcatagtggcacacgcctgcagtcccagccacctgggaggctgaggcagaagaatcacccgaacctgggaggtgggaggagaggaa

SEQ ID NO: 622069 - DNA, 613 bp, Homo sapiens
  misc_feature (1)..(1): n is a, c, g, or t
ncacgtaaaaaaagttttaaggtttttgaaaacctccccgtgaaaccagaattggtatcccacaaaaaaatgggcaagtacgccccatgtgccacccctcgattggttctataacattcgttatcccccccaccacaattcctgactccacggtcgatttatgcggtagttattcagaccaccccaatattgattatctctgatactcccccatcatgccttctatagagatacaacaacctccatgttcttctaacacatggcagagccgacactgtcccgttggagcgaaccgcttttgtattcaagaatatggggctatggcaacacaagtgcgatcttgttgaccgcacttttggggtaaataaggaacgataggccctcggggttatttacaatctttaatgatcatggcttctctctgtatctaattagatgagcaacaatcttgagtctaacaagcggtcctgtgaggccagccaggtcaccgaccttcatggcggcacccctgttgtcccgagcaataaagccgcgggactcacggcccctgagtttacacacaccttgccatattgaaactcctccccagattaacaccccaacaaacatgaca

SEQ ID NO: 622070 - DNA, 803 bp, Homo sapiens
gagcgcacgccattcatgtcgcccgcgcagaaatgcttcaggttatccacagtctttcgaccagatgagacaggagtgcgcgatactggatcctcatctcagtcgggctgatggccaagatgtaaaattaggagcagattcccgagccttaatgttctctgggtagttcgtacctacttaaccgatgctgtggacgtcacgactggggcccctccggtaagaacatatgatgattgagcagaggaacgtgcgatgctcccaaagtaacaaatgactggggtgacagtaggaatctacccgactcttttgctattaaccttgcacataggatctaaacgagtactataatgtatgccagtcactacaccatgaagaaacctggtggctgtgctactatccactgtctacttgatacctggctctcgtcctaataaccgaaggaggcgactcgagaccattacagtgctaggtgcattaatcgcccaggaccatcacgagaggcgctgatgtatgctgttgatacatgtaatggccgacctaacacacaggctaaactgtgacaacccctggaaactgcacaggagccgacaatctgcggcgacacataccgccccactccccgcgcacgcaacgtggaccacgcgcctcgccctcgagcacacccgcgcaagtcccgactggggccagacgcaggcaagccccgcgagaccgcacgtaacggccgcagccagcccaccccccaccccccagccccactacacgagctgacccgccgcaccctaaggcaggagcgccccggcggg

SEQ ID NO: 622071 - DNA, 309 bp, Homo sapiens
gaagaagtgagccagggctatattttcacttctccctggatttattataacggagggagtcagataactaagtcatataattgcttcaccgatttaacttggatgtcaattataacatggtgcttagaacacttactgtgatagctttctttgtggatagtctctttgggtgttggtttctggagcagttcagttagactccatctgcttcctttgccttggctgcatttgatgtgttgatgtctcgcagtgttgctgcattggaattttgctctttctactagaggcatagaggccatgtgttatact

SEQ ID NO: 622072 - DNA, 1206 bp, Homo sapiens
  misc_feature (362)..(362): n is a, c, g, or t
  misc_feature (671)..(671): n is a, c, g, or t
gcagtagacaacgatcccagaacatttagacacggatctcttacctttggcaaaataggcggttaggcatgaatgcgtggttcgatcgagtataagacagatgtgttcttcgcttattgaatatagccagttaaagctgtgcatactttggactacacgatgtagtattgatgcgactcccgtgattctaaagccctggcttcatttctactattcaggtagctcccattgagtctgcgacgcgcactataccgtgtgtgaatgttaatcaatggtctcgagcggcgatgttcgcagatgctgtgaggacatatagacatccaacgtctttagtcagtctccatctaaggtacttcttgccnactgctagtcaaggaacacgaagggtagtacttactcgtaggcggaagtggcggcagacgctactgaatgtaacaggtaatttattactaaactatctctcattatcatggatttcttgcatccccagtgctgtctgtcgccgtatcaggcgtcacgatgcaacgagtggaaattgcattactattgaatagggctcaagtcatggcttccgcttccttttgagtctatcaatctcaacgtgccaagcatgctgtcagagttgagacacagaggttattaggaagcggggatcgcaaccgtttgtacgngtgacatagtcaaatgcggggtgacatttgtgtgagtctccgaatctgtagtttctctgcaagcgtattctatagggggaaattctatatacgatagcgggaggtagggcgaaggtcgcgtgtgaaagcagacggggactagttggcagaacgtccgaagccaatccaaattgggaacagattttgttccaaagtttccctcaattctattctgtcgcgcctttgacaatcgtgcgacacaccagggggcttataccttagtttccttccattttagtggagcgggggacaaaacaattgtttgtctagatttggttcaccaggttttctttggatccaatggtcttgcgccaaagggcttttcctttcggctgacttcaatcttggaaaacgctttccaaagtgggccccaattccaaggtgggccccaaaggcgcaaaacaacttacacgaacttaaacttttggacctttaacccccttttaaaccatgacacaccttataacacaagacggaagacaacactggtctcaca

SEQ ID NO: 622073 - DNA, 88 bp, Homo sapiens
  misc_feature (18)..(18): n is a, c, g, or t
agagtttaaacctttaantgtaccccctctgtacacactatctgaaggaagatattcttttttcaatcagtattttggatggccacca

SEQ ID NO: 622074 - DNA, 231 bp, Homo sapiens
gttacaactatggacaacagtagtagactggagtacaccccgaccttaaacgtatagatcattgacgctacgtggatagaattattttccatgaaaactacaatgcaggcacttaccaaaatgacatcgctatgattgacatgaaaaaagacggaaacaaaaaattttgtgagctgactcgttccatccctgactgtgtcccctgatctccttacctattacacctggcta

SEQ ID NO: 622075 - DNA, 1288 bp, Homo sapiens
tcctcgcgggtttgttgctcctctggtggtttttgtctaaggagtgttcttgtgtttgttcgcggtctccactggggggtgcttgcgttccgcaggtttttttgtcacgtgggggtatgttgtcgcctggtccaggtggttggcggttgggctatgtggggtcgtcggggggtgtgtgtccggggggccacgtgtgcgctggagttggtgttagtgtgtgtttggtttctccggtgaggggtctgcgtctcgctctcgtcaggtgtagggtgggtgatagggtgtgagtccggcccgcggtaggtgtcctgtggagtaaggtgccatggggtgcgccgtctatgaatggattattgatgtagtgtttttcgacagtgtcgtttgttatattattttttggtgtaggccgacgggggttttcgtcgcgtgcgctgtgtgccatatgtagcggtggggtatgggtgatatgaggaagttgtgtgcagcgatgggggggccgccataacggggagtaatgtgcttgtttgctcgggagcctgcttgatgggggggaattgtgctgcgccgctgtggggcgacggttttgtgtcactgggcacccttggagcatgttgggggatgattcatgtgtggagtgagtcgctgcacggcgtatgagatatcgtgtgggagggctcactgtcgcgtgtcccacggatgcagttagtactttgtcgcggcgcgcacggtggagcacacgtgggagttcggagatagtgttcctgtttgggagcacaggcctgtctgtggggcctgtgttttgtgtctggtgggagcactgtgtcggtccacgggatatttcccacttgtgaatattttatccggcagctttagattgtggagtgaagagagagagagagggagaggcacacctcggtggtctcgtggggagattgggccacttgttaagagtaggccgctctcaccgagataatagagaggtctttaagtcaccacgctgtctgaggttgagcatgtgtcttgatagatagatggggcacgtagaatatgatttgccactagataatgtatagataaattagggtgccttgccacacttgtttggagagtagccaatctagctgtgtttggacacgacttagagaattatgctaaagagtttcactctttttacctcactatttcttaggaatttaagtggttataatgttgtctttttttcctatgtcttttggctcaagccacatgtatatcagtgttgactttttcttttttagattctagttta

SEQ ID NO: 622076 - DNA, 151 bp, Homo sapiens
ggtcaggtgggtgcgcagcgtatctcttcgtctctaacacgctataagcggaggtgtcccaggctgcccaaactccaggcctgccccctcccactcttgaagaggaggcctggctacctcggggcctccaggagttctaatcaggcgcgtt

SEQ ID NO: 622077 - DNA, 196 bp, Homo sapiens
tatcgtcttaatgccaggattctctgtattctttcagacttcatagcttctttcctgatgacctgtcgccctgatcttggcatgtgccatgttgcattcatccttagactgcagcgttctgcgcatgggagttctcttcaagagaattactgctgtttcactacctggttgctatatttattaatgctctttcttc

SEQ ID NO: 622078 - DNA, 450 bp, Homo sapiens
  misc_feature (356)..(356): n is a, c, g, or t
gagctcttttaagcatgtctggtgataaattccctcagcattcacttgtctgaaaaggatcgtatttctctttcacatattaagcttaatttggccagatacgaagtgctgggttggaatttcttttctttaagaatgtcaaatggctaggcgtggtggctcatgcctataatcccagcactttgggaggccaaaggtggggtggatcacctgagatcaggagttcaagaccagctggccaacatggtgaaagcccatctctactaagaatacaaaaaattagccaggcatagtggcatgtacctgtaatctcagctactcaggagactgaagcagtataattactggaacctggnaggcataggttggagttagccaagatcacgccactgtgcttcagcttgggtgacagaacaaggctctgttcaataataataataataccaaaaa

SEQ ID NO: 622079 - DNA, 270 bp, Homo sapiens
attgttggcccaggctggtctttgaactcctgacctcaagtgatccacctgccttgggcctcccaaggtgctgggattacaggcatgagccaccatgcccggccctgactgcgcttcttttctttacctaacttctccccttttcctaactgattttgagattgctgctgtctatttctgacttttgtattcagagaatacaaattaattcatttagaagcattgtctctttgctctgtttactcactgtttgtttaattcctccatctc

SEQ ID NO: 622080 - DNA, 204 bp, Homo sapiens
tacctgcctcggcctccaaagtgctggaattacaggtgggagccacacacctggctgtatctgattttttaactttttgtttgagaccagcctgactaacatggtgaaaccctgtctctactaaaaatacaaaatattgccagggcgtggctggcaagcacctagtaaccccagtctactcgggagagtgggagccagaggaca

SEQ ID NO: 622081 - DNA, 275 bp, Homo sapiens
ttgtgcctatctgtgagcttaacattggtagcaggtgtggattgggacataaaaaagtaaataaaacatagttaagttgacataacccataagtataatgtgatgtggaaatctgagataggtacaaataacctgtaccagaatctggaggcaggttaattctgacaaggtgagtccagagaggctcacaaagtgtcaatatttgggatgagttttactgggtcttggtcttctatttcagttgctggttttgatttttctcaacgcaacacaca

SEQ ID NO: 622082 - DNA, 427 bp, Homo sapiens
gccgggcgcggtggctcacgcctgtaatcccaaagtgctggtattacagatgtgagccaccgacccagcctgagttctctgtctctcttattaactttatgttttgaaaaacccggtgagactatgtggggagcattttcgttgactaattttactgatctacaagctgagctgatatttttaaaagaatttgaatttggcttcctcaccagtaatatgtctccttgcttctttgatgtgatagttatcgagatggctgggactctaatagatctgtgcccgaattcgctgtgtctgttatgaagtccaccctgtgggcacaataacataactgtcggtaggcagtcgttcagagctattctggagattattaggtcaagtactactacaacgccttcaaaaccatgctatgtgcgctgctatgaac

SEQ ID NO: 622083 - DNA, 400 bp, Homo sapiens
  misc_feature (368)..(368): n is a, c, g, or t
agatacaattgcacataaactgttaatataattcatcaaacaagagaatgagcatttggaagttaagagcctttactgcagaaatgtaggatggtatttcaaactactattgaaatattatgtatttgaggagtcctcctttcctcattttcttatctagaattatatttctgagacaaacaagataactgaatattgggttcaaatgtatctcatttatagttttttttacacagtaattacagtagttggatatttgcttactaaaatgaagtgtgcatgaagaaagtgtgaaacagtttttttattatagaagcattttctgaattatttcattattttcgacttgttacccaaaaagatacatngattggagatagtgcccattccatttattcgg

SEQ ID NO: 622084 - DNA, 137 bp, Homo sapiens
tactcctccagcatctgctcttcttccttcctcttatcttttaatgataactattataatagatgtaaggccatagctcactttagtttttgacttgcttttcccctaattactaactgttgagcacactttttata

SEQ ID NO: 622085 - DNA, 742 bp, Homo sapiens
gcagtggtgagtagcaattcttgctaggacctgcatttttcttcctcttaatgtgctgttttcccaccctttgctattcttgctacattttcatgcttctcactcctgctccaaaatgccacttcccacctaccagtactgttcttaaacatctcctgtgtctcaggaagtcactatttaagaacagacttatttaccctttgagccttagtcccttcatctgtaatatgggaataatgacaataaaaactctatatggggccaggtgcagtggctcaagcatgtaatcccagcactttgggaggctgaggcaggtggatcactttaggtcaggagttcgagaccagcctgatcaacatggtgaaaccccatctctactaaaaatacaaaattagctgggcatggtggcacatgcctgtaatcccagctacttgggaggctgaggcaggagaatcgcttgaacctgggaggcagaggttgcagtgagccaagatcgtgccattgcactctagcctgggcaacacgagtgaaacttcatcccaaaaaaaaaaattcatatccaagatgccggccgaattccagctcacttgggcaatttgccctatagtggaggtcgattacaattacttggccgcggtttacaacgtcgtgacttggccctggccgtacccatcttaatcgccctgagcacaatccccttttgccaggtggcgttgcctaggcctgacccgacggctcttcc

SEQ ID NO: 622086 - DNA, 269 bp, Homo sapiens
ccacatttggctgttgagtacttgaaatgtggctagagcaactgagaaactgaatttttaattttctgctaatgtcaaacataattatctttttatgtttcatacctaagtatgatatttcttgaggtttctgtttgatacatatgcatacatacttctgtccaatcttgctctcagttaagtgagtgacattgaaaagagttagaaagaaagcttgccttctttctacctagcatttaattaacctctagaagttttttaaggacttt

SEQ ID NO: 622087 - DNA, 200 bp, Homo sapiens
cccggggggggggggggggtttttttaaaacaggccccccgggaacccccccggtttttttcccttttttttttgggcccccccccccccccggttttttggggggggggggcgggggggggggggccccccggggcccccttcccctcttttgggtttaaccctttttttggcgggaagaaaaagaaatagtaacctta

SEQ ID NO: 622088 - DNA, 294 bp, Homo sapiens
ggcagggggggcgggggcaacagcctccccccccccgatccccccagttccccccccgtccctggggggggggggagggggcggcggcaaccacggcaaacgggggggggtgggctaaacaggtccccccccgggtttttttgcctggggtttgtaaggaaggagacccctgtcgctactcgcctgccccctttgcccggccggaaagggtagggggcaaggtttttcaacgagggggctgttttttgcacccgcccctttgtaaaaagcccttttccccaataaaaccattta

SEQ ID NO: 622089 - DNA, 626 bp, Homo sapiens
  misc_feature (1)..(1): n is a, c, g, or t
ngggaaaaaaccttggggaaatttattttttttttggggccgggcaaattttttttttagggggccccaaaaggtccctattaggggaaaaaattggccaaccgggccttctcaaaaataaaccattttttggtcccccaaaaaaccctttaaaaaatgggccaacccttaacctgggccaaaattttcccataccatttttcggaaagggcctttttcccaaaaattccttttttaaaaaccccccccaaacccctgttgaaggggaaaggttccatggaaaaaaaggggcctttcccggctgaaacccaaaaaaagggccgggggggccaaaaaatggaaataacccctttccaaagggggttttggaaaggcccccttttttgtccgggggaaggcaatttaatcccttttgaacccctatttttcccaaaccggcccatttaaaaacccctccaccttaaattgttccagggttgtaaacccctaatttcaaaaccttgctggcctggaaaaatacccccctctctgtggaaaccggaccttttaaacggtaaagggggaccctttttattacccaccggtcccctcctaagttttaaatattcccaaaggaaaccaaattt

SEQ ID NO: 622090 - DNA, 175 bp, Homo sapiens
ctaggggatccttattaaatatctttttctttttttcttttttgcgactggaatcttgctgtatcggcccaggctggtctcaacaatcctgagctcatgctatccttcagcctcagctgtcctaagaactgggattattgacgtgagtcactacacctggccattgtgcatttgt

SEQ ID NO: 622091 - DNA, 1184 bp, Homo sapiens
tcggcacgaggtgtagagcgagtggtttaagtgcctgattaccaccacgcgtgctcgacctttgttcatgcgtgggacgatcggagagtgggctggggtgcctacctagcgcgtcgcagtgccagcgagtgtcacgaatctagcctgtggaatcaatcccaagttcgtggcgcgtatgatacctaaagtggagtggtctggcgttcctggaggcggcgataacttgcgtctgatccaggtgcctgaaagggccggttgagggatatgaggagaatgaggagtttctgaggaccatgcaccacctgctgcttggagtgtgagaagcgagccatcacttgcttccctgggacacctgcctcccgaactgaggctagcagtgctcagcatctgtaacctcgcctgcccgcatggtggaagtgatagcagggcaccctgcagtgcccggaatcttggacgtatgttccccatcagccgcagggatacccaaacaatgcttgctgagtgaagaggaaactgagcagttgattgtgccagtgcgccagtatatacttgtcatgactgtgtatagatcagtcgatctataccccatgtaatccgaaatactagacgagtgtatccccaacccttgagccaatgacaccaaaacacaggcgtacaagagctcgggattcatatattttacatcttcaattaacgggtttaaacaccaagcacaacacacaagaaaaaaatgagaaagaaaagaagagacgacaggcgaacaacgcgtcacgaaactgacgacatggaagagtgcatatacactcacacgaattcataataaaccaaatgcgaaaaagtgtaagcaacaccacaaaaaaagatgaagcaatataaccatgcatagcagagaacaacagtgattatcatacgtgcaacagacgaacaaacaaagatacaaaacacgaagaccaaccacaacgacaatagctataagagcgaagtacacgagacatgcagccacaccagacaatagtctgcagaaagtcaagcacttcgacacacagactgagagcgacggcaaagacaccgtgactgccggacacgcgcacgaaaggtgaggcagagacatacacacacttagctgcaacgcatatagtaacacagaagagtgagcagcgacagagagagagacgcggagaaaa

SEQ ID NO: 622092 - DNA, 295 bp, Homo sapiens
ctcggtagctgtactaacaagaattccagaagtcacccatcctgaaatggcactgtcccatgatactctccacttccaatcttcaattttttacttcataccttgttctcagatctctcctggtaccccttccccacgcccttagattatccatctcaattcctcatgcttattgaggagctatggctgcaagccaggacaggagagtaggtgcctccacttgatcaaggccatctctgagaatccagcagacatcatacttgagggtaaaaaaccccatgctttccccttcaga

SEQ ID NO: 622093 - DNA, 609 bp, Homo sapiens
  misc_feature (14)..(14): n is a, c, g, or t
  misc_feature (70)..(70): n is a, c, g, or t
  misc_feature (89)..(89): n is a, c, g, or t
  misc_feature (99)..(99): n is a, c, g, or t
  misc_feature (127)..(127): n is a, c, g, or t
  misc_feature (132)..(132): n is a, c, g, or t
  misc_feature (138)..(138): n is a, c, g, or t
  misc_feature (174)..(175): n is a, c, g, or t
  misc_feature (192)..(192): n is a, c, g, or t
  misc_feature (204)..(204): n is a, c, g, or t
  misc_feature (228)..(228): n is a, c, g, or t
  misc_feature (251)..(252): n is a, c, g, or t
  misc_feature (304)..(304): n is a, c, g, or t
  misc_feature (416)..(416): n is a, c, g, or t
  misc_feature (590)..(590): n is a, c, g, or t
ttaacctaaaaaanaaagaaaaaatccccatcacctgtatcagtagggcctgaaaggagggaagtagtgnggggaacccctgctttggnatggagaatnacggccccttgacccaggccggggccgngggtngccatngctggggcttctctcaggataaactcgggtgtgggnngtttcaccctcatgggngcgggatttggngtcatccagtttacgcggggcatnttccatgtcttcttttctgggannctcgcccatccccactccatccttctgcacatcagcataacagccttccccngcttctcgcctgtgacccttcaggtcctgccagctgcctgacggaggaagtcctgaaacaagaactcggaaatcagatcttcttgtagggggcccattcctcccaccacggngccacccaccccgacctccataagtcctggggaactccacacgaagccgacactggccataatcataaccatttcttccataaatagcatcctctgcatctcgggggtcctcgaagcgcacgaaggcgaagggcacgaggccgtgcgggttcttgagctcgatctcgcggatgnggccgtacttgtagaacag

SEQ ID NO: 622094 - DNA, 285 bp, Homo sapiens
ttccctggaggggggctggggaaaaattgctcccggggaaaaaaaccaggcccaagactttccccttttggtttagagccaaaggaaacccaatggggggcttttttcccctcttgggacagggaaaaggctttttttttttaaaataattataaaccaggtttttatggacccgctattcccctattttagggggggcctaaaaaaagggggtttcagggactagattataaaaattttctattgggaaaagttgaataaaacagcggtttttttttgcttcca

SEQ ID NO: 622095 - DNA, 108 bp, Homo sapiens
cctctcttatccaacatcaactcttggcagatttgaactcttcaatctcttgcacctcaaagcttgtaacagatagttaagcgtgcataagttgcccgccaatctgaa

SEQ ID NO: 622096 - DNA, 171 bp, Homo sapiens
agggcggtgtgccgccatacgctttcgctgaggtcatagatcgattgtggggcgactcactcactgcatgatgatgcacgggcgcaacagcgtgacgaagctcatgactgtgcgcatcgttaagcaatcgttcaagatcatacacctgctcacaggcgagaaccctctgcc

SEQ ID NO: 622097 - DNA, 479 bp, Homo sapiens
gagctcggcccatgtttcccttaaccacttaataacgctaataataaacctttatattataccagattacagttgccataaacattcaattataaataacactacactctatcctttacgctacaagatattcctactatatactgttctttatgttactcagtccaaatatttgctgatctatctgattattcagtggctgatatttttcatctatttgccactcattacgttaatcttcttattaatatttctgacgttctgctgactgtttaccactctagaatacacagttcccatttcgcaaaaaaaagaagtactgtaccatttcagcctatcaagggcttgtgtacttgcgtggtcttgcagtaatgaattccaccatttactctttcttgcaatcatggcgaataaaagtggggtatgacggtcttataaaagagcagaaaaaattagtacttcagaaaattacctagggg

SEQ ID NO: 622098 - DNA, 1043 bp, Homo sapiens
gtctggtcgtgtggggtcgctgttgcgtggggctcgtcgcctggtcggccctgagtgtggccggtgttcccgctgtgccggtggcttggtgtttgcgtgtcgcgcgtcggcgttttctgtggtgttttgccctctggggtctgggtgccggcgtggtagccgcggggtcgccggggtgtgtcgggcgccttgcgtccgatgcgtcctctgggctgcgcggttttcctggggtgtcctgttctttgcgtatggccttggtgtcgcgacgggtggttttccccttgtgggtgttccttgctttgcgctgtacgtggtccgtgttgttttccttggtgcgtttggcgtgcatggcctgctagtggtcgtcagtcgtggtgccgagggaggggaagctgcgcacactgggcagcgtctgccaccgcgccgtcaggggccgcggagtgcctagttagccagggttggcgcgcgcgaggggctgggagcgtggcggctgccacaggtcagtcagcagagtgaggcaggcggcagtcgtgatagacactttcgggtggtacccctcgtcctctatggtttggctcgagtggtttgcgggccagcatctccgtggagttggcgagtgctcatagctcaggcgcgtgacagacgattaactatggttctgggatgatgagaagtgacttggcggctgaggcagtagctgcgtgccgcaaggcgctgcctgggcttgctgtgggctcctgggggagtgtggccctcgtggcccacgctccatgccagtggctcacgctctgctcctggctacgcccagagggagttgtcacgtctacagtgagtggctggcctgtttaaatcgatcgtctctctcatccaggatttggtgtttagctgtttctctcttttatctcacgtagcctttttcaggttagtacgtgttcttctgtcagggccgaaactcgaaagtctcctgggagaatacgtagttgagtgagtccaatcgtgagtttgtccccccagtatataaatctcaggtaataaggctttag

SEQ ID NO: 622099 - DNA, 364 bp, Homo sapiens
  misc_feature (116)..(116): n is a, c, g, or t
  misc_feature (135)..(135): n is a, c, g, or t
  misc_feature (175)..(175): n is a, c, g, or t
  misc_feature (269)..(269): n is a, c, g, or t
  misc_feature (312)..(312): n is a, c, g, or t
  misc_feature (329)..(329): n is a, c, g, or t
  misc_feature (359)..(359): n is a, c, g, or t
tcctgtattataatgtaatccctaaatagtgatatgattcccatcttaatcacatccaccgaaaatgacttatttccccaagataccgctctaaaaccgaaattgttaggtgaaancgtttttgagaatttttancatatattactcactgcagagatcatgttcatttacatcncccattagcaatatatccaatgctcagaattgaaaattactacttaaaatctttgcaaattgaataattacagacaagggctacatttaaaatntgtatttgtttttcttacttagtgaaggttgtgtttttttttncatattcattgggccangctatattcattcctttggaggaattggcncattc

SEQ ID NO: 622100 - DNA, 176 bp, Homo sapiens
aggggggggatggggaaaaaaaaaaagagggagggagagggaaaggagccgaagccgccgccatcctgtttaatgggggcccaaactcccctggaagggggcactggacaagggggcccttttccttttcctccttattccggtttttggtttaattcccccatttttcctttgga

SEQ ID NO: 622101 - DNA, 265 bp, Homo sapiens
  misc_feature (98)..(98): n is a, c, g, or t
  misc_feature (112)..(112): n is a, c, g, or t
  misc_feature (118)..(118): n is a, c, g, or t
  misc_feature (206)..(206): n is a, c, g, or t
  misc_feature (219)..(220): n is a, c, g, or t
ggatttatttgcctttgcggggccttgatttcctaagatagaatccaactctttgccctctaacacatagccatctgctcggccacactgtcccgggncttgaagcgatgcncgcaanaacttgccctgctggaactgctcctccaagagactgctgattttggcattctttttcctttcatcatatttcttctgaatttttttanatcgttttttgtnnaaaatctcttcttcccaggagtcagcttggctcccttcttgcggc

SEQ ID NO: 622102 - DNA, 1033 bp, Homo sapiens
ggtgctagttatgtctaatgccatccagctgccatcctcgttgctctgcagcaggaacactacgactctcgatcgtccgcatgactgaacacgatagatcccttactgtggcgaccctacaagggtgcactaatggctggtgtaacccagatacgctactacctccgctagttcccggagcattatcctctccgcctctcgagataagaccatacatcatgtggaaactgaccagggatgagaccaagtatggaattccacgaagcagtgctctgctgagggtacactcccatctttgttattggatgtgtgttatctcctcagatggtcagttaggcctctcaggctcctgggatggaaccctgcgcctctggtgatctgcatcaacggtgtcaccaccaacgatgtcgatttggtgagcgtccactaccaacggatgttgctgattgtgcgtacttgctcctctgacaagccggtcatgatttgtctctggatctacgagataaaaaccagtcaaagctgatgagtaaatacccttgtggtgtgtgcacaagtacatctggttcctggagtgagatgccactcagagtggggttgctcttggtgatcgcgttattctggcccgaatgagcattgaaaccctaatatcgtcgtccttgtgggtgggacaaagctgtcgaagtatagaaccctggcttaactgaaggctggggaacaaccagattggtcaacacaaggcgaacctgaacacgggtgaagtgtctcttccggaatgtgatcctctggcttctggaggcaagatggcaggccggttatgggatctcaagaaaggaaagaccttaaagctaaaggtcggggactcaatacagccggtgttaaggctaaccgtacagggggtgttgcccaggccacgtataatgggggtaaaggacaacttttaacgaacaaatttgcgcgggggaaccccgccccgtgtggtgtacatttgacgcaccgtggacgtcaaagttaaaagagtcgcacgccgtattag

SEQ ID NO: 622103 - DNA, 586 bp, Homo sapiens
  misc_feature (78)..(78): n is a, c, g, or t
  misc_feature (95)..(95): n is a, c, g, or t
  misc_feature (210)..(210): n is a, c, g, or t
  misc_feature (213)..(213): n is a, c, g, or t
  misc_feature (470)..(470): n is a, c, g, or t
ctcggtcctgcaactctgcctccgggttcagtgattctctgctcagctcacgagtagctgggattacaggtgcctgcnacatgcccgactaattnttgtatttttagtagagacggggttcaccgagttggccagactgttcttgaactcctgacctcaagtgatctgcccacctcggactcccaaagtgttggaattacaggcttgagncantgcgtccagcctccacctgtctgcttttctaagttgggaagttgttgatgggtttgcgtaggtgaaggttagtccccatctctctgagactatgggttgtctatgaggtggacagaagtgcttttctaatatttaaagtacttaacagtaatgattaggctgggcatggtggttcaggcctataattgcagcactttgggaggccaaggcaggaggatcacttgaggctgggagatggagaccagcgtgggcaatanagtgagacctcatctctacaaaaaaaaggaagggaaaatagctgggtggcctgtagtcccagccactcaggaagctgaggtgggaaggatcgccagtaccgaatgggtaccgagct

SEQ ID NO: 622104 - DNA, 391 bp, Homo sapiens
cactcggcgccaaaagtgctgagattacaggcatgaggcaccaggcccacctagtctggtgctctggaatgtagttacggccttgatcaggatgatgctcactatttaatttgcagtgtaattctcttttcagtatatacggccggggtccaatacctagtaatttagattcaggaaatctgggataagagtctacttcattttttcattaagtatgatctgagcatttactatgtgctggataggggtatggtatacgaaataaaataaagtcctcatatatcctaaaggatgaggtcaacattagtcactcacacaattaaactgtacagtcataacgggtaagctctgaatgaacaaggtgaatgtcactcgagaccccgcctccaca

SEQ ID NO: 622105 - DNA, 278 bp, Homo sapiens
gcacgagaatgctccctgaagagcaaggatcgagtccgcccgtacgagaagtccaacaagacattccgaatggcagttgacttccagagaaactgggttgatatcagaggagtctatcggttttatgtgaaagagctcgtagatgggaaacttccaaagacttatggaaaaatgggagttcgtgaattcggagataagaaggttcaagttgaacttgatgagaatgagaagactatcaacattttctggccaacaactgaaaaagaagatcggacttt

SEQ ID NO: 622106 - DNA, 281 bp, Homo sapiens
aggaaagatgcccagacttttttaaatagaaaatattctcataggccaggtgcagtggctcacgcctgtaatcccagcactttgggaggccaaggcaggaggatcacgaggtcaggagtttgagaccagctgaatccccgtctctactaaaaatacaaaaactagccaggtgtagtggcaagctcctgtaatcccagctacttgggaggctgaggcaggagaatcacttgaacccgggaggcggaggttgcagtgagccgagatcgcaccattgcactcca

SEQ ID NO: 622107 - DNA, 336 bp, Homo sapiens
gcccagggtttccctttctggggcaaggaaaagcaaaaaagctggtttttgtttttcatcttttttaaccccccaaattttttttaagccctagggttcgatggtttttcccaacccccctatatgggttaggggggtttttcaaaaccctccaatcccccctttgccctactggccatgggacatttatttttaggggtcctgcccatcaaagatttctatattaaattttaaaatgggattaaaagaaaagttggggaattcccccttattggggaactgaggtcaaacaacctgggatttttgaattcccaaaaaataaatttccctctttga

SEQ ID NO: 622108 - DNA, 269 bp, Homo sapiens
gccctggcccgaaaaaatggcccttgaaaatttccctctataactagaaagtatgctaatcccaggtctgggtattaggcccaatttttgttccggtattttttaaaccaaaggtgccccccttttagtaaaatttttcgaaagttttttaactattaaagtttttttttaagggggggctcttaaacctcccctgctctctttttccgtttccctaaaaagctgtttttttagctatttcccccaaaaaagttttttggtttgcttta

SEQ ID NO: 622109 - DNA, 444 bp, Homo sapiens
ctacttttccttttagaaaaggttgttacaggagatttactggcgactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtatgttttgccatttggtgtattccctcctccccccctaaaaaggagtgaattatttgaagtgggaggagactttttgtgcagaaatatatctcagaatgagggtttttgtggacgaagaggtgaaggagttcagtctggggtgttgacggagtgaccgaggtgagggtagctttgaaaagcagtcagagttgctatatagatatatgtggctcctttaaaatgctttgtgtatgtgtggtgtttaaaggagt

SEQ ID NO: 622110 - DNA, 3813 bp, Homo sapiens
  misc_feature (1041)..(1041): n is a, c, g, or t
gataaggacaattaccatccttgcttatatctaagtccagaaacataagacaataagggaacacacacacacatgcatttggattttgatgacttaggtttcccaatgtggaaaaaatagtagcaaataagttctcctgtgaaaaagtcgttaccttatttaaaattctgtgcccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagacggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgangaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaagacttctatgtaagcaaattcactattgatcttcctggaacttgctatgtgaaactacagatcttgtggaacactgcttaggtagcggtgttaagacttacacagtacctcgtttctacacagagaaagaaactgggcagtacttcagtgaacttgcagtgccttactgaacgggccatattttcagggccctccttgaacacttttccggaacggttacgaacttgggggc

SEQ ID NO: 622111 - DNA, 3472 bp, Homo sapiens
  misc_feature (700)..(700): n is a, c, g, or t
caaaacaggctcaggacttagcaagaagttatggaattccttttattgaaacatcagcaaagacaagacagggtgttgatgatgccttctatacattagttcgagaaattcgaaaacataaagaaaagatgagcaaagacggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgangaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaagacttctatgtaagcaaattcactattgatcttcctggaacttgctatgtgaaactacagatcttgtggaacactgcttaggtagcggtgttaagacttacacagtacctcgtttctacacagagaaagaaactgggcagtacttcagtgaacttgcagtgccttactgaacgggccatattttcagggccctccttgaacacttttccggaacggttacgaacttgggggc

SEQ ID NO: 622112 - DNA, 881 bp, Homo sapiens
ccgctgccgaagccggcgaacgggacccctaaagttctgcttctgtctggggcagcccgcctccgccgcgtgaccccggccggcagtgccctgccgtcatggtgccagcccagagaggggccatgccccggaggcagcgagctggggggctgccccagtggcgcgcaagcgacgaggccctcacgcacctgagtccccggaaggagaaggcgctgaggaggaacctgaaagaacagagtagcagctcagactgccagagatcgaaaggaaggcctcgaagtgagttgagctggacacagcaccgttggtagatttaggaagaaggagaaccaaaaacttttgctagaaaatcagctttttacgagcagaaaaacctcatggccttgtagttgagaaccaggagttaagacagcgcttggggctggatgcccttgtgtttgctgaagaggaggcggaagccacggggattgaatgtgaggccagttggccgggtctgctgagtccgcagcactcaggactacgtgcacctctgcacgcaggtgctggcccagttgtcacccctccatgaagccaatttccccagtggaattcgaggcggggaatatggactcttcaagatacaagaagtctgatatccctgtaggggcatttcttggccaaccttggcaccccaggtctattgttccttccacatagccctttccccaagaagactttgcagcctgggaggagcccccaagaaggtctacccaagaaaggggccaaggtacctttaccaggcgcacctctatctcgcaaggggggagcgtcatcacgcatggggggagcccattaatgacacaatcggtttggcacacaataaatacaagcgccagtttaaa

SEQ ID NO: 622113 - DNA, 3525 bp, Homo sapiens
  misc_feature (1041)..(1041): n is a, c, g, or t
gataaggacaattaccatccttgcttatatctaagtccagaaacataagacaataagggaacacacacacacatgcatttggattttgatgacttaggtttcccaatgtggaaaaaatagtagcaaataagttctcctgtgaaaaagtcgttaccttatttaaaattctgtgcccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagacggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgangaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaagacttctatgtaagcaaattcactattgatcttcctggaacttgctatgtgaaactacagatcttgtggaacactgcttaggtagcggtgttaagacttacacagtacctcgtttctacacagagaaagaaactgggcagtacttcagtgaacttgcagtgccttactgaacgggccatattttcagggccctccttgaacacttttccggaacggttacgaacttgggggc

SEQ ID NO: 622114 - DNA, 509 bp, Homo sapiens
tcatagctgattctagagtatccctactgtacatcatacataggtctgtcttctatataaacacatagtctaatgtggagagataagaggcaattacaacttcgagctagataaaggactttaggcactaggaggagaggcatctatctagatttgatctggctcagctttcaagagaaagttacttgtcccaaggagttggcgcagaatgatgtgatagatttcaagccagagagtaacatcatgagctatggcataagccactgaggacatacagcatggtaagctagggatataagtccggagcaatagagaagccagtcttgttcatcagacctaggaatttggccttggcgacagtaagatcaggggactggtacatttatagttttagacagaccatacttcagtcggagaatgtgttgatgggaggcacgaaagaagcacaggatgcaaaggccgtagaatgataccaatgcactttagggactcggaaggggaaggtcggg

SEQ ID NO: 622115 - DNA, 365 bp, Homo sapiens
tcgacttttttttttttaagagacagggtcccctctgtcacccacactggagtacagcgacatgatcacagttcactgcagtcttgaactcccgggctcaggtgatcctctcatctcagcctttcgagtagctaggactacaggtgcccaccaccaccagctaattttttttatttttgtagagatgaggtttcactatgttgtccaggctggtcttgaactcctggcctcgggtgatcctcctgcctcagcctctcaaagtgctaggataagccaatgcacctggcctctaccttttcgcttgctactggtagttattccagagcaaggattgtattgtactaatctttattatcctggtgcct

SEQ ID NO: 622116 - DNA, 2939 bp, Homo sapiens
  misc_feature (1041)..(1041): n is a, c, g, or t
gataaggacaattaccatccttgcttatatctaagtccagaaacataagacaataagggaacacacacacacatgcatttggattttgatgacttaggtttcccaatgtggaaaaaatagtagcaaataagttctcctgtgaaaaagtcgttaccttatttaaaattctgtgcccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagacggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgangaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttacttttttttttttggtgtcagagcgagatccgtctcaaaaaaaaacgaaaaaagccacaggttgacagaaaatatttgcaaataacatacctggtaaagatttgtatccaatagatatattaaaaactttcaaaacccaaaaa

SEQ ID NO: 622117 - DNA, 2649 bp, Homo sapiens
  misc_feature (1041)..(1041): n is a, c, g, or t
gataaggacaattaccatccttgcttatatctaagtccagaaacataagacaataagggaacacacacacacatgcatttggattttgatgacttaggtttcccaatgtggaaaaaatagtagcaaataagttctcctgtgaaaaagtcgttaccttatttaaaattctgtgcccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagacggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgangaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccataagcgaccgtaggtttgttacaatcctactgtcgctaatgggttggcagcaag

SEQ ID NO: 622118 - DNA, 1342 bp, Homo sapiens
  misc_feature (1041)..(1041): n is a, c, g, or t
gataaggacaattaccatccttgcttatatctaagtccagaaacataagacaataagggaacacacacacacatgcatttggattttgatgacttaggtttcccaatgtggaaaaaatagtagcaaataagttctcctgtgaaaaagtcgttaccttatttaaaattctgtgcccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagacggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgangaatgtaaagttacactgttcacaaaggttttgtctcctttccactgctattagtcatggtcactctccccaaaatattatattttttctataaaaagaaaaaaaaaaaaaatttgggggcctgcgccagagatttttaaccctctgtgggccggccaatagtatgaatggctaaggtttcacagaacccggcgacaaggttggtttccccaaaaaacggcgcggggtcggaacctcgtttgggtttgtcttaagcctcattccccccgcccccccggaaaacaaaaaaatgcatcatcgc

SEQ ID NO: 622119 - DNA, 515 bp, Homo sapiens
ctgtgtgttggacactggttgagatggcgctattgcccctcatgtgcagtatatcagtttcggatgtccgacggggccgcccttggtaactctggccctcagacgtggtgggcgtcgtatttcccccctgtgtgtcgcctctacgcccccgtctgcgtcccttggggggctggagtcttcgccgtgtagtgtgtgtgttcccgccacggggccctgttgaggagattcttccagagcatagcgcttagtcatggtcttcatgaattcttgtgtcgccctccttggagctgcgatacattcgaatgtgcttctttcatagtggcacgaggttttactcgccccttggctctagaacttgccaccaaatggtctaagcaatggtgttaagaatactaagaccgtacgctggggaaaacattcagtcgccgcccctatgcttcccccacgagtttgcccccatccatggtagccttcctgtctgccccttttagggaaaaatttcgcccaacatgaca

SEQ ID NO: 622120 - DNA, 767 bp, Homo sapiens
agcggagattgaagcttatgtgccacctgtagggagtagtcttcattagccttataaacacaagtgggagggagaaagacaggcgtagacctcgatcaccatcccaaagcagagcccatgctcaggcttgctgtaaggcagggcagcaagttgaaatgtaatcgagagattatcgagaagcagcgcattgtgtaacttttgtgcaggtgggaaatacagaagagcataggggagaacgagactagtttatgttctaagaaaattatctagtcttctatagctaccgactgagagtatgatattcaattatccctatttagctagacacaaaaaggtaatacgagcattggaacgaagtctaagtgtgtctacccaagatctctagatgagtatctcagtgaacactacaggtgtgaatcgacccattatagaagatttttggagaatgtcgaggcagatgtccgaaagagccctaggtagcttatgtcggacatggatctcaatcgaataatcagtactggcaatataataagtggcaaaattacgaaggattgtggcattggtccgaggcattcttgtcatcaactatacccatactgaagctcgtctatgaataattaggggtcatccaggaatcctcgtgtatagaatcatgcatgtttcgtaaagacacgtatgttggggtcgtgaataaagcttgcattgaaatatctctgggcaagatggaatggagaaggaccccataaagagatgagcgtagaatcgtg

SEQ ID NO: 622121 - DNA, 301 bp, Homo sapiens
  misc_feature (90)..(90): n is a, c, g, or t
  misc_feature (276)..(276): n is a, c, g, or t
  misc_feature (287)..(287): n is a, c, g, or t
  misc_feature (301)..(301): n is a, c, g, or t
gtgtgataatgatatggtgttgctgtgattagatgatcactggtgttgctgttgatagatgatcgtggtggttgggtgtggttaatgtgntgttctgtgtctcagtaggatcatttctctctgtggatcatggtccaaaggatggaaacccgtcctggaggccctggaagctctgatctgggcaagtgcccatgtgggcttggaggcttgggaaggggacatgaagaatgggccaggtccagggcttgtactgatttcctgttgctactgtgacanaattacccagncattgcactccggn

SEQ ID NO: 622122 - DNA, 296 bp, Homo sapiens
  misc_feature (7)..(8): n is a, c, g, or t
  misc_feature (14)..(14): n is a, c, g, or t
  misc_feature (72)..(72): n is a, c, g, or t
  misc_feature (137)..(137): n is a, c, g, or t
  misc_feature (142)..(142): n is a, c, g, or t
  misc_feature (170)..(170): n is a, c, g, or t
  misc_feature (172)..(172): n is a, c, g, or t
  misc_feature (174)..(174): n is a, c, g, or t
  misc_feature (185)..(185): n is a, c, g, or t
  misc_feature (197)..(197): n is a, c, g, or t
  misc_feature (203)..(203): n is a, c, g, or t
  misc_feature (225)..(225): n is a, c, g, or t
  misc_feature (227)..(227): n is a, c, g, or t
  misc_feature (231)..(231): n is a, c, g, or t
  misc_feature (238)..(238): n is a, c, g, or t
  misc_feature (244)..(244): n is a, c, g, or t
  misc_feature (276)..(276): n is a, c, g, or t
  misc_feature (278)..(278): n is a, c, g, or t
  misc_feature (280)..(280): n is a, c, g, or t
cgcaagnntagaanatatatcaatatatgtatatatctatatctctaaacctgtgagcccatgggaggccgnggtaaaccttgtggaagaagaaacagaccccttgagcagagcccagttcagcagccccatggcangcctngcctgagtccaacagtccaccgccaccngnangaagagccccngtctgaactgcngtgggntgggctgcagtaagcccgaganangggntcagcancccccntgggcacaggccccaaggcggggacaccaccncngnatttcatgtccgcccc

SEQ ID NO: 622123 - DNA, 207 bp, Homo sapiens
acgtatcacaacgcggagactggtgcagccctggcgcaccgccaccgactgtgaccccgccaccgcaccgcccctggcccagctgaacaccagactcgcatccccacccaacggctcccagatcacggtcccggtccagaacaatgccaccgggctgaccttccagttctacaacgtggcgggcaacaagctgaccgtgtccaccgc

SEQ ID NO: 622124 - DNA, 1244 bp, Homo sapiens
ggtgagcttcagcggtctgttatacttgtacgacgggcgtaattaatgccccttcttgtgcccgccctcttttttttgttgggacgaagccgcctcagagggtgtactggccctggggtttctcccgggagtttctctgtggcctgtgacacccttgcatatcggcgtggtaattgcttttgggcgcggcaccccccgtggtgtcttgttggggcgtgctgtctccgcccttctggggggagagtccccccggggaagtgtccagcttgtgagttgcctccctggaatgtgtttaaacctcgagtataaaggtaataacatgttttttgttgtggatataggggtctgcctcgccagtgtgttgtaaccccgcgcgggtgtgtttccccctgcgcaatttatatggtgggggaaaatggggtttgttaagtgttttgggaggcccttcgttggtggcggcgttttttcgtgatgccgttttattgttttttttggaaagtgttgtttgtcacaggggggtagatgtggggagttgtggtggtagtacacccccgcatagcgcccccttattttcccccccatcccccggtttcccccccgcggccgccaaatctctttgggcccgccttctagtttttgtttgtggatttccaccttcttggccccacttgtttttataaacaaaatattctaaaggttgttttgataatagaggtcccagaataatgtgtgggggaaataatataaaacccctctttttctccccaccctttgtgtgataaaatctcttttgtggacacacaagaatttggtttaacacccctatttttataaaaatgagagttctccccaccgggagaacgccctttgttaaaccacacagatagtgttttatataaagaggtgttcttttgagccctacaatatatagatctctccgccactgtgtatatattttatattttgtggatattttatactccacgaattctcttactatactacacatatagcgccccataagaaaggagatattttatcctttaatatattgtgagctttgtcgtcacatatgggtttgtggcccccactttttttttttttaaaatcacatacccacatatatgggaaatttttttttttgtgtttatggttttttttttttgagagtgggcacccccggggggttatttgtgaaaagccccatttttttttataatttttttggaaaaaaaatttttata

SEQ ID NO: 622125 - DNA, 711 bp, Homo sapiens
ggcgcggcgtagcttgtgctaccctggatgaccaactgcgtgtgatcactcgtgcctgtgcctacattcaacgactcgcagctgccagtgccatcaaggtatcgggtgtgatcagcgtggtgctcaacgtgctgcggatcatcaacgagcccacggcctgcctgccatcgcctacggcctggacagaactggcaatggtgtgtgagcgcaactgtgctcatcgtttgaccttgggctgggtggcaccttcgacgtgtccatcctgacgatcgacgacggcatcttcgaggtgaagtgccacgtgcggtgacaccacactgggtgcgggaggacctttgatgaagcaggctgtgtgaaccacttcgtggaggagttcaagagaataacacaggaagtgacatcacgccagaacaagccgagccggtgaggccggcatgcgcaaccgagctgcgcagagggcccaacgaggaccctgtcagtccaggcaacccgatgccagacttggagatacgacgtccctgtatagagggcatcggacattctacaggtgcatcagcagggctgaggttcgacggagctgatgcatccgacttgtcccgcaaggcacgcgtggagcccgtggagaaggctctggcgcggaggcaaagcctggacctaggtcccagaattcagtgatcctggatcttgagtcggggggatacaccgagatcc

SEQ ID NO: 622126 - DNA, 167 bp, Homo sapiens
gctctacagatcttatcctcattatgatctgccatggagttacttatcataatcttccttccctctgtgatctgccagtaaacataggtgatattagcacaatgagggtgaggatgaaaaagaaagcaaaccccagctcacttgttctaggaaagggagacgaggtg

SEQ ID NO: 622127 - DNA, 230 bp, Homo sapiens
tattcccatcaggttaaagtcttcatctacattatgccctccaagatatgcctttagtgtaagtagctggattggggtatcagcaaatttcaggtatagttagatatacaggtacagggccttcatactattcacccatagtttgtggccgccgttttcctactcccaaccgtctcaccgcctctattggaagcgcgcacgacgaaacgtaggtataggagtgggcgcta

SEQ ID NO: 622128 - DNA, 1093 bp, Homo sapiens
  misc_feature (131)..(131): n is a, c, g, or t
  misc_feature (453)..(454): n is a, c, g, or t
  misc_feature (468)..(468): n is a, c, g, or t
  misc_feature (485)..(485): n is a, c, g, or t
  misc_feature (507)..(507): n is a, c, g, or t
  misc_feature (518)..(518): n is a, c, g, or t
  misc_feature (527)..(527): n is a, c, g, or t
  misc_feature (545)..(545): n is a, c, g, or t
  misc_feature (557)..(557): n is a, c, g, or t
  misc_feature (638)..(638): n is a, c, g, or t
agcggagcgtggcagcgcgctaggcggcagcagcgggcgcggagcggggcgcggccgccgcgcgttccctcttggcggggttggccggccgggtgcggggcgcggcgctccggctcgaggcattcggagcngcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaacgaggccagcgctagcatcattgttaaaatgacagactcgttcactgagcaggctgaccaggtgactgctgaggttggaaagctcttgggtgaagagaaggtggatgcaattctttgcgttgctggaggactgggccgggggccaatgccacaatccnnagtctctctttcangaactgtgacctgatgntggacagcacgacgcatctggnccatcgaccantctccagcncatctggctaccaagcantctcaacggaanggaggcctcctaaaccttggctggcgcacaaggctgccctggaatgggactcctggtatgatcgggtacggcatggccacngggtgctgttcaccaagctctgccagagcctggctgggaagaacagcggcatgccgcccggggcagccgccatcgctgtgctcccggttaccctggataccccgatgaaccacggaactccactgcctgagcgctgacttcagctcctggacaccccttagaattcctacgttgaaaactttcccatgactggatcaccggcaaaaaccgacccgagctcaggaagcctaatcccacgtggtaaccacagaacggaaggacggaacttcaccccagcatatttctaccgcctccatctccgtgcctatgcagggggctgccagcaaccgtcactaacctgtctcactgtggccctgtccacccttgtcgtcccctgtaaccctgttgcggtcgagactaagcgcctactcttcctcactactctccttcgcccctaggacgcgtcaactcctcga

SEQ ID NO: 622129 - DNA, 372 bp, Homo sapiens
  misc_feature (254)..(254): n is a, c, g, or t
gcaattctcctgcctcagcctcccaagtagctgggattataggatgtgtacagcctggtaatttgtattttagcagagacaggttcaccatgttggccaggctggtcttgaactcttgacctcgcaatctccctgactcagcctcccaaagtgctgggattacaggcgtgaatcaccgccccggcccctggtccatatgttttcattcaatagtattgggcttcattttcctttttcttttcttttctttttgnagggaagttggtagtgggtattgtttagttagaacttagtataaatgatccttttgacaagggaacaaaagccctcattctgattggcacagtatccgccactggtcgccaactgggc

SEQ ID NO: 622130 - DNA, 127 bp, Homo sapiens
cgcgatggaccttgccttcgagttaggagacaggccatcgcttgcaagtgcatcagtcactgatttcatcctctagtttccgcacagtgccaccaaagttgtccgacaagcctggaagaaggcagac

SEQ ID NO: 622131 - DNA, 194 bp, Homo sapiens
gggagcaggagaagtgtggttccgagacccattcacaccaggaggaacttttaggtgggcaagaggacacttggagcaggaggacagcagttccaagaaaagaaagcttttattaggaaagcccatttacatgggccaccagccacagcatattgttaacttaggtgtccactcttgggccacttagtaagctt

SEQ ID NO: 622132 - DNA, 440 bp, Homo sapiens
caaggtccaggcgctgttggttcatccggtcggtgatgccgttctgctggtcctgcaggctacgctgacgatcgccgagaccaaggccgtcagcggaacgcttcccctgcagccttagcgccaggacctgctggtcgagggcatcggtgtaggtctgcacggccctggcctgtttggccagccggccctgctcattggtcgccagcaccgagagctcggtatcagcgtccttctgcgccttgaccatggcagcgcgggcatccgcgattttctggtcaagctggatgcgctgctgggcgctggtactgctgcgccccttggcctcctccagtgccgtgatctcggcctcgtaggcgttcgtgacctcggccttctgctgctcgatgattgcggcgcgctgggcggcgtacgactcctgtgagatcaagccggccttctgc

SEQ ID NO: 622133 - DNA, 731 bp, Homo sapiens
tatggccggggactacggcgcatgccagttttcagagtaattggacatgttctagcagttgcatgaaccgacagcctgagccgtggccatgaccgagtggccgggatagtatcgtactatcttagcagaacagtcatatggctccatgaagcgcacgacgccggcggtacaagaggatcattagccgtcggaggagtagggttatgaccaggacaggtaggtatacgacggctcacatttcgtgtgaggctaatggaactgctgagagcagtcagacttgttgtccgactgatatgaggcgcagcactgacacgcagccgcgtactacgggaaccagatgtatacatgatcaacgcgtactatttgttcagacatatagacgccgtaggatcacgtgctggcattcatgccataaggccatttactgtaggtaggagtctcatgtttagcagcgcactgacctaatagagactactcacgctaagcaactcttgcaacgaggggcctaacagttggataataatcctcttcaagtcctcaagactatacttcaacttataggtttgtgacgaggcttatgaggcagccttcctattgcttaaccctcacctttaaccaatgggggaaccctctgggttaggtctccgtccccagggcaagacttatttggctcctaaccgacccctctatttttcacgggctcatgtgccttcagtattcacccttcgggc

SEQ ID NO: 622134 - DNA, 303 bp, Homo sapiens
agcggcccctactactactactaaattcgcggcgctcgactggagatccctcacagaactaaaaacagactgctttccataggtgctgaatcaatttacattcccaccaacagtgtatacgacgttcccttttttcagtggttttgccaacatgatgttttttgactttctagtaatagccattttgactggtgtgagatagtacctcattgtggttttgatttgcgtttccctgatgactagtgatgttgggcattttttcatgtttcgttggctgcttatatgttttcttttaaggtcgac

SEQ ID NO: 622135 - DNA, 274 bp, Homo sapiens
cccccccttttctgccccccctaaaccctcggtttagtaatttggaggggctggtcccctccctctgttgcagggaacccggaggaaagggaaaaatgtttccctatttcctactcttttggcatgggctctcccttccccttgttagggttctggggtcccctgggctccggggtttgttgggtaagggttttctgggcctatatatatatatacctatggttttattttttaatacccctatatattggtccgaataaaaatgtttttttta

SEQ ID NO: 622136 - DNA, 513 bp, Homo sapiens
aattgatatatattaaacatggtggtatacccaggatgggtgtgacacagtaccaaaagaggctgtgctgtttctgttgtcgataatttataaaacaattaataaaaccgaggtctatgctatccacaaacaagcgacttaacaattcagtgataacggcacctgccaccgtggtagcaaccttcggggcggaggcatgtttaaactgcactgcgctcaggttgcctggcatctctgtgtgtggatgatgccattgtgctatacgtactgtcctgggacgtgagtgggggcctgtctgtgtggctgtgtccggttgtcgtgtgtctcactgttgcgttgtacacgggacagtttacctttctgaagtccaggactccagggctgggaggccggctggccctgctgtcccgagtctccaaacagagcagctgctgcctaccgcctggaagaccttccaaagggggcctgccgtggtacatcttaaacgttttacagagagcttggtatgcaggc

SEQ ID NO: 622137 - DNA, 97 bp, Homo sapiens
taaagataattacaaaagatggaaaaatcagctcagaaaggccaattacttcttttgtaattatctttattaaaaaattgtacttggaaaaaaaaaa

SEQ ID NO: 622138 - DNA, 974 bp, Homo sapiens
  misc_feature (628)..(628): n is a, c, g, or t
tctctgctccttatgcaaaacacatgattgaaataatccccgacgaaggattatttcaatcatgtgtttgcataaggagcagagaagcaacatggtaacaccctctaatgaatcccactgtattggggggaaacttgagatgtgcccatgtacatttttttttttttttttttttttgtggagagagaagggatgtttgggctttgtggcgcccccaaagggttgggtggtggaaaaagggggggagaaaaaaagggccccttggaaaggttgagaactctatagggccggggagaatgtggtccttggcattaaggtcaccaaagggggggggggaaaggggggggaagtggcatataatcacagcggcagaaagattatttttaagaagtagattgggagaagagagaatgagagggtcctggcagaccagtggccacgggggtggggtatatagagaattctgggggacataagaaaggaacaatcctttcgttggctccacaaaatatgggggtgggactagtctttagggcaggttttttttggggataacccacaaaattttttcggcggttacagaaaaaaagggacttctattaagatttttaaacctgggggactaatnaagggggggaaaaagaggcgccaggaggggttttttaaaaaaaccacggtgggtatgggacagttttaaaatttagcgcgcccgtgttattagaaaaacctttcccttacagagaggttttgggggttttttttaaaccacgtgtggttcttaacagacgacagaaaaattaatatatttctcccctcccacaggaggtgctgtcggaatatcaaacaaagagggcgatttggggcggggaagccacattgtggagggagcccgggagtaaaagaaaggcaagtcggctatgggggcgcggaaaagataatacagtgctggtggacgaagagggtcaccacaaata

SEQ ID NO: 622139 - DNA, 1317 bp, Homo sapiens
  misc_feature (174)..(174): n is a, c, g, or t
  misc_feature (224)..(224): n is a, c, g, or t
  misc_feature (268)..(268): n is a, c, g, or t
agcggagggtagccggtagccgggtcctggacacagcgcagacgtggactcgtccccgtttctgctctcttcgcgggtggcggggtcgggaaaagctagatgtggatggcacccccatggcaaggatacagaaactcgcgaacggtcccgcgaacggtggtcggggcgtcatgntggcgaagtgtcatgagtagagcgcatattaacactaggtagctacaggnaacatgtgtgatttctcgactatgtgcacgagatttacgtgacntcttggccacctgagtaatgctgcggtgccttacttctctgttgagctggagttgatctgtctccgcaaggctcatgtgccttcatgtctgtcggtactggcagttccagtgacatgcactgactgagtagtgacagcatgataaaggggtctcctatggagcgttgagagataaaaacacctggcatcgttggatcatggcacgtttcattggagagtatcaactaggtattccaatttgggaaccaatggaaaagtatattggagggtgtgcatgacacgacaattttgtgggggagtcagtgttgcgttaccaccaaagaaagataagggtcctcttccctcactaaggcacgtttcaagcaagaagagctttcctggtgggagtcaggagaactttggattgtgtcaacggtagggagtttttcagaaaaaacgggcttcggggcataagatatcattcaccaacaaggtggctctaataacgttctggggtaaggaaaagggtttttcggcaatgcgaaagaaagctaaagaaaaacctagtggaatctttgattgagcaatttacagagcgggcattttgaccagcgttctttataaataattacgaaatcacacgcaacaagggtcttccccaaggggttgggcaccatctatgtttcgaagagagatttcgctgccatagagttaggaaattccaagggtgagagttgggtgagggaataacatcgcggagctttgatcttctcttgaaagaggtctggtagtggaagaaagttgtagggtgcaacggaattccttaccgtattggatctagcatgggttcaaggggggttacctaaaattgtggctcgtgggcgaaattagcacgttgcaatggagacggtttcaggaaagggtgggttggagttttggaacattaggaaatattgcgttccttattaggtacacacaacatatacactttcagattccagaggaagaggaatcggagtgggacattttagacgcgtaaagagaaagtttccttgaggctgtggggaatg

SEQ ID NO: 622140 - DNA, 377 bp, Homo sapiens
gacttggaaaaaacttggctctgtcgggaaaggaaagacggggcctccatcacgcctgttaccaaaggatccccgaaagcccccccagctttggacatccccgcccctggaactggggcccccagccctgggcccgaaatttgctttgactttatttatatggcatgaaatctctggtttattttgggattttttgttgttggggttgtcaaagtttgttttttttaaagttgggggattataaatttgaccttttacctttcaaaaaaaggtatgttgtttaacagggggcccacaaaaggtagtattggccactgttcctgctttttctaaaaaaaaaagagccccaaagaaaaacttaattttttgaaaattta

SEQ ID NO: 622141 - DNA, 800 bp, Homo sapiens
  misc_feature (138)..(138): n is a, c, g, or t
gtgactcctgcccttggagggcatgtagtagtgtctgtcctgccaggtcccaaggccctgtgagaagagagactggcctgcatctctcaaagacttagtctgacgccacgcgcatctcttggtctgtgttcaatcagntagtccaggggagaagcttctgctactcacagagcttggctaaactaacctaattgtgtccaaatcaccccaaaaccaccatctctgacgtaagcttccatgcgacagctgatccgtttccctggacaggtctctttcctgcaaaatgcagcccaggcacctcgtgctcctggcacccttgaggtctctcctttgagccgtgttcaccgagagggttgaggacgcagcacccgaggtcccagccttggcaggagctccctgggctaagctggactagatctcggtggctcatgtaaacgtggcagccagctcttctagaaccctagcccaggtcctggagcggaaagggaccttcaaagtgaagactgccttgtccggagctcctcctgcctagattgaaaaatgcgctcctaatgggttaaatccttttaaaacaaggagttgttggcgcaagggtgtccgtgcactccttagagaagggtacccagttgcccggtgtgggaattgtgcttggcgctgaccctggcggcatctgactggtcttccaggtccaggaacagattgaagacgcttacgtgagggaacacagagagttggattggacaaaggccggtaaaggcgagagccatatgaattaatttcgggggacatttattagcacg

SEQ ID NO: 622142 - DNA, 153 bp, Homo sapiens
aacagataagatccaacccttactatttttgccgtgactttctacaaagattccaagaggaacagacatggctgaaacgtcccccatccgctatagcttcggcggtgatgaacatctgttagccgaggatcagcgacagcatgtccctggagg

SEQ ID NO: 622143 - DNA, 894 bp, Homo sapiens
tcaaccaggtcaaaaaaaaccttaataacttttaatgattggccacttatgcttttcttgccaaatgccttgggagcaggtgcttatctggggctggagcttttggacccttctggagcttatgggaagcaggctgcttgatttctgggccttgtgtgcttccttggggaaggagaacctctctgtggctgggacgacttttatcacatccgcggggggtgtgatcttattaatgtgcttgggaacaattatagccatgcatgcaagcatgctttgtatgctagcagagcatgcactgctatgatccgtgctccacagaccgacacaacatcttgactagtcgtgtcctatctctagttatcttctatcatgagcctcttaccttaatgctataacaacttgttatgtctagtcaccaataaatatcttatttactatgactatcacatcaactatgatcttcttttaactgtgcattacacaataaactatcaatgacttaatcgaaactcaatactcattattaatcgggaaccacaccgcgatctgctacagcaccttagtaaacccgtaggtgactagaggcctagggactaagtaatacagaatcagagtgaggctaggactaaggagagcaaggtaagtctcccttactttactaaaccccatactgacccctctcctctattaatactccttattcacacaccacacaccaactccacccatcatccatctttatatctatccttcactctacccctcacccacccacatctatcatatctacacaccacaactgataaactcataaccagctctcgcacacacactaagataaaaacataaccaaaacaacatactctgtctcctacctgcagccagcctccatca

SEQ ID NO: 622144 - DNA, 1138 bp, Homo sapiens
aaaaaaaaatctgggggggttccatcagaaggtgggtagggaagaacaaaaacttggggaggagcagctggggcacgggggctcaagcctgtaatcccagcatcttgtgcgaggcttgagggtgggtgtggatctcacctgtgaggctcaggagtttcgagaaccagcctgtggccaacatgtgggtgaaaccccattctcttacttaaaaattacaaaaaatttagccgggcgttgtggtggtacgcgcacccttgttaatctcccaggctatactctccgggagggcttgagggcagcaagaatctcgcgcttgtgaaccccagggagggcaagagggttgcaacgagaggccaagagattcggcaccattggcactctccagccgggggcaacaagagaggcagaaaccctccattctataaaaaaaaacaaaacaaggcaaaccaacaccaaaaaaacaccggggagggaggcaattaaaagagggaatctccagggctgtggattttttttttataagggtggaagaggagaagggagaaggggcgtgggtggcgcttctcaaatttttccctgtgtgtgttgggagaggttctctttaaatgtaggcttgtgtgtgtacaccttcgtgggatatatttccccggtggccagtggggttttcctttaatatatatattatattgggtgccattttgggccaaaaattgggaaaactccctgagggggacaccatggggctaaaaggggggctctgggtgccacctcctggggcgcctctctcacaagggggcccttgagaaaacaaaatatgtcgtgtgtttaaaacaaagacgcctagtaacacacacaagggttaggggcgaggcccacaaaaagttttggggctggaacgcgggacttagatgtggcaattacagcttgggaaagaacccccaaaggggggtgtggggcccccctcaggagaaaggggtgaacccgtggtcgacaacagggggttaccaagagcccataaggcccatactattaaccactatatgctggagaatacacgcttatatttaacctttgtgtcccctttgtaccacacacaacaaacaatataatatacacacaaaaaataacaaacactcgg

SEQ ID NO: 622145 - DNA, 550 bp, Homo sapiens
  misc_feature (544)..(544): n is a, c, g, or t
atccaaaggctgggatgataggcgtgagctacacaccgggctactgctttttaaaagatcttgccgaagcgctctacgctgaagatgccgggctgctatgacgtcatggctgatgcccgtaataatctgattccaggtgacctcagggataaaggatgatatagttacattccatgaactctgcaagtcagcatgaggcataacctggcctgcaacgccataagacaggaggcacctaaagaactcttggcaacttctccatgctacccgagaggcacgtgagcctctctttgcagtttctccttagtggctggtgacagtaactggtgtttagatgaaggtgaccgtcgctggactggcatgtggtacctgacattcttccagaaccttgtctttgcagactgtggtccctgtgtaaagtcccctgaccagcggatagcctcatgtttctgcttaatgaatttaatcgattctggcattttctcatagtctgggattttctccagctcaagcaggacaactttaattccaagcggtgtgcatnggacga

SEQ ID NO: 622146 - DNA, 954 bp, Homo sapiens
gcccgcgtacatgggctgaggaatgtacacgcagtaagaaatggtagagttgacttcaggcttaaagggtatgtccttgaacttggagacctgagccaactgtggtgtcgtcgtgttggaaatgatacactagttaaggaaggagatatagtgaagaggacagtgatgccattgtggacgttccagttggtgaggagctgtgggtcgtgtagttgatgccctgtggtatgctatgatggaaagggtccaatgtggttccaagaacgcgtaggcgagtgggtctgaaaagcccccggtatcattcctcgaatttcagtgcgggaaccaagtgcagactggcattaaaggctgtggatagcttggtgccaattggtcgtggtcagcggtgaactgatgtattggtgaccgacagactgggaaaaaccgtcaatttgctatgtgacacaatcattaagccagaaacgttccaacgatggatctgatgaccaagacgaagctgtactgtatttattgtgtgctattggtcacaagagatccactgttgcccagttggtgaagagacttaccgatgcagatgccatgaaagtaccaccattgtggtgtcaggctaaggctcgagaatgctcgccccacttacagtactggtccgtataatctggtgtgccatgggaggagcatttgaggaggacaacgggcaacactgctcgctcatcgtatgacgacgtaatcaaacaggtggggtaaccggccaaaggcctggggtccggcggaccccggcgtcgaaggcaccgggacggtctactaaacccgggggcgggaaagcgccaaagacagcgggtcgggggggccctaaagcgtggggacaaaccagcgggggggtgcgccaaccgcaaggggcgccggggcgcctctcgcgagggcaacagcgcgcaaagggggtctgcgggccgcagt

SEQ ID NO: 622147 - DNA, 126 bp, Homo sapiens
  misc_feature (23)..(23): n is a, c, g, or t
  misc_feature (84)..(84): n is a, c, g, or t
  misc_feature (89)..(89): n is a, c, g, or t
gcttttcctccctgtcgccaccngaggtcgcacgcgtgtagacttctccgccgcctccgccgcagacgccgccgcgatgcgctncgtcncctcctacctgctggctgccctagggggcaactcctc

SEQ ID NO: 622148 - DNA, 336 bp, Homo sapiens
gcgtcgactggctcacacttgtaatcccagcactttgggaggcctaggtgggaggttcacttgaggtcaggagctcaagaccagcctggccaacatggtgaaacccgtctctaccaaaaaatacaaaaattagccaagcatggtggtgcatgcctgttgtcccagctactagggaggctgaggtgggagaattgcttgaacctgggaggcagaggttgcagtgagctgagatagctccgctgccctctaccctgggtgacagagggagactgtctcagaaaaaaagaaaagattaaatctagcaagttaacaagtcatgcagtaacaagtcacagc

SEQ ID NO: 622149 - DNA, 225 bp, Homo sapiens
agagtttccggcagcatctactgtccggagattcaccggacagcatctactgtaccggagatttcaccggacagcgggatccttacatctactgtaccggagatttcaccggcggcaacatcatccccataaacattatcaccatcatcattaatatcaccatcattatcacatcaccaccatcattcccatcagcagcagcatcatcatcatcactatcatgac

SEQ ID NO: 622150 - DNA, 132 bp, Homo sapiens
tgggggtgggccgtagtttttggggaggtgtgagagtcgtaaagagtccagtagcgcttcggggacatcattgactccagagagtccggggtttccagggacggtcagaaggctggaagtcaggtgggaagg

SEQ ID NO: 622151 - DNA, 348 bp, Homo sapiens
cgaaagagtttgctttgcgagagaggctgctttagacgagagaggctgctttagccgagagaggccaaccctccctcaatctgggtggcaccatctaatcaactgccagcatggctagaacaaaacaggcagaagaaagtagaatgagcggacttgctgagtcttctggccttcgtttttcgcccgtgctggatgcttcctgctcttgaacatcagactccaagttcttcagcttttggactgttggacttacaccaggggtttgccaggggctcttgggcctttggccacagactgaaggctgcactgtcggcttccctatttttgaggttttgggccttggactgg

SEQ ID NO: 622152 - DNA, 769 bp, Homo sapiens
  misc_feature (83)..(83): n is a, c, g, or t
  misc_feature (126)..(126): n is a, c, g, or t
gaccagctgggccgcgcattgcagatcatgtccagattcagcgtgcaagcaggatctgtgggcgtatctgcagcgcatcgccntgttctgtcaccagctcaacatctgccagtaaagtcaaagcgnaggtgcagaatctgggtgaagagctcgtggtgtctgggctggacagtgccatgtctctgatcaggcggccaagaatctgatgaattctgtggtgtccacagtaaaggcctcctacgtggcctccaccaaataccagaaatctcaagatatgcaaagcctcaacatgcccgccatctcctggaagatgaaagctcccgagaagaagccgctggtcaaacgcgagaagctggacgacggtcagaccaataaagtcaagcggtcctctcaaaagaagcacatcaaccctgtgcaggccctgagcgagttcaaagctatggatagtatttaagcagcatttcagtagattgagagttcgagaatacacatttaaacgcattcctgttccttagtcaccaatctgcctttctttccatgactaaactcttaggtctaggggtaacactttaaaatagtggtgcattggttaatgtgtttactagcatgaacaaactattaggattacatttattatggtgttaatcagtctttgttaacattagttcggtagttgttaaatcactgttcataaactaatgttaacaagtcagattttaataatgcataatgttgaagcatgattaataaatgatttgcaagatcaaaa

SEQ ID NO: 622153 - DNA, 223 bp, Homo sapiens
tttttttttttaaaggaaatttgtagggaaattagtataaagaggtagaagtttttttcgtgaatagtggttcactggaataaggtggcgtgtggctttgccatgattgtgaggggtaggagctcaggtagttagtattaggaggggggttgttaggaggtcgaaaaaatgtggctgcatcaataagaaaaggagcaaagaaaagctagaaatttgaagaaag

SEQ ID NO: 622154 - DNA, 141 bp, Homo sapiens
tcatgatcattgcagttcaagcctgagtgtgcaagcattcagcagtatgccttctagctttttcctgctgttcgcggtttttcttgagaattgatggggtgcttatcagaatgcctacacgatggctttaccacttaggct

SEQ ID NO: 622155 - DNA, 327 bp, Homo sapiens
tgagacatgatctcactctattacccaggccagagttcagtagcatgatcatggctcactgcagcctcaacctccagggctcaggtgatccttccacctcagtttcccgagtagctggaactacaggcacacgccagcacgcccagctaatttttgtattttttgtatacagggtttcactacattgcccaggctggtcttaatctcctggactcgactgatccacctgtcttggcctcccaaagggctgggattataggcgtgagccatcacacctggcctagagaactttcattcagctttttcatgttgacgtggtcggaaaat

SEQ ID NO: 622156 - DNA, 864 bp, Homo sapiens
  misc_feature (198)..(198): n is a, c, g, or t
gtgtgtcggggtcctccttcgctcccttttggtcgcccgctcgtgcccccctcgttggtgtgtgcgccccccgcggcgcctcagtcctgggccgacgttggtggtggtcgggggtagggaggagaagtagttgtttcccccccctctgttgctgggttagaacagggtgggaggaggggcgcccccatcttttcttgnaccgtttggtggtgtgccgccccctcgttggtttgatagtgttcgctctcgcgccccccccccctctctggttggggggaagagtctttctctctcgcgagcgatgctcaccccccctctctggtggcgctcttgttttgctgtgtgtgcgctgaagtgttagctgagcaccccacgctgtgctcggtggggtggggtgctcttctccaacccgcggtgggggcccaacagagacgatgcttcgtgctggttcgtctgcgccgatagttcgccctcgttgttgttctcgccgcagatacttcgcgcgggggggctgctatgatcaatattttcctccctcgctgtgtcctccgcccccccccctctctcttgttgctctaggtggtggtggtagaccgctttttccaacagccttgtgttgtttcctctgtggtgccgccgtagtgttgtttgtgttgaagcgaagcgggtgcgtgtagtagcaccggtgccgttgctgttaccgctctcctccgggagggcagaggaggatattattttttgtggccccccctcgtgttttttttcttttgtgggcgcccctgttttagatttttttttttttaaacacctttttttttggggccccccgcccccaatttttccccgggtttgtgggccccccca

SEQ ID NO: 622157 - DNA, 748 bp, Homo sapiens
attagatcgggtagggtggtgtgacagtccccattttgttgtgtgttatcttagtggtatatttatggacaggaaaagtgaaggcgcaactccattgtctgtccaccgactatgaagaattcagtcatgtatctacgagagtttctgcgcatttaagtgattagcaatcgtttgtgatatgccctgtgcctgctggctttgctaggaagactcattggagaccctgaacttggtatttgattgcgcatgccgtgtctctgcgtcgcctcatctcaggagagattgtgcatggtatcgcctaggctttggtcagtctatcagttatgtagtcatcgatcttagaggttgtctgcagacggaactgtctgctcgccggatgaggactgatgacgcgtgtgtagtaatgaagcttggagcctcagcgtcagaagtctagttttatacggtcagctgtcctgtgatcgtcagcggtgcacgcgtgtgtgccacctcattatctatctagctaagcggaacatgtgcttcatctgtgggatgctgaaggagatgagtgggcttcggagtgaatgtggcagtttaaaaatataacttcattcgtttggacctgcatatatagctgttttggaacgtcagttgattccggtgagtttcatatataagactgtctgcagtcacatcacaatattcagaggtgatatctgttgtaatgtcatcccattccttgatcctaggtcaataatactcagct

SEQ ID NO: 622158 - DNA, 165 bp, Homo sapiens
tggtgacctagaggatcccccgcggggctggcatggaccgggagataggctctgtgaaatacatggagtgctcagacctgacccagcggggcctgaagcacagtgtttgacgaggctgatcctgcgctggtgctctgacctgaccgccagatgacagaagcgcgg

SEQ ID NO: 622159 - DNA, 114 bp, Homo sapiens
tagtagacgacaggcacctgccacaggcccggataattcttctagtacctttagctagggatggggtttcaccatataggccatggctggtctcgtaactcctagaccttgatg

SEQ ID NO: 622160 - DNA, 105 bp, Homo sapiens
agggggccctccaccctcgtgaccaggttgtgggccccctggcgctacttcttatcgttagtattttttattaattctgaaaagttgctccatggatttgcaggt

SEQ ID NO: 622161 - DNA, 338 bp, Homo sapiens
  misc_feature (225)..(225): n is a, c, g, or t
ccatgaagagcgtttacggggtagctgcatactatgttgccacatgacataataatgcacagatttgtatatttccctgtaggcacttctgcaacaatttcattggtggttacttctgctccttgcccccctggattatttccgtccatggatgacatgcaataattgcggcagtttacttgcagatgtggatgtattcactgcatctgtttggtggagattgtnatgatcccatattatcctcaataccatatctcgagagaattcagggctcgatgaataccacgatcctgagttggagtaaagggttaccaatgtgttgttgacccttgacggta

SEQ ID NO: 622162 - DNA, 341 bp, Homo sapiens
  misc_feature (66)..(67): n is a, c, g, or t
  misc_feature (75)..(75): n is a, c, g, or t
agtgatgtgtcttccggtggcaatggacagggaaggagcacccatgtccactggaacgggagaaannccttcggnatctacagggttactgtttgcattttctacccacaagcagaaggagacagtgacaatgggcagtggatagccctcactcgtgagtgtttaatgttgcagcaaactcaccaagaaggagacaaatggctgtttcgaatggaagctttctcagcagacaatgtgtgcacagtaaacttcagcagagtccacttgttctcccggaagcttaatgtaattgaatggcagttatcactaaataaaattcttttctgagtctcaaaaaaaaa

SEQ ID NO: 622163 - DNA, 125 bp, Homo sapiens
tacgatgtagctcacttccactatgtcctatcaataggagctgtatttgccatcataggggaagtgaggatgagaacgaggaggcaaagcagacagaaagaaaaagagagagagaaagcgagacg

SEQ ID NO: 622164 - DNA, 330 bp, Homo sapiens
cctgggtactatctgtgatgagatgcagaggagaaactgtctcgctctttgtacagctggtgcatggccatggccaaggccgatggttcccacgcagctcacagctttgtcaggctgtgggggccactgtgttggcgggcgctgtccccggcgtagggagcaaagcgcctgccttcagatggtctcatcgagacacgccttggatatttttgggactcttctctgccagactacctctgtgacctcccacccttggagcacatgcgacccgtgtcgtcttctcttgcagaggtgctccgtcacaagagcagagcctgggagcctgccccc

SEQ ID NO: 622165 - DNA, 229 bp, Homo sapiens
agactaattattaatgtggtggcttcaagctttcttattgttctccagaaaattcagccacctttggtcccttcttaaacagactggaatgtttgcgcgatgcatatgacttcacactctgtagagcaaccatcctgacagtcatccacatctacttcaaggaatatcacgttggaatacttttcagagagggaatgaaagaaaggcttggtctacatgcaatcagggc

SEQ ID NO: 622166 - DNA, 528 bp, Homo sapiens
  misc_feature (282)..(282): n is a, c, g, or t
ggtcgaccttgggatcgcactggaaatacaggcgctgcaccgtcggcgaaccgtgctgatgagcacgaagccgcgatcatgctgggcatagatcagttcgtccgacgacggcggcgcttccaccagcacgccgaaccagccgaagggatagatgcgctggtaatcctggcgcttgctctccggaatggccggacgcgagacgccatggaagccgtcgcaaccggcaatgaaatccgcctccagcgtgtgctgctcgccctcgtgcatgaagcgcaccgcgancttgttggtctcgacgccttcgatggtggtgccgctgacaccgaacagcaattgcccttgcgcggccagacgcgcgccaccaggtccttgatcacttcgtgctgggcatagacggtgatggcccttgcggtcagctcggtgagatcgatgcgatggcggcggcaccgaaggccagctcgaagccgtgatgcaggcggcctcgcggtcagtcgaaggggcgcgattttaaagagtagtataatcgcc

SEQ ID NO: 622167 - DNA, 420 bp, Homo sapiens
taatttacctctatttccaccttgttttttagtagatttgtttcataaagaggccactctttgatcctggctctctctgccagcattgtgcgcactatgtaacatcttcgtggtagtcctgtcttcctaatacctttgagcctgtgctgtggaagatttcagatttgaccatgtagtgtacgtgctgttggggtgtgaactggtggcccgtatgtccctcctgcccttcgtgaagatattgggtcttggtagcctcttaaggaaaatttgcttccaagttttaagctggatagtcaactggaataactttgaaagagattttcaatacatggctttttagagtttcgttgagtatgttaatatttgtgtgcaaatttgaatgtctgtaatgatcctcgtccaattaaatttcagtttatt

SEQ ID NO: 622168 - DNA, 698 bp, Homo sapiens
cagtgatagtggtgaggaaaatattaggaagcttttctactaatgcttctacaacatgagaatatgcagtggagtgagtcccattgaccccgcacgaggtagatgcctccctgttggtgagcattgtttttcttaaactggtgtgaaaggctaaggagaaatttcttgtgggacaatgagtatgaagggacctgaagaagtccatcagctttacgctggatatctaaggaagtccagaatcctcaaagaatattgaaaccctaagttaacctggaattttgccactgcgaagaggtagctaacttagatctgttagaccccaaccattgggaaagtggaggaaatgagactgagacaggaagggagcacagggactctggagctgccctggggttgagtctgcagctgactcctcctcctctccctgctccctttgacttgtctctgagaaaccgtgctgggagacaaactagcaggccaggcaaactcaagcagctttttcaaaaagtagcctcagactcgtagatgtagagtagaatggtggttgccagagactggaaagcggatgaaggaaaggggagtgattgatcaaagggtacaaaatttcagttagatctgaagaataaactttagtgatctgttgtagagcggtgactataatacataatcatgcctggtattattcaaaatcactaaaa

SEQ ID NO: 622169 - DNA, 180 bp, Homo sapiens
ctctctgcgtcctggtgtctgaactacactgtgttaagcgctctgcgtactggtgtctgagtatgcactgtgtgaacgctctgcgtctggtgtctgatatgcaccgtgaagcgctctgcatgctgatgtctgatacgcaccatgatgcagatctctgcatccgggtgtctgatatgcaca

SEQ ID NO: 622170 - DNA, 481 bp, Homo sapiens
  misc_feature (8)..(8): n is a, c, g, or t
  misc_feature (27)..(27): n is a, c, g, or t
  misc_feature (166)..(166): n is a, c, g, or t
  misc_feature (201)..(201): n is a, c, g, or t
  misc_feature (212)..(212): n is a, c, g, or t
  misc_feature (289)..(289): n is a, c, g, or t
aacagacnaccaaggccacaataaggntatggctctgatctagaagacaccttccaggtgcctggcaaaccacttcctgtgccacacagacacattaggcctgtgtattattcccttcaagcagactgaggagggaggagacgaggttctctggctcactcctggntgcagaatagacaccttgagatttggctgggcccntgagactgaancagaaaaacagaagggatgtgcagggtgggggggtccacttcctgctcccatgtcaacccccagggcctccagcgtncagacgcgtgtcttactcatctgctcccacggatgaccctggtcttcaatggttagcagaagggagaaaagagagcggaaaatgtgctattgagattccagtggtgacttcactgatatttagtgaatatttgatttagccaacatgcctttctttatgtgagtattaaagtaaaatgatttttatactttc

SEQ ID NO: 622171 - DNA, 272 bp, Homo sapiens
aagcagttaatacatgactacaagccacagacttgtttccacaagcacgtcttaccttagccacgatagtccaagccacacgtactaaagggttgaactcaaaggttatgtacggggtattaaacaattaccagggggaccagtaactttcattacagggccaaattcagcaacaggttctacatctccagtgctgttttcagatacaagcttcagggccaattcctttccgagggctaatcccagttccgtgaggctagcttgagttgtgt

SEQ ID NO: 622172 - DNA, 617 bp, Homo sapiens
  misc_feature (8)..(8): n is a, c, g, or t
  misc_feature (55)..(55): n is a, c, g, or t
  misc_feature (133)..(133): n is a, c, g, or t
aatccccnagcacaatgcagggaatttaccttttaatcttggaggattcctacanatctataaagcatggagccatcctgtattgaaggggggtattataccccagggcttcagactcacaggaccgggattnctggagaacactgcgagctgtggagcacactttaagggatgggatggtcagaggcgctcccgagcaagcggggcatcattctcccttagatcctagtgtggctaagcagggatgtggcagagagatctgtgtggatctggcttcctgctgctggggcctggctgggcccaaagctccaagcctcactgccttcctggggtcctaattaactcggcctactcaatgagaacgtaacatgcttattgaatgtatagccgtgtttgctgagtaacctgtcccaccgttgaggctatctgaagtgtattgtatgaaggaagtatcaagaacaaatcattggcccgttatagcaaatagttgcttaagtagcagttgtcatagactaatcataaaatattttgcacaaaatttcaatgttgaacttgcacttactgttgttatagtaaattataaatcacagcttctagctaggccaaaatacttactc

SEQ ID NO: 622173 - DNA, 348 bp, Homo sapiens
  misc_feature (85)..(85): n is a, c, g, or t
  misc_feature (117)..(117): n is a, c, g, or t
  misc_feature (119)..(119): n is a, c, g, or t
ggctcctcggtgtgtcaagtgactgccatcggtgtcaccgtgatctggctttacacctctcgggcctgcaacaacctgttcatcntgtcatttctcagacaagagggtccatctttngntatccacccactcacaacaccaccctgtctaagggtgtcacctgaccagggactcttggtatcctcgaggcattggttccaggaccccagaaaataccaaaatctggatgctcaagtccctgatataaaatggtgtagtatctgcatataacctacacgcatccttctgtatactttaaattaatctctagatgatttacaataccaaatacaacacaaatgctatgta

SEQ ID NO: 622174 - DNA, 215 bp, Homo sapiens
  misc_feature (168)..(168): n is a, c, g, or t
aaaaatacaactcagatttcactatgtacagcaataaatatcagagacattagggaataataataggtcaaagcagaaattcattcctcagcatgttcttcaagtggaagaattaggtctgttttagttctgttgattctaaaagaaacattcaggctatcaagaaancctgttttaaactctaaatctgacactatagatagatagatagatag

SEQ ID NO: 622175 - DNA, 412 bp, Homo sapiens
  misc_feature (21)..(21): n is a, c, g, or t
  misc_feature (25)..(29): n is a, c, g, or t
  misc_feature (33)..(33): n is a, c, g, or t
  misc_feature (37)..(37): n is a, c, g, or t
  misc_feature (39)..(41): n is a, c, g, or t
  misc_feature (94)..(94): n is a, c, g, or t
cttttatttttttttctgagncatnnnnnaccnctcncnnntaaaaatacaaaacatgtagccacgtgcagtggctcatgcctgtaatcccagntgggaggctaagatgggagaatagcttgaacacaggaggcagaggttgctgtgagctgaaatggtgcccagaagacagagcgaccctgtctcaaaaaaataaaaaataaaaaataaatttcatataatcttcagatatattcattcatttacatattgtctgtggttgttttcaccctttaggtcagaagtagccgacaacctttacacagtatttaccactgttatagacatctttaaatatggtttacttttgcctgtttttgtactttatagaaatgaagtaataaagtattgtctgtcttgcattttttgctca

SEQ ID NO: 622176 - DNA, 172 bp, Homo sapiens
  misc_feature (159)..(159): n is a, c, g, or t
ccggggttatttgccattcgctggggctttatccctcttgtgatttacccgggatgtattaggggtgcagatcccggaaagcctgaaccaactgttttgagcctacttcggggataaatggattatcttggtcttcttggatttaggaggcaatcagcnggacagcttggaa

SEQ ID NO: 622177 - DNA, 448 bp, Homo sapiens
tgcctggcgtctgggctggagaggctgcgggaggtaggagctgggccaaaagatgtaagcacatttgcatttattaggcactttatttccattattacactgtgatatataataaaataattatagaactcaccataatgtagaatcagtgggcgtgtaaagcttgttttcctgcgactggatgttcccacctgagcgtgatgggagaaagtgacagatcaataggtattagactctcataaggacagcgcaacctagatccctcacatgcacggttcacaacagggtgcgttctcctatgagaatctaacgctgctgctcatctgagaaggtggagctcaggtgggaatgtgagcaaaggggagtggctgtaaatacagacgaagcttccctcactccctcactcgacaccgctcacctcctgctgtgtggcctctaggggcacccg

SEQ ID NO: 622178 - DNA, 103 bp, Homo sapiens
cgactagcctagtgcagcatagcaatgataccatccctccaaaaataaataaatataatgttagctggcggcatggtggtacacatctgtatgtgtggtacct

SEQ ID NO: 622179 - DNA, 185 bp, Homo sapiens
ggaggagaggtggcgcgtcctcgccctccagcaggcggcggaaggtggcgatctcctgctccaggcgcgtcttcacatccagcaggatcttgtactcctggtactgctgctccatctcgcagcgaagctaggccagttgctcctccaggctgccaatcatctcctgggattgggctatcaagggg

SEQ ID NO: 622180 - DNA, 451 bp, Homo sapiens
tcggtagcccaacttatgcggggggacagtagcaggctctgagctggcattagagaccaagggagactgccctgatagagacccttcagtgagcctgtgctgcataccatccctggtctccaataatgttcatcacgcctccttgtcgatacagtggagaaccataaaggctgaagtctgcaggagccctgggatcattcagtggctctgctcccatggtcacgtgtctctcggttgccatggtcatgttgctggcagctgcccaggacatctgtccatggagttggacagggatctttcctgccctggatggtgattacttgacatgaagatgtggagggaggggatgcgcctttcagatttaagcaaacaggtagtcctgagttgttgctgtttgtgaataacacaagtctctttttctccacataaacgaaatcctcatgttactcca

SEQ ID NO: 622181 - DNA, 284 bp, Homo sapiens
gtctggctgttctagaggatcccgacgaggaaggcaatggagtcaggctcaaaggcaggctctgagcttcacccgagtccttcgtgaaaacgcagccttcccacatggttactctgccctcacctgtggcccaggccactgcctgcgtttcccccagacccagacctgacaggcagatctctctcccgtgactgaggccggatggttgagccgggggcggaattctggacagcccgtgttgaccgtggtgcattcccctgctcacgcctcctcatagaaggtga

SEQ ID NO: 622182 - DNA, 117 bp, Homo sapiens
tctagaggatcctgcttgtctgctctgcatgtttaggcgtacacacgcccacaacggcaccccataaggcataggcaagaccatacccgcgaatgtaggacaagcagtgtatgcagt

SEQ ID NO: 622183 - DNA, 119 bp, Homo sapiens
gggtcgtttagcctactacaagcgtgcttaaggaaggcagatgaggggttagcatcgctgatgtgaggacggaagatcacccatctctcatccgccagagtggtcctatgatatctgga

SEQ ID NO: 622184 - DNA, 278 bp, Homo sapiens
ctcccaggttcatgccattctccgtgcctcagcctccgtgagtagctgggactacaggcacccaccaccatgccgggctaatttttggtatttttagtagagacggggtttcaccgtgtgggccaggatggtcttgatctccgtgacctggtgatccgctcgcctgggcctcccaaagagctgggattacagggtgtgagccaccgcgcccggcaagtttttggtttggtgcaatctttagagtttccctttctttccagtttttttttttttttttt

SEQ ID NO: 622185 - DNA, 281 bp, Homo sapiens
gtatagtcatttatactctctacatttaatttactaaatagtaaatattattaaatgagacatagctatcctgtggcacaggtttcaattgaagcagtagttcaagccagggaatagatcacctcagctcccagcaattactcatcgttgttccgtgtgtaaaattcaagaactgttctgtgtatataagaatatctgtatgtgttctcctgtattttgttgtttttctcacccgtaaggtcttcctatatatacattagttcatttttttttatttttta

SEQ ID NO: 622186 - DNA, 1684 bp, Homo sapiens
tgtggaagtattacccaaaaatgggtttttggggaattccccggggaagctgtgtaaaaaaccccactgtgtggcaacccaaagaacccgggtgtgtgtgcacctcataaactccaggcgggtgatcaaagacgtcgccgtgttcctcttctttctcccaccaccacacctgtggtggctctcgggagcaccctgtgcgagagagagaggcgccttgtggtgtggaaacgtgtggtgttaataacccacacgagaggtgagagaaaaagttgagtgggcactgcgtggtgctcttctattgtgttccacctctctcccacaatatatctctcacgtgtgtcgtcatcaaaaaaacaatatcagcagagagataatatgtcggcgcacaaagtgtatacccccctctcacaataataaaaacacgccggcgcgcgctgggagtgtgttgtagagtgtgtcgcccccataaggagagagaagagaaacgccgcgagagagagtgtcgtctcccctcagaagagagcgctctctgtggggagacaaaaaacagcgcgagagagaacacaccgaagacacacgcagagcagagagagggccccgcacagaagtccccgcgatggagcgccgcgcgaagtgtgtcccacgagtagagagcacactctcccgcgctgtggagagaaagacaccccccgcagaagctctccccgcgcgcggcgggtgtgtcaccccctcagcagaatgcagagtgcttctcccacgaaagagtgcgcgagagacaaaacaagaggtggtgggcgaagaagaccgccacaaaatcctcgaagaggggagagacgcaccgacgaggggagtgtccatactatagtatgtgtgcggaccctactgtatatgatgatgtgtgacccccacgagggggggacaccctgtgtgaaaaaaaacgcgcccccaaaaagaaaggcttgtttagtttcgcctttctatatttagaaacctcttttctttcgtgggaggaaaaccaactcgtggtgtgcacaggagatttttgggagagccacccaaagaatattagttgtgtggtatctcctcccctctatgaaagaggcacctataacacaagaagactttattagtggagacgaccgaaaaatcactgtcggagagagcccgctgattagaacaacaatctcccccaatattagaatgaggcgcccccacatcattaattgtgtcgcccccacaccacgtgttggttgcgaccacaatttgggcggtgttgtgggtttcgcccccccaacaaaaggggtggcggagaatggtgcgaaaacaatatgagaagagacaaccactactggagtgagggaggggacctaattatgacacagggcacaaaaagggaggcgaccactccagcaggaaggatgatggagcatacccatgagacacacattaagtttcaataaaaaatagcagagagaagcgggcgaccgcgtcatcactaagagatagtaataaccccccccgaagaagggggcgccccagcaagatattataggtgcctaacacccgagcggtttcctgctgtacaacgaaggggggggcccccccataataatgggacgcgcagataatattaaaagcagcaggaacggaggggcgcgcggtatataaaacagccgtggtagtg

SEQ ID NO: 622187 - DNA, 573 bp, Homo sapiens
  misc_feature (185)..(185): n is a, c, g, or t
gcgaactagaggacctcttcgacggtgtctgagtcatatattatcatggaatgcaattaaaacctattagaacgtctaaatccacaacactgacacacccaatactggactggaaagttcctgtggaacaaccaggactttcattcactggtagtgggaatcccaaatgatacaggcacttttgnacgagagtttggtgatttcttacaaaactaaacatattattactctatgatccagcaatcacactccatggtatatacctataggagctgaaaacttatgtccccataaaaaactaaacacagatgattatgtaagctttattcataattggcaaaacttggaagcaaccaagacattcttcagttgatatatgaatttttaaaactgtagcacattcagacaacaaaatattactcagggctaaaaagatgtgagccatcacgttatcaaaatacatgggaggaaatttcagtgcgcattattcaataccaagtcaatgcgaaaaggctacattctttatgattcccactggggggctccttggatatattagcggggccattccat

SEQ ID NO: 622188 - DNA, 100 bp, Homo sapiens
  misc_feature (82)..(82): n is a, c, g, or t
ggcgcgttcaggactaccgcaagaagttgcgttgatcacaaggagattcgaccggccagcgttaaggagttaaggagagcanattaaaagagacttacca

SEQ ID NO: 622189 - DNA, 558 bp, Homo sapiens
gactggtgagaatatttaccagatatttcaaacattaggcgaaaaagtaccatgtcttgaacaaaatacacgacaaagctctactcatgatcgcacaattaccgataatcaacgaatcgatctcgaatcaacgactgtagaaagtactagggagactggaggttgtaactgctaaactgcaagcaaaacaacaggaaacgcggcatattcagcgtcttagcaaagcttgccattgaaaagaacagttcgtaacaacagctggaagaatagtactggaaattttcaattacttttgcaaaacaagcacttttttgtttcacttccattagccgcaagaaatacactttttttaggggcgggaattttcatcgccagatcgagaatcacaaggcctttacgtactatagtttgtaatttatacaaaatcagctactgttattttggtgtaccagcggcaaaaattggtgaggatctgaaaattaattagaagtgaacacatatcagtaattttgactatggacgagaatgaatttgataatcaaagggagaataaagctg

SEQ ID NO: 622190 - DNA, 430 bp, Homo sapiens
tgtgtgcggaattttaccgcaagctgttttatgtgtgacctgcgaagggagactgtacggcgtgctataagaaaacggtagactaaccatacatgggggaaatcgccagttccgataaggccaagctgaataaaacggcgacgctggagaagaacacccttgtcgccaaagagaccatcgagcaggagaagcgcctgaaattccaagatcctggaggatttcctacccccgtcctcttctagaccccagtcgtaatgtgggggaagagccacctgcaagatggacacgagcgacaagctgcactgtgaacctgggcacttctgcgcctatgccaccggcctgtggggctttgaagggatccctccccaatcggactgccaaaattctcggtttgccccgggatattatagactatcagtctgaacttgtc

SEQ ID NO: 622191 - DNA, 624 bp, Homo sapiens
  misc_feature (585)..(585): n is a, c, g, or t
tgattttctgagcacacttgattcctagaaataaagagttctgttaaatagagtgaaccccaagtttctcttcaaagaatcagtatgtcagtctgttcagcttcctgttctttgattctccattttaaagtttaacttcctggttctcttcacccccttgcctctagtttcagtaaacaactttcccgccagtcctaatcactagttcacatctgttcccctggtcacctgctccatcctgactcatctcggtcacctgctttgaccggagtcacctttagttacctcttcctaaccgtccttcccaccaaactgctcaccccgccactctggctcgtactcctgctctttttaaaatagccagtcggaattagcttagactgtgtggtccaaccctagccaataagggaacgacacagcagtagggactacctgcctcagggataagacctcctgtccctcccgtgtccaggtatgctcttgccatggctccacctgcgagggtcaccctttatgcaaaaagtcaaaactgccttgctgagaacattaaatggatgctcgagtgctatttctctgtggcactgnggaacaagcattttgcatttctaacagtccaggcaccag

SEQ ID NO: 622192 - DNA, 774 bp, Homo sapiens
  misc_feature (687)..(687): n is a, c, g, or t
  misc_feature (690)..(690): n is a, c, g, or t
  misc_feature (693)..(693): n is a, c, g, or t
  misc_feature (705)..(705): n is a, c, g, or t
ggaacaccttgaggggcaggcagggggtgatgaccccactctacagatgggagcaccgaggtgcccaaggcaggggtgaggaccccactctacagatgggagcagtgaggtccccaaggtgggggtgatgaccatattctccagatgggagcaccgaggtctctgaggcagggggtgatgaccccactctacagatgggtgcattgaggtccctcaggcaagagtgatgaccccactctacagatgggagcaccgaggtgcccgaggcagggggcgaggaccccactctacagatgggagcaccgaggttcccaaggcagggggtgaggaccccactctacagaatgggagcagtgaggtccccaaggtgggggtgatgaccatattctccaggatgggagcaccgaggtctctgaggcagggaggtgatgaccccactctacagatgggtgcattgaggtccctcaggcaagagtgatgaccgccactctacagatgggagcaccgaggtgcccgaggcagggggcgaggaccccactctacagatggaagcactgaggtccccgaggtgggggtgatgaccgtattctccagatgggagcactgaggtcttttgaggcagggaggtgaggaccccactctaccagatggtttgccttgaggtccctcaaggcagagtgatgaccnccnctntacagatgggancaccgggggtgccctaggagggggacgaagagacccacaaggtgctggagcattgtgatgacccatcaa

SEQ ID NO: 622193 - DNA, 117 bp, Homo sapiens
cgtaccgtcgcgaggagggtcgactggttgggtgtgtgtccgaagcggcctcttcgtgcgtcgagaggaggtcctgggaactttcctgccgggcaggtaccttacgtgatacccgga

SEQ ID NO: 622194 - DNA, 131 bp, Homo sapiens
aagctcccaacaagagcacaactccttcttaaaaaaaaaaaggttggtcaattttctagaattacagattcccaaatttagggtgttaggtacacacttttagaattttaatgtaatcttgtggggagctt

SEQ ID NO: 622195 - DNA, 923 bp, Homo sapiens
  misc_feature (264)..(264): n is a, c, g, or t
  misc_feature (614)..(614): n is a, c, g, or t
  misc_feature (807)..(807): n is a, c, g, or t
  misc_feature (820)..(820): n is a, c, g, or t
gcaggccagcctcggagccagcagggagctgggagctgggggaaacgacgccaggaaagctatcgcgccagagagggcgacggggtgctcgtgtgaagcctgacagggcttttgctgcacagctgcctggctggctgctaccctgcccgctgccatgcccccgatgaactgcgctgaccagtgcacccatgtcctggtcacctgcatgctggagatgctctgcctgctctgctgcagctgaggccctggagctggccccgcagnggaccctccccatgacctgcctggtgcctgccctggatgtgcactaaaatggaacatgcccttctaccacgactgactcatacacagctacgggatactggccggggcccctggtggcctctctctacactgactacaaactcctgaaaccgagcctggcggtcaacctggcctgacccctacctggagtctcaaagctgcctggtgtgctcgcggaccctggcccagagggctggctggtggcggcagctacttttctggtcagggctcggacacctggcgcgtctctcaagctcgcctcttcggagctggaacgcctgattgtccccaacagcaacggcgtgatcacngacgacgcctacacccccgggacagtacttttacccccgcgggggtggcagcggtggaggtgcagggggcgcatggggcggcaatcaccgaggtagcaggagggcttcgccgacgggtatggtcaaggcctggacgatctgcacaagatgaaaccacgtgacaccacccaacgtgtcctgggcgctaccgggnggccccgtgtggncccgtggccgttaagcgggccggagccactccgtttaaccacctcagcagtatcccagctttgtcccggagccccgggttgcgtgactggacccgacgagcag

SEQ ID NO: 622196 - DNA, 281 bp, Homo sapiens
  misc_feature (236)..(236): n is a, c, g, or t
  misc_feature (265)..(265): n is a, c, g, or t
  misc_feature (268)..(268): n is a, c, g, or t
aaagtcagggggccggtgaaggtcctggacagcaggaggctctactcctgcaaatgggtacagtttcaggacaacttagcctccaggacgcactgctgctgcttttggtcagcttcctcacctttgacctgctccataggcccgcaggtcacactttgccagctcctgtggcatgcccttgaccctgcttggcctggctttttgcctccatccttgggcctgagagcccctccccncaactcagtgtccttcaaatatacaatgnccnccctttttcatca

SEQ ID NO: 622197 - DNA, 467 bp, Homo sapiens
tcagacaggcaatagaagagaacaagcaacttcagtacaatgggcagaagagaaactggacccacgagtgggacgctcataaagagaaccgagaggcacgactggctgccaaacgggaaggttggcgagagaaggatcagcacatggaagacagtgcggaagaccaacgaatccaaagacccggctgacgagactgaagctgactagttggttcggagaacggactttctccccatccccttcctaaatatccaaagacggtacgggccagggtcatacaatttaatccctcctgacacttatcttagaagctaatgtaggactgtataggtagatccagatccagacggtaagatgtcgtctacggggctaagggggagaaactgaaagtgtttcactcttttactaaagggtgggtctttctaatgtagctatttttctggtggcatcttttctacttcagtaca

SEQ ID NO: 622198 - DNA, 224 bp, Homo sapiens
atcttctattgctctctccctttctcttctcttccccctttgtctgtctcacattcatctcaaaaaaaaaataaattaattattaattaattaataaagcatgatttaaaaaaaatctaccatacaggagggtgaccagttcatcccacatcccccagcctcgggtccttctcggcagaggcagccacctctgtgcaactgcaagcttatcgccagtagtgggt

SEQ ID NO: 622199 - DNA, 480 bp, Homo sapiens
aacaacggacagcagtagatcacatactggtaggaacaagccaattactatgacaggatgtccatgtgctgggactctcctagactaacaggatacacataaaaactgatgtatcgagcaataattcaagtagaggttgtacttggtcctcaagtataggctatcctttaccgggtggaatgatcacttgtaccaccaactctaacaatggctccagctcatccttaacctctgtcaacttgactttcaggtcttctatcagctccaagagttctgatgattcctttcgcaacatattcagcttctctttcactgaaaatttagccaaatccttcacgacccgtgtctcagcctcatctacctgaggcactggtttagcaaaggcctcaacccaggcgacaccaaaatcatcctcttgcagcgctatgggctaggcgccgctgaatgatctgtgcctcctcctcctcctctctttcctcc

SEQ ID NO: 622200 - DNA, 978 bp, Homo sapiens
gcgactaatcaccagccaatgaatgactaatctggttgttgatgagatatttggcaggtggggactcagttgaggcggtacgtgtcccgtcctgaggtctcatagctattcgtctcctcttctaatcaggccctagctgatggcctggggacctctcgaccctgagacctgcttcgagtaagagcattggcaccgggactaaagccgaggcctccttagtcttgctccttgagtagttggtctctcatgctcgctcattggctcagagcgaggagtgccgcccggttggaggactcctgtacctgtcccctgcgttctggttaccagtcaccaggcccctgtagtgcgtagtctactgtatggtctgtgtggcacatgcgggtgtcctccccgcgggcccgggcagggccgggtgtactccttgcgtttcacggactttgtaagggctatctggaaaaccttccctgtggccggagcttggtattacctttgaaaaggcagcgcaccccggtttcaaacgacctcgtagaggtacactctccttagcctttgggtgtaaatgcattgtgagaaaaacccccttggtgcgaccgaactgaaggtcgactcttcggaccgcgaaaatttcgtgggcctcgggtaaacggttctgtgccataccccctggctaaggtggaattccccttgaaaaggaaacttgccttgtggcgtcccatgactatgctgttggccctggtcttgggcagccagaaggtgtgtgcacataaattcccaaagcgatttgaacgcctctaaccatatatagacagctgtggccccactctgtgcaacccacttgtgtcttgagatgcccttaggctctgactttagttccttaacacaaagttcgcgttgagtaaacgccctctatatttccccaaggcatatatcctcctaggccctctacccttccaagggtaaaccgcctttgtaaccctg

SEQ ID NO: 622201 - DNA, 1018 bp, Homo sapiens
gggctagtcgtagctgcggttgcggccggtcgtgtggccgtgcaggatgcgacggtccagatggtcatgctccagttcatcacgcagcgggctgtccaaggtggctgtgccatccaccatccagtgtgaccatctgattgaagcccagtgttgtcgggcgagaaagagctgcgccgggccaaggacatcaagcaggaagttggataacttgtcgctgtgcagactagcaggtgccatagtactggtcgtggtgcttctgtggaaggcctgtggatctggaatcattcaccaggattattctggaaatactatgcgtaccctggtgttgcttctgattggcatctgagctcccaaacccccaatggtggtgtggccttgggtggcatctgcattggagttgggggtgccgatgctgtggatggtcatgggggggatccgcgtgatacttggaacgtggtcgccatggtgacttcgacgtgacagacgttgactggggcttgcttcgtcatcgcgagtgaggtgcctcttcgccatagagaatggtgattctctggacaggtggccaggtattagctctacggttgaaacaggtgtctacaaaggtgtcacattcgttgggacatacccatcggggcctggtgctaagacgtacgaattttccttgccttgggtatttggctgagacatcatgcaacgagtggtgtgcatggacatgtgtgtgccagctagttccagtgtgacgcttacaaaccagcatggatcgacagaatgtagctgagcaaacaccggacgggaagacatttgccgatcctagatgatgacattcgagggctcattggtggcttgaccttggttgccatcgttggaccaatcaagtgagactttacctacttgaagctcacagcgtaattattgcgtccttaacgcctgaattggtaaccttgggacaattggcagcgtgacaacacggacggtggcttggacatcggcgggctataggaggccatgacgtcgcatt

SEQ ID NO: 622202 - DNA, 136 bp, Homo sapiens
ctttttaaggccccggacgggccccaagtgggtggcggcctcgttcccatggcggcacctccctgggggtttttaaagtttgccgctcaacagggctggcacttttttaaaaataaaaaatgggggttatttttta

SEQ ID NO: 622203 - DNA, 703 bp, Homo sapiens
  misc_feature (395)..(395): n is a, c, g, or t
agcggggagggaggctggagagaccaggatccttccagctgaacaaagtcaggcacaaagcagactactccacgccgggtacaattggagtcagagtcccaaacgacagtggtgcttgttagagtgctgtgcacagatgtctggtacgggaccccctttgcttccctggtggccactgagagttgtgttctcgtttggggtggcatcgtgttctgtggctgtggagcatgaaagccctcaactggcgagcagtaaatagctaagttgaggacctatttctccaagagaactacgcaagactagtgagtacctcgtcagtcaatgtgatccatgccgttccacgtaatgtctatctactggaagcggtcgtctatattcttctcttcctctatatngtgaggaccactcactgactagtgcttgacgggcttgcgtactagcgaccggacgacagtcaggcagatcttaggcgactacaagaccagcatctgcggcaagggcctgagcgcgatggtagacagggggccagacaggcgaggggttccagaggccaagcatcaacgctcagtatcgtttggagcgggtgtgtcatagttgtgggaaaatggctaggacatcctcgaccgagttaagtagggcatcaactatgtccctagaacgtgtgtgtggctcctggtgttagcctgctcgtgctgtgcatgtg

SEQ ID NO: 622204 - DNA, 148 bp, Homo sapiens
ctgtatgtacagccatttaggtacagccatataggtaacagccatttaggtaacagccatttaggtaacagcaatttaggtacagccatttaggtaacagccattaaggtaacagcaatttaggtacagccatttaggtaacagccat

SEQ ID NO: 622205 - DNA, 414 bp, Homo sapiens
  misc_feature (50)..(50): n is a, c, g, or t
acaccacttgtattgacagccgcagtcactctgcttgcatagagagaagnaccatcacttcgcattacagtacaaattgatgagtggtcgccattcgcagagagatctactacagccgttccttttattgttctcagtaggagtcctttactctccagcaactttaagacctcttgagatttttcacgataaaatgattctcctgaatattcatcaaaatatactcccagacgcttgtaaacccgaatgtactcttcaatgctcaagtcccgaaatttttgccacagtgaaagtgcttgcacatcgcccagttccaatcgttggaagaactcctgtgctgcttttgctacacttttatcatctgctgcttctttattaacttgtacatgaacctggaatggggaggagatgggg

SEQ ID NO: 622206 - DNA, 276 bp, Homo sapiens
cgccgctctagagatccccctcataatgtgtgcccaccagagtggaacatcagttacaattgatgaacctgccttgaaacatttttatcacagagtcgatagtttccattagggttcactcttggtgttgtacattccgtgcatctgaacaaatgtttaatgacatgtgcccaccattacagttgtacagagtagtttcaccaccttaagaatctattattggccaggcaggatggcacatgcctgtaatcccagcactttggaaggctaaggtgg

SEQ ID NO: 622207 - DNA, 117 bp, Homo sapiens
gtatagccacctgtttttgatgccacttcgtgccccgcttaggaaggtccgtctgttcatctcctggctcttttcccacatggtaccgtgcactggtgcttgtagagagcgcctgag

SEQ ID NO: 622208 - DNA, 740 bp, Homo sapiens
  misc_feature (311)..(311): n is a, c, g, or t
  misc_feature (330)..(330): n is a, c, g, or t
  misc_feature (338)..(338): n is a, c, g, or t
  misc_feature (367)..(367): n is a, c, g, or t
  misc_feature (370)..(370): n is a, c, g, or t
  misc_feature (374)..(374): n is a, c, g, or t
  misc_feature (379)..(379): n is a, c, g, or t
  misc_feature (386)..(387): n is a, c, g, or t
  misc_feature (396)..(396): n is a, c, g, or t
  misc_feature (400)..(400): n is a, c, g, or t
  misc_feature (406)..(407): n is a, c, g, or t
  misc_feature (410)..(410): n is a, c, g, or t
  misc_feature (413)..(413): n is a, c, g, or t
  misc_feature (415)..(415): n is a, c, g, or t
  misc_feature (422)..(422): n is a, c, g, or t
  misc_feature (424)..(424): n is a, c, g, or t
  misc_feature (431)..(431): n is a, c, g, or t
  misc_feature (433)..(433): n is a, c, g, or t
  misc_feature (436)..(436): n is a, c, g, or t
  misc_feature (444)..(444): n is a, c, g, or t
  misc_feature (451)..(451): n is a, c, g, or t
  misc_feature (460)..(461): n is a, c, g, or t
  misc_feature (467)..(468): n is a, c, g, or t
  misc_feature (473)..(473): n is a, c, g, or t
  misc_feature (475)..(475): n is a, c, g, or t
gcgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccaggcgctttttcggcgtctacctgctctactgcctgaacccccggtaccggggccgcgtctacgtggggttcactgtcaacactgctcgtcgggtccagcagcacaatgggggccgcaaaaaagngcggggcctggcggaccancgggcganggccctgtggagatggtgctctgtcgttncangggnttccntgtctcnngtgtgcgcncttngtggtnngangtngngcttggnangcacccngnacntcctcgcngcctgcntggcgcatnntggggnnctcgncntgcgaggagagacagccttcgctttccacctgcgcgtgctttggctgcacaattgcttgcggctgcagccggagccttggtgactcgcacgtcccgcattcacagcattgcagccttgggtgtgctgcccatgaacctccgggacagggaacctccatgaccttccacgaactggcctggacagaatggttgccatcttgggccatctccggggccactcccaagcggacacccaaagtgaccccgggccaccaaagggtggacg

SEQ ID NO: 622209 - DNA, 506 bp, Homo sapiens
cgggcatttaatccttcccgttctctatccacaattatcaattgcgattctagtaagctgccggcggcgctcgatcccgatgagtacgtcctagctcgttggtgctgaccgccgcactacatggtcgacagtctcgccaacgggcacgtctattcgttctgcttcagcccgccttggaattcgatcgcggttgatctctgcttctgccacatcctgcacttcgtctccgacatcctgctcaccgcggtggacgaacgtgctcgcgtgtgcgccagagctggtccgacaagcatccagatctctgtggcggtactgccccgcgcgcatctgcgcgccgccgagttcatcgagcaaccggagaaccggcccgaggtcgcgcgcattcttagctcacccgagcggctcggcgtcgacgccagcgtcatccagcgcacgctcgatggttgtttgaagatctcgccggacggcaccatacgcgagagcaatcgctatttgctggtggggcg

SEQ ID NO: 622210 - DNA, 117 bp, Homo sapiens
atctattatccaatggttcttttttctccggagtagtagttcacaatatgggagattattcagaagcctggtaggataagaatattaacttcagggctgaccgaacaatcagaatag

SEQ ID NO: 622211 - DNA, 837 bp, Homo sapiens
  misc_feature (62)..(62): n is a, c, g, or t
  misc_feature (123)..(123): n is a, c, g, or t
  misc_feature (182)..(182): n is a, c, g, or t
  misc_feature (307)..(307): n is a, c, g, or t
cggcttttgggtctgttacccaagagaatgataacgtagggtttatatcaagaagtcgatcnaaaagaaagccccagcgctctagagctcagctgacgggaaagggggtgcgcagcctcgagnttgagagctacccggagctccaagacaggggggggttccagctgcccgcacgccccgancttccatcgtaggccggaccatgggaaccccaaagccacggatcctgccctggctggtgtcgcagctggacctggggcaactggagggcgtggcctgggtgaacaagagccgcacgcgcttccgnatcccttggaagcacggcctacggcaggatgcacagcaggaggatttcggaatcttccaggcctgggccgaggccactggtgcatatgttcccgggagggataagccaagaccgtgccaaacctggaagaggaattttcctgctctggcctcaatcgcagagaagggtcgcgtttagcagaggaccggagcaaggaccctgctaggatccacgagtaatacatctacgagattagtgaacgtcaggagcttggggacgttttcccagtcagacacctctccggacaccaatgggtggaggcagtacttctgatacccaggaagacagttcgtggatgagttactgggtaacatggtgttgggcccagtcccagatccgggacctccaagcctgtgctgtatcccctgagtcctgcctcttaggctcatgcggagactgcgggctctggagcaatctcactcccttcctaatagctgggagcctcttgtgaaacgagtgaagggggtgttggttgccgtgggaatagtggg

SEQ ID NO: 622212 - DNA, 325 bp, Homo sapiens
taacagcgtgagatggagacagttccttatgggaagaaaagttgcaaggaggagacctgctcccctctgattgctggcagtgaactggactgtttctggcgtggtttctgttgagttgacatcattgaaagctacccatgtgcccatcggtctggcgtagcatcgcagatgtagggactctgaaggctgatgaaataaacccatccttgtcaactggggaaaggcactcagcaatccaggacaagacggcatggtgcggatcctgcaggaggttcccgcatccttttttggctgggttacttttggggacaggagggctgtttgg

SEQ ID NO: 622213 - DNA, 280 bp, Homo sapiens
  misc_feature (35)..(35): n is a, c, g, or t
tgcaagcgtagtacccaaacctctactgctcactntcctgccatgcatgcacgccccccatttaaaagcctctgctttctgctccaaaggtgaagcagttacccttaaggaaagaagcctgtacttcttcccctaaggtagctttggaataaaagtcactttataccaaacctagctcttgttaattagactctgcaagtgatgagcaactgaacctacatttcagttataattcctatgcttgctcttcctgccctgccttgggtactacgctttggca

SEQ ID NO: 622214 - DNA, 1009 bp, Homo sapiens
  misc_feature (409)..(409): n is a, c, g, or t
agcgggagtccggcgtgcaaggagcggaagaaacgcggctggtaccccggcatgcacctcgcatggcaacttccggggatggtgcttgtgtgcgctggatgctgggagcgtagctggggcccagggcattgctgattaaagacgtaagtgccttctcaccaagcatgtacccgatggtctccagcgaccggattattgaccagccacgaattaaccatctctctttccagcccgaggggtcgtgcgtctaccatagatagatatatgactgtctcaatggctagttgaccgcatgggtggcgcttgacttgtcatgtaggtctgtcgatagggtaatcgactgtgcatgtacgattgtcgacactagaaggaaacgtagcgctgatcaagacttagttgggatttccangcactacgctgactcaacgttattttcaactactcacctgaaaacgattctggtcttgtagttgattgacctggaattgacaagctgccacgctagattcccatggtaacagcatggtgcgtcgcttatcgatggctacgtctgatctgggtaaattacaaggtgattggctgatagacgattccctagttgagacagttgctcgtgttacagacattgccgcatattctctcgaggtctaacacatcatgaaatgctgagaatgacggcctcttgggttgttgtactgatctcataagtgtggtcactagactgcacgagcaagggccctcagtgtatactagagctgtgatcctagcaggtctactactagtggcgtttaacaggcccactgcaggcgggacgttccaagcaaagctggagtcaagccagactttcctttgtaacaacacacacacgttgacacgcaagacactttcggatttggcaccattttgcaaccacgaaccagttggaaaaactggcacatttaacattgccctggttctaactggtgtctattcaatctgcattttccgagacctttccacgaacttagaa

SEQ ID NO: 622215 - DNA, 264 bp, Homo sapiens
ttcctcacacgcctgcgcaggatcactctatatctcttactgctccactccttctttaagggaaagtccggcacgggtactgatggctgcacccagctcgtggtcgctgcagcctggttccaagcccatattagtcctaaacaaagttcagcaattcctacttacacagtccccttataaccaccctatttatcacaagacagactttttgggtaggccagcctgacgccgctcagggacactaagcaacaacaaagctcatct

SEQ ID NO: 622216 - DNA, 104 bp, Homo sapiens
ctggcaacatgcaatctcccctcatgccccaggtttccttctcttctgtcccctgggccctgccgacatctgactattgcatgggaacgtgttttgtgtgcaca

SEQ ID NO: 622217 - DNA, 159 bp, Homo sapiens
acattggcgaacggcgatctgtgtgtgtgctgggtgtgagctgtgtgtgctgggtgtgatctgtgtgtggtgggtgtgatctgtgcgtgtgctgggtgtgatgtgtgtgtgctgggtgtgagctgtgtgtggtgggtgtgatcagtccgttcgcatgtt

SEQ ID NO: 622218 - DNA, 384 bp, Homo sapiens
gtcgaccgcttcgacaacgacggcgctgcaggtcatgatgtttggcatgcaccgccactcgccctggagctgtctgacatgcactggtgccagcccctactgtccaggacacctccggtaccagtccagcccatgacgcagcccgcactggattcctggacaccctgaaggtcctagtggagcacggggctgatgtcaacgtgcctgattgcaccggggcacttccaatccatctggcagttcaagagggtcacactgctgtggtcagctttctggcagctgaatccgatctccatcgcagggacgccaggggtctcacacccttggagctggcactgcagagaggggctcaggacctcgtggacatcctgcagggccacattg

SEQ ID NO: 622219 - DNA, 110 bp, Homo sapiens
tgacaggcgtatgtccataccgctagaagttcaaggaggcttccagtctgtctgaccgaacaggtgatggcaagatcctgtacagccagtgtggacactcggcgtgtgca

SEQ ID NO: 622220 - DNA, 2796 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacatgtcgtctctgcgcatcttgttggacatattggaagaaatatggtggcttgaaaatgccaacccggttagatggagagaggccaggaccaaaccgcagtaacatggtaaggggggggacacccaccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 622221 - DNA, 3094 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622222 - DNA, 1874 bp, Homo sapiens
gtgagcccgcccgccactcagtgcccggggtgtgccgccgtccccgtcctgcgcccatcctctcccagcaggtgggcgtgcactgctgcagcggaggggaaggaagactcctgagtccctggccggctgtcctctccgtggtgctctcctctccgtagcctccagcctgtctgcactgcaagccccaacctgggcctagcctgctgacctctgaccttctcttttgttttaagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 622223 - DNA, 3487 bp, Homo sapiens
  misc_feature (41)..(43): n is a, c, g, or t
  misc_feature (46)..(46): n is a, c, g, or t
  misc_feature (54)..(55): n is a, c, g, or t
  misc_feature (1976)..(1976): n is a, c, g, or t
  misc_feature (1988)..(1988): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatggtaagaggaacaacccatgatggggtacggtgcgctcacccatgagctctntggggtgttggnaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtagctcactggggtggtggggggttggccaggcacagcaccttggctggtggcccctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622224 - DNA, 3202 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622225 - DNA, 362 bp, Homo sapiens
agtgattcaccttttgcaggggttgtctctaattctatataaattctttacaggttataccatccactagctgaagtggaaccaccaaaggaagaaaaaaccaaaccagaagcttatgccccaaacagagcaagggccaaagaattccctaaggtgagtataactgagggggaagggctttatttttccagcatgaaggaccccactgaaactccaattttttttccttccccagaaaaccctaaagaaacttcgagcccaaaaaacatgctggctttttaaaaatagggtaaaggtttttttattgtgtatatgtagccttagacaaaattatttaaagtccataaattgttttttgagga

SEQ ID NO: 622226 - DNA, 3047 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622227 - DNA, 1051 bp, Homo sapiens
ggtcggtgctgacaggagcgtgcgtgtgtctccgtctctccgtcgatggcgtgtgctctccccactgatatcagtgtactccgaacagggggagtcctcgtggctaaaaatgtctaactcctgtgtgctgcgtgtcttcaatgtgtcctattcgagccagcatagtcgtgaacactttggttcacatcaacttgcgttccgaatgacatcaatgacgacaggcccttatgactgtcagatgaagttaccaggtcagtcagtactaatggcgtgagtcttgttcgatactggtggacagcctgtggacctcgtaagtatcccagagttcgactgtgtgggtgggactcaccgttctggaccaggggtgcttcgggataacatggtgtcgtggagggccgaagtgtttgcaccaaccaaacacctggacaccgtgtgggcatcatacaggtgaacacaataccaaatgacgatacgccagtcttggatgctggcctgtggcagctctcaattccgtaccagaacttggtgtcatgttctacaggttcatcgtattgagggaaggtccctgggactttccattgggtaaattgaagtataacagttgaaggctacaagaagacccacggtaagctgtttgctccttaagaaactgaaagcgttggaccctgaatatcaaaagagtctattcctctcagcgaatgaggagctggggacaggcaaaatgagaaagcgtcgcgtatcagcgcagggcccgtgcatcatctataatgagggttatggtatcatgcaggcgtcagaaacatccgtgaataatctgttaagtgtaggcaagctgacatgtgaagctgtacctgggactgtgggcgttctgcttggtgaagggttcggataaacagaatgagggagggaaacgctagaaatattaatttcctggaaatattaaagtgtaattgaaacgcagatgacaggatacagaaagactggtagacacaagaatatggacataacagcactaaggaaccgagaataataggggagagagcaaaaatta

SEQ ID NO: 622228 - DNA, 2983 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622229 - DNA, 3277 bp, Homo sapiens
  misc_feature (41)..(43): n is a, c, g, or t
  misc_feature (46)..(46): n is a, c, g, or t
  misc_feature (54)..(55): n is a, c, g, or t
  misc_feature (1547)..(1547): n is a, c, g, or t
  misc_feature (1549)..(1549): n is a, c, g, or t
  misc_feature (1561)..(1561): n is a, c, g, or t
  misc_feature (1575)..(1575): n is a, c, g, or t
  misc_feature (1579)..(1579): n is a, c, g, or t
  misc_feature (1586)..(1586): n is a, c, g, or t
  misc_feature (1766)..(1766): n is a, c, g, or t
  misc_feature (1778)..(1778): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctccgaggcnanttccataactanatcggggaccttcncgcncacagcncgattccgtgtgggcagagctgcagctatcgaggcaagcacaaccgcgggtcggacgggcaacatgtaagaagacgcctcttgcatgcccagctagggtctggcaaaccacggacagaccaggcacatggtaagaggaacaacccatgatggggtacggtgcgctcacccatgagctctntggggtgttggnaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtagctcactggggtggtggggggttggccaggcacagcaccttggctggtggcccctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622230 - DNA, 136 bp, Homo sapiens
gcaagcagcaggaaggaaataagagcagaagtcaataaaattgaaaacagaaaaacaatacagaaatatcaatgaaacaaaaagctgtttttttgaatagaccaatcaaattgacaaacctctagcaaggctggca

SEQ ID NO: 622231 - DNA, 2443 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggactgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622232 - DNA, 97 bp, Homo sapiens
  misc_feature (69)..(69): n is a, c, g, or t
caccaaatggcggatgacgcggtgcagcgggggggcccgggctggtggctgggatggggaaccgcggtngcttacggaggtttcaacagtggcatcc

SEQ ID NO: 622233 - DNA, 913 bp, Homo sapiens
ggactatgagaatcgaaccgatcgcggagaatccaaaattctgcgtgccaccgtatcacaactgccatgctaaagtaaaggtcagctgaaataagctgatcgggacccatacgcccgaagaaatgtcggtatatatccccttcctcgtacatacagttttaattctcactctggacacccaatcactcggtcatctagcatctgccgtctttgacaggtctacactcatccacagcgacgttaagctcgtcactgaattctttattacctggagttgaggcctaggaagactaaaagcatgtctagcttcaaattacctaagtttctaagcgaacaaagtgatgcccgtggttctctaccggaagaggacgtggcccatacaacaggtatctggcgctttcagcgcaataggcaaaaccgggtatccacttaagtccctatctaatagtcagcatagtaccgtcctttcaagaaccacatgagtatcgtcgtgccggcatcgaatggtagatcccaatgaactcagaaataggtatcaccacaatcagagtaacatcgattgctactttcacaatacacttcatcagatgggcctagtgagtcagagtaaagaactaggggaaaatgagcctcccttgttcacgttcgtgagatccctagaaggttgacgccaagggcaggcgcttctgatcttccgaggctggctgactggctcccggttgaccaaaaaactgagcccccagatctaaaggcaatataccaagaatctctactctgcagtaaaggtaaggcgcttctacctgcatctactgaattcttatccatcaatagcaggcacggtgaggtggctccaacgcaaagcgagttagggcaaatcttgaggtaccctaggtaccactgggatgatactagg

SEQ ID NO: 622234 - DNA, 2505 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622235 - DNA, 115 bp, Homo sapiens
agtgctgctgtttgattagaggatcccattaaacaagttatggtctggagcacagctggtggtgctgagcaagtccagtgttaaaattcagagcactctggtcaagcagtcaggt

SEQ ID NO: 622236 - DNA, 1620 bp, Homo sapiens
  misc_feature (583)..(583): n is a, c, g, or t
taccagacaaccttaaccaaagccatttacccaaataaagtactcggcgatagaaattgaaacctggcgcaactagatatagtaccgcaagggaaagactgacacattatacaccaagacataatactagcaaggactaacccctactaccttctgccatcaatgcaattcaactcagcacaataactatgtgcaaggagcagccaaagctaagcacccccgcacaaccagcacgcagctaccataagcaacagcatcaacacgcagcaccaccctgtcatattgctcagccacacacatcagcgcggcacacgcattcacactcagcgtacagcacggctgaacacacacactaaccagcagccctacggttgcatcaagcatggctatagtacccaaaatgccatcagcacatcgttctcagtacccaacactattcaccatatatagcaccaacacagacacacccctacatcaagactcacgcacatactgctacaacactctaaaaaccatctgcctgcaggcttcaccaacacgcacgagaacaccacaccatactacacgcgcacccaccatcagngcacacacaaacacccgtacgcatcacgccacgcacgcaggaccacacaaacaaaataccacacaaccaggcccccaaccgtacgactaaaggcgacaccaataaaaaaccaacgacccaaggcaccaacgcccacaacgatccacaacacgcacaacaacggcacgcctgaccaacaaggcaactccaaagagccagacaccaccaaaccgttaacacgccgataaccacgcagacacgaagtacacacaacaacacacaacgttacgttcacaacccaggaaaacaccataaccctaccaaacaacccccccaacacaaaaggggacacaccaaacgccactacctcaaccccccgccactaccgacaaacgcaacacccacacgcaggcaaccacagacaacacccccagctcaccaccattcgacaacccacaacatcgcctcaccccaccacgcccatacacccgccactcgacagatagaagaaaaagacaacagaccacgccagggacaaccgtagcacaaccagcaaaccgacgcccccacaaataactccgaaccgcacagccacaccacacacaccaagctcaaccacacaaaaaccacacaacacctagacgaacaccaccagccaacaggcaatagcccaaaacaccacaccgggacaaaacacacacctccccccgcgacccccacgaacaacgacaccacacccgcacacacgacacacccaaacaacaacagaaccacacataacaactcacactcggcacatacaaggcgacagcaccagacacaacgagaaaccaaagtacaacaagagcaccgcaaccaccatacagaggccccgagacagcaaaaacaagaacgcaccaacacacagcaaacacacaagatcagcacacaaaagatagcaagacgacgacacacaaccagaaaaataaaagcacgaaaaaaacggcaaacaaacacaacaacagcaaaaaagagacataacaagaaacagaaacacaacgacacagcacatacaccac

SEQ ID NO: 622237 - DNA, 168 bp, Homo sapiens
ggggatagtacaaacagtgcgttgagcgtcctagttgagatgcgtcatgagatcagaaaagtttctgagcacgagcgtgatgccagaagtggaaaattccacacgtgacctcgtgtgacaagtcgcaaagcaccaggcatacaacagtttatgcagcgaccctaagag

SEQ ID NO: 622238 - DNA, 324 bp, Homo sapiens
tcccgggacgtaggtagttttgttggagccgggttctgaggccattgcgttctctttacttcttccactactaggccactgatgcctgcagtaccatgacctggcgaggagttcacgcccgctgcttgcgcgatgaacgctttatcctctgcgtgaccctcatgaacgtgcactgtgatggtttctcaaactatacgggcattcttgaatcgggacacgttgctgttggttcaacagtcaaccagcatgcatctctcaggttctgttcttgggttgtcatcacaacacaagacccaagcgtcgaagcattgttaaacgcaccgg

SEQ ID NO: 622239 - DNA, 197 bp, Homo sapiens
atctgcccacctcggcctcacaaagtgctgggattacaggcgtgagccacggcacccagccgagtcactggtttttctggtgtgttggttctaagtttctccatcacagggtaagctcctggggaatgtggactcggtccacatggctagtcatggtgtctgcaggttctagagcagcacatagtgactattcctat

SEQ ID NO: 622240 - DNA, 328 bp, Homo sapiens
cccctaatctcggctgatcgtcccgcgctaggcctcccaagttcctgagatggcaggttccaaccatcgtgctcagtttatttcactataatattattcgtaaagacctactattactcctgtcgcgcagggagttctcagactcctgtacactcgctgtgctgtcttggaatcccagaatggtgcgatgataggcatgtttcacgtagtggctggcccatgttgattcttgtttctcttttccttttttttcctttttcctccctccctccttcctttcttcttttcgttttcttttctcttttttttcttttgccctgtggaacag

SEQ ID NO: 622241 - DNA, 353 bp, Homo sapiens
atggggccaggtcataagggggagtttccctgcagaaattctcttttccctgctgccatgtaagttgtgcctttcaccttctgccgtgattgtgaggcttccccagccaggtggaactgtgagtacattaaacctcttttctttataacttacccagtctcaggtatgtctttatcagcagcatgagaaatggactaatatagtaaattggtactgatagagtgaagtgcttctgtaaagatacccacaaatgtggaagcaactttggaactgggcaatatttggagggctcagaagaagacaggaaaatgttggaaagtttggaacttcctagagacttgttgaatctcgtg

SEQ ID NO: 622242 - DNA, 266 bp, Homo sapiens
tgcatattacaagttcagctcggtacctcgtgatcttaaacgcagctggaccctgtgtaatgtatattcggcgcatgtggccttctgagaccagcacagaccagcagagggaatgtgagcagggtctggcagtggcccgggaagacacctggctggtctgaagtggctcatgaggctgagtgtagcagtgggtgccagactgagggagctggactgcggtggaggaggtggccagagagtccctttgaggggaaaagaccctgtgt

SEQ ID NO: 622243 - DNA, 410 bp, Homo sapiens
ccccatctccaggctggcacctgctgtgcattcctagtttaacttcattgtgttcacaaaacacatctgtgtgaacctcgtaatgtccagacttaggttttggcctggaagacagtctacgtcagtgggtgctccttgaaaacaatgtctattctgttgttgctggggggagtgtcctgtggtaacacttagatcaagttggtggatcacgctcttcaaatctactgcatcttggattttctgcctaacattcctatcgatgaataagagactggaattgaaatatcacgttgcaatttgccgagttctccttgcagttctaccaggtttcgcttcgtgtattctgaagctctgacaccaggcccataaacactcgggatcattatgtgctcttgatgaacacaccacgg

SEQ ID NO: 622244 - DNA, 131 bp, Homo sapiens
ctcagagtcccctgagagcacttttgattttcttattatatattccacttggcaatctctttataaagggtcatctcttttgcacacactgatccaccagttataatgcactctagcctatcctcgtgaac

SEQ ID NO: 622245 - DNA, 300 bp, Homo sapiens
  misc_feature (10)..(10): n is a, c, g, or t
  misc_feature (33)..(33): n is a, c, g, or t
  misc_feature (144)..(144): n is a, c, g, or t
  misc_feature (191)..(191): n is a, c, g, or t
gggaaaacgnggctcaatcggatggtgggaacntgggtactaatggtaagaagaaagaacaggctggaggatgccaaaggactttctttcaaagaaggaaagataagaatttttctaaccaaagcaaggatgggaggaaaaatncaaccaagcttcttcagggaagaaagcacgccatgaaacaaggccgncatggaaaatgatgaagtcaagaagattcaagcaagctcacaagccctgggggcaagctcaaggctactgctaaggccttgagaagtttttgcaagaaatgggggcaag

SEQ ID NO: 622246 - DNA, 150 bp, Homo sapiens
ctatttaccttcagattctgcatttattagaaaggcaatcaaagaaagaaggcatcacctagggtcccatagtagaatttcttgtccagtctacagtatcttagggtttgcaccattctcgctagtctcttccaccctaggcaatgattt

SEQ ID NO: 622247 - DNA, 1083 bp, Homo sapiens
gaattcaaattagtcctcactgcagactgtacgccgtcaggcatttttcatggcaacatgcatgagtcatgaagcccgctgaacaggtgttcttcaaccagacaccaagtggcaggtcctctgtggcacagcaacctggcaagtggaaccatactcgcaatacagcaatgatacagatttccccaagttcaaccacagatttcctcgatcatccatatatattccaacctgggtttctacccaccagcagcctgaagagtggtactctcctggaatatatgcacactcaggcgtatgccagctgagactctctaccagggagaaactgcaggtagcagagatgcctgtaacaaagaagccccgcatgggcgcgtcagcagggaggatcaaaggggatgagctgtgtgtagccagtggagacagagcctctggataccactataatgcactgacctgtgaggggtgtcaacggtccctccagggacgaagccattcaccacacaacggcttgtgtacacagtgtacaaaccggaggcaactggtctgatggcatactgtcacatgcgcaccgcaacgtgtccagagtgtcgactacgggacaatggccacatcagactggcccatgcttggctcgaatggtatggcataccgggcttgctcaaccctgaacttcacacgcggtacatcctaacgcagactggacaaacacctgtcccaccagcactgcacaccacgaccgtgcaattgcaagcccgtgacacagctccgcgacttaggcgcaccacgggtgacacactgcacacaagacccagtccatgtccaggtacgcacccaccttgaacagtttaaaccagagaattaacgatgccgatagtcctattcattctactataaggacttcacataatcacaaccacgtgctcgtcctatcgacaaatcacacacaaaccagtcgtataacagacactacctgagccaaacagactctttacctagcgtgtatttgtacaccgtcatgcaggatagcagaataccaataaggacaccgcattacacatgcgacccaccacactcattgaatca

SEQ ID NO: 622248 - DNA, 218 bp, Homo sapiens
gtgaggtgctactagctcttagtaagattacacatgcaagcagtccccgtaccagtgagtcacccgtctaaatcagcacgatcaagataggggacaatgcatcaatgcacgcagcaagtgcagctcaaaagcgcttagcctatgccacacccccagggggaagacagcaggtgattcacgctttaggcaataaaccgaaagtaaaactatagctatac

SEQ ID NO: 622249 - DNA, 393 bp, Homo sapiens
aggtttgaaacaatccaaaaatcatttaggaccaagtctaaggaaacattttagtggccaagtggattccgatggtaaaggaatgatactaattttctagcatggctctgaaggtgattttaggtagaagagtttcgaggctgggcgcaatggctcacgcctgtaatcctagcatttggggtgactggaggcgggtggatggctgtgagcccagaagttgaagaccagcctgagaaataaggtgaaaccctgtctacaaaaaatacaaaaagttggccgggcgcggtggtcacgcctgtaatcccagctctcagggaggctaagaggcgggaggatagcttgagcccaggagttcgagacctgcctgggcaatatagcgagaccccgttctcc

SEQ ID NO: 622250 - DNA, 342 bp, Homo sapiens
  misc_feature (8)..(8): n is a, c, g, or t
  misc_feature (32)..(32): n is a, c, g, or t
  misc_feature (53)..(53): n is a, c, g, or t
  misc_feature (119)..(119): n is a, c, g, or t
  misc_feature (292)..(292): n is a, c, g, or t
  misc_feature (295)..(295): n is a, c, g, or t
agcgcttnttggcccccttggctacaagaacntgaagaagcaacccacgggcnttgagcaaggaggacttcgcgggaggtcttgcaagcgggaaggaggcgaccccgaggagaagggcntggaccagcccaggaggtcccagtgaggaagggatggtgcgcccccaacatggtccggagatacacccagctaccaattcgggaccaggaccaacaggaccggacccgccttcccttggaccttcggaccttgatgaggccacgaccccttgcgcttttaccatcccccttgnccncccaccttgtgccttaaaataaacctttggacttgaccgggttaaaa

SEQ ID NO: 622251 - DNA, 105 bp, Homo sapiens
cgtaacacattacggaatgtctacttttcctgttgtaggactcgctcagaaacagacttagtttatgataaatacttaccgattaaacagcatggactacatcat

SEQ ID NO: 622252 - DNA, 2093 bp, Homo sapiens
cttaagggatgggcctcagctaagcagcgtttctggagctggcaggttgctccgatgcccctgggccctggcacctgactgagttgagtatgacgtcctgtcctctctgagctggtcctgctgggagccgagccatcctgggaccagctcccacatgcacacgcccacacctacacgcagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccaggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccgaggtggctgaggccgtggtgggcggtgggagtgcaggacgcgctctctcggggcctcatttctctcctccatttctcatcaggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622253 - DNA, 165 bp, Homo sapiens
ctcgtggggagtatggttgcaaagctgaaacttaaaggaattgacgggctcgttgggtggcacttagaggggctcttcgggtggctcgttggggggctcgttgggtggcacgttgcgtcaattcctttaagtttcagctttgcaaccatactccccccaggcgcg

SEQ ID NO: 622254 - DNA, 173 bp, Homo sapiens
atcagcttttcctggtttgccaattacatccgagctggggctctaatcatgggctctgcatggactcttccgcattaacctcctggggtcagccaaggatggtttaacctacgcgggattggaggaccaccttccaccaccactctcaactcgtcctcggcccaatggttttt

SEQ ID NO: 622255 - DNA, 1353 bp, Homo sapiens
  misc_feature (1)..(1): n is a, c, g, or t
  misc_feature (68)..(68): n is a, c, g, or t
ngccctccaccccccccccccctcccccctccccccaccttacggctaggtacgaggcctgggtggtncttgtgtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622256 - DNA, 2129 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacatgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622257 - DNA, 157 bp, Homo sapiens
  misc_feature (21)..(21): n is a, c, g, or t
attcgcggccgcgtcgacganggacacgagccacaagctggactgggagggggggcactccgcgccgatgccaccggcctgtgggcctctgaagggacccccccccaatcggactgccatagtctccggtttggcacgaggcgtggcttcacgtacc

SEQ ID NO: 622258 - DNA, 2122 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgcaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622259 - DNA, 2192 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctcccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622260 - DNA, 1841 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622261 - DNA, 754 bp, Homo sapiens
  misc_feature (412)..(412): n is a, c, g, or t
  misc_feature (448)..(448): n is a, c, g, or t
  misc_feature (450)..(450): n is a, c, g, or t
  misc_feature (581)..(582): n is a, c, g, or t
  misc_feature (629)..(629): n is a, c, g, or t
  misc_feature (687)..(687): n is a, c, g, or t
  misc_feature (731)..(731): n is a, c, g, or t
  misc_feature (748)..(748): n is a, c, g, or t
gatattttacccactgacaggcgccaggtgataactcattagtgagctgagtttacattttcctgatgagtactaagagagaacatctcatgatacttcgaggtcaataccctagaaccttatggaaaggggaccaaaaagttcatgttctgaatgtataataatgcttttgccagggagggggaagcacgcctctggccccagctactgaggaggctgatgcatgcttgatcccagtatgttaaggctgcagtaagccgtactcacaccaccttactacagcctgtgcgacagagtgaaaccctggataaatacacgacaaaaaactactatctttattatctaggacattgatttggcagggtgagatggctcacgccatgcataccaacactccgggaggccgaggctngaggatcacttgaaggaggaaggtagcgccagcttngncaagaaagtgggcccccggcctataacaaagatacaaaaagtaggctgagcccgatgggcgcaggcttttataacagcctttttggaagcataggtggaatgtcccaaaacccgggacatagaggttgggnnaagccaaaatgccttttgaactttaaacatgggggaagaggggactnctttccaaaaaaaaagcggaaaatacgcggccccacatcggagccacagggcaaacanacttatatgagggattcaaatcaggtgagggcataaccaccaangggggaagaagagcttnataaag

SEQ ID NO: 622262 - DNA, 177 bp, Homo sapiens
  misc_feature (58)..(58): n is a, c, g, or t
  misc_feature (124)..(124): n is a, c, g, or t
  misc_feature (136)..(136): n is a, c, g, or t
  misc_feature (145)..(145): n is a, c, g, or t
ggggcagtctattaaacatcacggagctgaatctgccggaggtagaaatgatcaagcnccaggtggaccaggaagtggagttcttgtccacgtccattgatcagatcaaggtggaacagaccanttttgtggaagncaaggtctncccctcagaggacacctgtcatccccaggtcc

SEQ ID NO: 622263 - DNA, 293 bp, Homo sapiens
attgtataaatcaattatctagtacgctcattactcattggtagttccttaagattagggaaactggcctacctatggcctcatttctaccatactcccaggtgcagaggggtttggtacagttgtggaagtgaatatgatatagggcaaattctgttctttaaaggatataggactaacagttcacctttctggtgattagatttataatgcagactttgaattttaggaggacagtgcaaacacaatgaattaagatgtattaagcatgttttttaaaatctccaaagatt

SEQ ID NO: 622264 - DNA, 1356 bp, Homo sapiens
agctgagctcataccactgcactccagcctgaacagagtgagatctgtcggcacgagggcggtgggagtgcaggacgcgctctctcggggcctcatttctctcctccatttctcatcaggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622265 - DNA, 191 bp, Homo sapiens
tgagtgtagtctttcaggagagtggagagcgtgcatctcttgtcgaagtcagggagtagaagctctcttatgtagagattccgtcggcgtgtggtagcttagcggtcggtgagattcataggtagcagcagtccggcagcagtcagagcagatgatggggaggataccctgtaatggacagtgtggtaccg

SEQ ID NO: 622266 - DNA, 1788 bp, Homo sapiens
cttaagggatgggcctcagctaagcagcgtttctggagctggcaggttgctccgatgcccctgggccctggcacctgactgagttgagtatgacgtcctgtcctctctgagctggtcctgctgggagccgagccatcctgggaccagctcccacatgcacacgcccacacctacacgcagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccaggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcagggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622267 - DNA, 545 bp, Homo sapiens
  misc_feature (529)..(529): n is a, c, g, or t
aatctgctcccaaaagcattagccaatatgaggccaggtggtggctcatgcctgtaatcccagcactttgggaggccaaggcaggcggatcacaaggtcaggagattgagaccatcctggccaacatggtgaaaccccgtctctactaaaaatacaaaaaaaattagctgggcgtggtggtgcatgcttgtggtcccagctactcaggaggctgaggtaggagagtcattgaacctggggggcggaggttgcagtgagccgagattgcaccactgcattccagcctggcgacagagtgagactccatctcaaaaaaaaaaaaaggccattttaattgtggctcaatccttcagggcacagggccgggacagggtggtcgccgggagcacgggttcaggaggcggcgcggctttggcacaaccaccgggtgctgccagctcgattttgtgtaattaactcaggctctgagcttaggtcctcctccctataaagtggagagactagggttcccccctcagaggtggggggnggtctagtgagcccgg

SEQ ID NO: 622268 - DNA, 248 bp, Homo sapiens
cgagtcgtaacataacgtaagagcactcagtggctaagtgtctacattccagatgagatcttcacagagctgcagaagttccttatggatatcatacacagggaggttcccagcattcactataccccatgtccatgccagacttgattgcaatggtaaaggaaaaccccatgcatagcttctcgaatggcttccattcctcggaaggagaaggacaagttggaaagacctccatttattctggctcc

SEQ ID NO: 622269 - DNA, 1957 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccttggcggacactgggggaggagaggaagaagcgcggctaacttattccgagaatgccgaggagttgtcgtttttagctttgtgtttactttttggctggagcggagatgaggggccaccccgtgcccctgtgctcccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622270 - DNA, 1395 bp, Homo sapiens
cactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622271 - DNA, 417 bp, Homo sapiens
  misc_feature (349)..(349): n is a, c, g, or t
gcaagtttaagggctacccacctgtagtcccagctactcaggaggcgaggcaggagagttgcttggacctgggaggcggaggtcgcagtgagccgagatcatgccactgcactccagcctggcgacagaaaaagactctgtctcaagaaaagaaagaaaaggatgtgttaagaagaaccaaaacgtttttagtggcaacatgacttgtggtaacaggatttgtgatttcctgtagtttaaatctttttttattttttgtttgttttactctcttctttatgagtgaattaaatttgctggtgtttgtcttttactacttcttgatatgttaggtatagtcactacttanctctagaagctactgaggatcattacctaacacctcttaagttacataaaaattatatattccatgag

SEQ ID NO: 622272 - DNA, 554 bp, Homo sapiens
caccggagctgattgcattgtctccccggcagctgtactatttacattcccacccaacagtgcacaagagtccagtttctccacgtctcgctatacttgttattttctgtggttttgctgttgttgttgttagttgttaggtttttttacagaagctatcctaatgggtataaagtggtatttcattgtggttttatttgcatttccctaattattaattatgttgagcatcttttcatgtgcttattgggaatttatatattttctttggagaaatgtctactcaactcttttgcccattttaaaatcaggtttttttttgttgttgttgaattgtaggagttctttacatatttgggatatgaaccacttatcagatacatgatttgccaatattttctcccattctatgccttttcactattgattatatccttttacgcacagaagttttacatttttgatgtagcccaatttttctattttttctcttgttgcctgtgccagagttttattttaaatgccattttgggatgtctattagacatccagtt

SEQ ID NO: 622273 - DNA, 291 bp, Homo sapiens
atcatgggcggggacaagttcgatcccccgtagaaatacccctttctctaatagcgagggctaaccacacaggctacaaataggtggtctcccatcttaactactttggctttgtgcaccaactgggggctcttcttactctgatgagtgtatacaagaaaggagagtcttgcagtgatataaggtgtctctttggagtctacccctcttatgttcctcttttagtcattttggttcatagctggttcctggtcagaaattggggaatgcctccaaaagctgactttccca

SEQ ID NO: 622274 - DNA, 584 bp, Homo sapiens
  misc_feature (516)..(516): n is a, c, g, or t
taagttacataaaaattatatattccatgagtttttcatagtctccaaacacaccacacatacagtacctttgtaatttcactatattttaatattatttcattaaacattgccagaattaaatgaattgttcccacagggtagaacttaaaccaagatgtactttgtttagatttgttttttcattttagttatcagtaccagatacacttgctgagtttgtttttttgtttttttgttttgttttgttttgttttgagacagagtctcactctgcactccagcctggcgacagaaaaagactctgtctcaagaaaagaaagaaaaggatgtgttaagaagaaccaaaacgtttttagtggcaacatgacttgtggtaacaggatttgtgatttcctgtagtttaaatctttttttattttttgtttgttttactctcttctttatgagtgaattaaatttgctggtgtttgtcttttactacttcttgatatgttaggtatagtcactacttanctctagaagctactgaggatcattacctaacacctcttaagttacataaaaattatatattccatgag

SEQ ID NO: 622275 - DNA, 184 bp, Homo sapiens
taactcgaagtgaaatggttaaaaatatttatcctgttagaataggctgcatctttttagcaactcattaaaaaacaaaccgtctctgcccctccaccacatggggccccatagccctggtggcccagcagggcgtcccctcacccctgtcataaaagcgtcatgtagctttggttccgttttt

SEQ ID NO: 622276 - DNA, 121 bp, Homo sapiens
tagttccaggccagcctgggccacatggcaaaaccccatctctacgaaagaaaaaaaaaaatttggccaggatgtgaaggttccttgcttgttgtccccagctatatttggggaaactggg

SEQ ID NO: 622277 - DNA, 186 bp, Homo sapiens
attaaaattaatgggctttggtggggtttaattttgggattgggtttggggtttgtttttagttgttttaatggtaagaattaagacctttgtagattttaaaaaaaaatatgaaattgtccctttaatcaagtaaaaatgggccccaatgttttcataaaatactgccagccctttttttccaga

SEQ ID NO: 622278 - DNA, 200 bp, Homo sapiens
aagggttaaggcagcaggaggaggaggaggaggagatgactcggcgggaggatgggcttgctctcaattatagcgcaagttgaaaagtgcaccagaagcaggaggtgagaatacttctccgtgggcttggataagtgctggcaagaaccacatcttctgaagcgagcttgcatactgaagacatcagccacgatcacacc

SEQ ID NO: 622279 - DNA, 463 bp, Homo sapiens
  misc_feature (19)..(19): n is a, c, g, or t
  misc_feature (22)..(22): n is a, c, g, or t
  misc_feature (39)..(39): n is a, c, g, or t
  misc_feature (65)..(65): n is a, c, g, or t
  misc_feature (131)..(131): n is a, c, g, or t
  misc_feature (137)..(137): n is a, c, g, or t
  misc_feature (163)..(163): n is a, c, g, or t
  misc_feature (219)..(219): n is a, c, g, or t
  misc_feature (225)..(225): n is a, c, g, or t
  misc_feature (275)..(275): n is a, c, g, or t
  misc_feature (365)..(365): n is a, c, g, or t
  misc_feature (393)..(393): n is a, c, g, or t
  misc_feature (420)..(420): n is a, c, g, or t
  misc_feature (426)..(426): n is a, c, g, or t
  misc_feature (438)..(438): n is a, c, g, or t
gcggttccggcccatgccngcncgccgccagcagaggcnaccgggccgatcggcgagtggcatgngggcgcgaggactggccgggcacagctggagctggacgaggacgaggcgtcttgttgccgctgggngcgcanacgccggggcccgcgagctggctgcnatcatactcgccaggcaagcgctccaggagtggtgctctgtgatcctgtgcttcanctcatngccacaacctggtcatctctgctgctggccgctggaggacacacccctcngtcatactcggtgttgttgcaggggctctcattgctgacttcttgtctggcctggtacactggggtgctgacacatggggctctgtgganttgcccattgtggggaaggctttcatcngacccttccgggagcaccacattgacncgacantatcacacggangacttcatcgagacaacggggacaa

SEQ ID NO: 622280 - DNA, 961 bp, Homo sapiens
  misc_feature (4)..(4): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (96)..(96): n is a, c, g, or t
  misc_feature (99)..(99): n is a, c, g, or t
  misc_feature (111)..(111): n is a, c, g, or t
  misc_feature (126)..(126): n is a, c, g, or t
  misc_feature (132)..(133): n is a, c, g, or t
  misc_feature (137)..(137): n is a, c, g, or t
  misc_feature (145)..(145): n is a, c, g, or t
  misc_feature (150)..(150): n is a, c, g, or t
  misc_feature (166)..(166): n is a, c, g, or t
  misc_feature (197)..(197): n is a, c, g, or t
  misc_feature (209)..(209): n is a, c, g, or t
  misc_feature (221)..(221): n is a, c, g, or t
  misc_feature (224)..(224): n is a, c, g, or t
  misc_feature (226)..(226): n is a, c, g, or t
  misc_feature (228)..(229): n is a, c, g, or t
  misc_feature (277)..(277): n is a, c, g, or t
  misc_feature (283)..(283): n is a, c, g, or t
  misc_feature (286)..(286): n is a, c, g, or t
  misc_feature (289)..(289): n is a, c, g, or t
  misc_feature (297)..(297): n is a, c, g, or t
  misc_feature (304)..(305): n is a, c, g, or t
  misc_feature (308)..(308): n is a, c, g, or t
  misc_feature (310)..(311): n is a, c, g, or t
  misc_feature (319)..(319): n is a, c, g, or t
  misc_feature (327)..(327): n is a, c, g, or t
  misc_feature (334)..(334): n is a, c, g, or t
  misc_feature (337)..(338): n is a, c, g, or t
  misc_feature (343)..(343): n is a, c, g, or t
  misc_feature (346)..(346): n is a, c, g, or t
  misc_feature (350)..(350): n is a, c, g, or t
  misc_feature (356)..(356): n is a, c, g, or t
  misc_feature (379)..(379): n is a, c, g, or t
  misc_feature (394)..(395): n is a, c, g, or t
  misc_feature (432)..(432): n is a, c, g, or t
  misc_feature (438)..(438): n is a, c, g, or t
  misc_feature (448)..(448): n is a, c, g, or t
  misc_feature (499)..(499): n is a, c, g, or t
  misc_feature (519)..(519): n is a, c, g, or t
  misc_feature (528)..(528): n is a, c, g, or t
  misc_feature (558)..(558): n is a, c, g, or t
  misc_feature (561)..(561): n is a, c, g, or t
  misc_feature (603)..(603): n is a, c, g, or t
  misc_feature (658)..(658): n is a, c, g, or t
  misc_feature (661)..(661): n is a, c, g, or t
  misc_feature (666)..(666): n is a, c, g, or t
  misc_feature (673)..(673): n is a, c, g, or t
  misc_feature (696)..(696): n is a, c, g, or t
  misc_feature (699)..(699): n is a, c, g, or t
  misc_feature (715)..(715): n is a, c, g, or t
  misc_feature (720)..(720): n is a, c, g, or t
  misc_feature (749)..(749): n is a, c, g, or t
  misc_feature (764)..(764): n is a, c, g, or t
  misc_feature (768)..(768): n is a, c, g, or t
  misc_feature (772)..(773): n is a, c, g, or t
  misc_feature (779)..(779): n is a, c, g, or t
  misc_feature (786)..(786): n is a, c, g, or t
  misc_feature (811)..(811): n is a, c, g, or t
  misc_feature (838)..(838): n is a, c, g, or t
  misc_feature (849)..(849): n is a, c, g, or t
  misc_feature (899)..(899): n is a, c, g, or t
  misc_feature (953)..(953): n is a, c, g, or t
tttnttgtgtgtccacaaaaacaaagtcagggtggcctttggttaatcccctccccccaacaagatgacaaaaggagggangcntgngaacaaaanganaaagaggaccanggggggcctgagtgngcggcnncccngggggganaaggnagggggagcgagcgcnacgctgggcgaggcccagcgccccccaagcnaaaacacagaangcccctgccccngcncncnnccccacccccactgcgaaggcagtgagcgagggctgccccaaagaccnagcgcngangcncagacccncagggcnnccncnngaaggggnggcctgcntcagccngcnngaggnggnaaangaagangaggacgagcacaaagaccaggnaaagcagcggcgggnnccagagcgggagcgggcgatccgggcccagcccagcnccaggngcacgggttncaggccggagggcacggcgggggagcgagggggaggaagaggtaggagtgnggacagtaaatgagggtggngggggaagngggataagaggacagggccagggagcgccnggnggcggagacagggcgggagggcgggaggcgcggggaggcacngtcccggccgtgcagggggcgggccctaggccggcactcctcttcataagaaganaanagatntttattntgcaccttgtgatggaaatcgtnacntcttgggaatgaagtnacttnttggtggacagccctggacgggccggcanattcgggctcccatnagtnctgnnggtgangtagctnttttcatagttgtcgtcattgtagntcttgctctggtagatttatgcgttcnctttctttgtnagatcatacatatctgcattccctctagtcgaatccaagtcagacaagcnattagaggaggtggcggatgagctggggggcgagacagccgcctcttggtttcntactcgaa

SEQ ID NO: 622281 - DNA, 466 bp, Homo sapiens
  misc_feature (16)..(16): n is a, c, g, or t
  misc_feature (24)..(24): n is a, c, g, or t
  misc_feature (39)..(39): n is a, c, g, or t
  misc_feature (46)..(46): n is a, c, g, or t
  misc_feature (56)..(56): n is a, c, g, or t
  misc_feature (115)..(115): n is a, c, g, or t
aaaggttgccagaganatgggganaaagattcagagagngaaaacnattaatatantaacaagagagcaaaaagcaaagggggaggagaaactaggaaaatcatatatgggctcncacctatttccaaagctgggctaatgtcctttggcttgtgtctgaataaggcaccaattttaagctgctaatgaaaaaaaaagaaaaagagaaagaagcaggcccaggctgggcgcagtggctcatgcctgtaatcccagcacttggggaggccaaggtgggcagatcacctgaggtcaggagttcgagaccagcctgctcgacatggcgaaaccctgtctctactaaaaatgcaaaaaaagtagctgggcgtggtggcggacacctgtaatcccagctacttgggaggctgagggaggagaatcagttgaacccaggaggtggaggttgcaatgagccaagatcgcgcca

SEQ ID NO: 622282 - DNA, 271 bp, Homo sapiens
gggccagtcacttgtgcaaaatgaaaatatttgttggcccaaaggatccctcttttgtggctcatatggcgcaccatcgctacccgatccctcatcaaaggtggaatttaccatcagaattgatttagagactgcaagaattactgatttcatcaagttcgacactgtaacctgtgtatggtgactgagggtgctaacctaggaagaattggtgtgatcccaacaaagaagaggcacctggattcttttgacgtggttcacgtaaaagatg

SEQ ID NO: 622283 - DNA, 126 bp, Homo sapiens
cagagccacaggccaacacagctaccgagggcgctgcatatgtgcagccaacagcttcttggcgtcatccacatcttcacccactcatcattcctccaaacaatatcacactgtcccatcatctgc

SEQ ID NO: 622284 - DNA, 425 bp, Homo sapiens
agtagagacggggtttcacttgaactcaggaaccacaggttccggtaagctgagattgcaccagtgcactacagcctgggtgacagagccagactgtgtctcaaaaaaaagaagaaagacaatatgcaaacaatctcaacatctcaccatcaggaacacagtcaaaaaatgtccagaatgtccacgaaaccatgctgcatagtcatgggacagaccaagctgctgcacaaactacagagccaaagggaccgccttcattttaaatagtgtgtgtatatacacagggggcttactttcttatctgtgtgtttttattgtatcatctttcaaaacttatttttaaagaaatcacttatgcgtgtgggtagtcatatctccgcatttctcttcaagcgtcaataggctctgtactctccctcgtgccg

SEQ ID NO: 622285 - DNA, 161 bp, Homo sapiens
cgctagcggcattatgaacgccccttcccctcaaaatagcggatggtcggctggatggcggccaccgaacctcgcagatccgccacgtccgccagcactccgaagtcgttgtcgagatagatggtgaccgtgccatctccgttcacttaatgccgctagcg

SEQ ID NO: 622286 - DNA, 380 bp, Homo sapiens
acgctggaaaaatgtgggcacaacaagggttacaaaggactggataattgccggttctgccccggctctcagtgctgcgtggaggatggtcccgagagcatcgactccatcatcgacatggacgccgtgtgcaaaagggtgaccacactgggactggacgtgtctgttaccatctcccaggatgctggcaggtatctgtgtgacttcacgtattatacatcgctctaccaagggccgcggcgctccgcttttgtccacgtgcccccacttgggtaaaagccctacaacgccgaccaagctaaggccgggcgctacgaagctatcatccgaggagatgctgggtgtccttggagcaagccgaagggagacatcagctgttg

SEQ ID NO: 622287 - DNA, 763 bp, Homo sapiens
cgtggtggttcatgcctgtaatcacagcactttgggaggccgaggtgggcagatcacctgaggtcaggagttcgagaccagccgtggccaacatggtgaaaccccgtctctactaaagaatacaaaaaataagccaggtgtggtggcgggcgcctgtagtcccagctactcggggggctgaggcaggagaatcgcttgaacctgggaggtggaggttgcagtgcgccatgtgtctctccatgcctgggtgacacgaacgcagggaaactccgtactcagaaagcaaagacaggagagactaaaatatttaaacagtactgtaaactgtcattgtgaaatctagcagggtatagccatagtcagagccattcatctagagagagagaattaaagagagcaaggagccaaatgtggacaaagagtatgtaaaagtcggtgtagggaaatgaggaagggactggaaataatatttctagagtcccttcaagaataatgcgaagaggtcacatgagttaccagtgttaagtccattaagagatacagcttagtgtacccataggtacctcttagcacagagatacactgtagctgatagatacgatgctagctgcatagagtacattcatatgatgtggtattcccaatggatgtataagcttatctcgaggactaagtgctgacgcatacactatacgcaatctgggatgggtctctatgggaaggtttccatgcaaagactaggaaaacagctgaaaacagcaca

SEQ ID NO: 622288 - DNA, 520 bp, Homo sapiens
cattatggccgggggggcattctttaagctgtcagcattcgggccgagatgccgggggtccgtggccttagttgaagctcgcactactctctctttctggcctggaggctatccagcgtactccaaagattcgggtttactcacgtcatccagcagagaatggaaagccaaatttcctgaattgctatgtgtctgggtttcatccatccgacattgaagctgacttactgaacactggacagagaattgaaaatgtgcagcatccacacttgactttcagcaaggactgcgctttataatctgttgtactacactgaattcacccccactgaaaaagatgagtatgcctgccgtgcgaaccatgtgactttgtcacaagccaatatagttaagcgcgaccgagccatcgaaacctccatactgcgggttgacagatcccccatttggaattgcatgaatcccaaattctgcttgcttgcttttaaatattgaaatgcttatacacttacactttaatccc

SEQ ID NO: 622289 - DNA, 774 bp, Homo sapiens
gggcggcatcagacggtgtgcaggtgtagcagagtggtcgttgtctttctaggtctcagccggtcgtcgcggagtcgcccgctcgctctgaggctcctgaagccgaaaccagtcgtagacgttatcctccttacccgctctgcatgtagcggcgttgtgcgcactcggtccaccatgttcgaggcgcgcctgtttccagggctccatcctcaagaaggtgtgggaggacactcaaggacctcattcaacgaggcctgtggggatatcagactccagcgggtaacccttgcagagcttggatctctgtccccaccgtactcttgtgtagcagcctcacccgtgcgaggctgagaggcttcgacaacctaccgcggtgcgaccgaaacttggccagtgtggtgtgaaccctcaccagtttgtccaaaaatactaagaagtgcgcgtgaaagtggacagatctcattacactctaagggccgaagattaacggcggaataccctgtggcgctaggtattggagggcaccaaaatccaagtgagaagagtcccagacatattgaaatgaacgtttgagtggacttaagatgtgggacacaactgtggaaattccagaacagggagttacagcgggtgttagtaaagatgccttctggggaattggcaggtaatatgccgagatttcagcaatattggagatgctgtggaaattcctggtgcaaagaaggcggtaaatttctgaaggtggggactggcaatggacacttagttggccag

SEQ ID NO: 622290 - DNA, 1183 bp, Homo sapiens
acgtcagtgtgctgctgagcgagccctgaggaggcggcgtgttctgtatcggggccttagcctgctagccctgctgctgatgcgccgcctgcctgtggccctggaggtcatccactgcatgtactggttgagacaatacctggactgtgtgcacacttgatgtggacccatgagggaccttgtgaactgctatggatgaacattccgattcttgccggtcaatacctgtgtgttccatgactggtggactcagtgtgtgttttgcatggaccatgcagggcaacatgttgtggacgaccctgtggggcgaactgcctgaagccagacgagtacatccttcagtgcaccactgaaatgctgtgtctgctgcaatggctggaggcacaggagcccttggggacagacgaagcagtatcctggaatggtctggcgagaagaaccgggaagcctcaagagacttcacacctgtcagcgctggagcaaacatgtggcctgtattatgacggcatgactgcttctgagctgcctgtcctggatcgcacacatcgcgagcacacacttgtcggtactgttggccagagcacgaagctgccccaaggccgagtccttcctttcagaccaaacgccttggaccgtcagtggccagcagatcgatgacatagccaggcttgaccacactgccagaccaagcacatcacggggggatcagagcgcgtccatgaaagactggtgagacaacaatgggttaccaaaaggcatccctgtgcactgacgttggtggaggctcaagagctgcgaacatcctcatgtgcttgactggggtccctgagacttgtagtcccctggaacaggcaattttggacccagtacaaatacataaagtcgagaacagagggcgtggtaggcatagagcacatccgagttgcgacaacgaatcaggacacaacagaaaagatcaccccgtaaatcagagggcacacaacacaggagaaaggtagcacttatagcgaacacacgggaggaaatgatcacggtgtagagccgacaacacgagcaatgaacatagagataagccactatcacccacaaataagcacgcgccatcatagcaaaccgacaagagaaataaccagaaggacgaacaacgatacgcgaacaatctgacgacgcacaaacagcgcaa

SEQ ID NO: 622291 - DNA, 736 bp, Homo sapiens
  misc_feature (130)..(130): n is a, c, g, or t
  misc_feature (387)..(387): n is a, c, g, or t
ctccgtgtccgctcgcgcccatcacggacccggcaggagctgcagctctcgccggtgaaggggctcaggcttggtcgacgaggagaacacgccgccggccctgagtcgggaccacgcgtcctgtgccagncaatgaccgcagagggcagcgatcttctcagcgagccctacgggagcgcgaataactagaacgctagctgtccccggcgtggaggatgagccgctggctgagagaagaacccccgccgctttgtcatcttccccatcgaggtaccatgagtatcgtggcagatgtatacagcaaggcagaggcttccgttttggagccgtccgaggtaggttggatcctctccaaggaccattcagcgacgtgggaattccctgaanacccgatggagagaatatcgtatagtcccatgtgactgggcttactttcgcgagcagagcgatggcgatagtaaatggagaaacttggtggagcgatgttagaccaagaagttcagattacagaagtcccgctgttgtctatggcttccaagattgccatggacaaacatacattctgaaatgtatagtcgttcttattgactacttacagtcacagagatcccaaagaatcgggaagtttctcgttcaagtgccagttgagatagcgagtgccttgtgtcaacgcaacgaatggcagacctggtgccgttgcgctggaattggggacaaaggaggctacctatggtga

SEQ ID NO: 622292 - DNA, 398 bp, Homo sapiens
  misc_feature (230)..(230): n is a, c, g, or t
tgaggtgatctagaggatcccagtgctactccacaaacaggtaaagcgtactatttctccacatcctcttcagcatctgtgtttcctgaatttttaatgatcactattctaagcggggtgagatggtatctccatgtggttttggatttggctttcctctaatgaccagtgatgatgagctttttatcatgttggttggctgcaaaaatgtcttcttttgagaagggttngttcatatctttgtccactttttaatggacttttgtaaatttaagtggctcataaattctggatattatccctttgtcagatggatatattggaaaaattttctcccattctgtaggttggctgtttactatgatgatgttcactttcctgttggtggaggtagcact

SEQ ID NO: 622293 - DNA, 245 bp, Homo sapiens
ataatgcttgatacctcctcaaaattcattaacagagaagctgaaactgtatgacagaggaaaagactaaaaattaaatatcacacctagagagctcagaggaactgtgcccagactatggtctggttctcagatcccattcagtttccaaagagaattatttactaaccatggtctgtgtactgggcccattcattcttccttaaaatcatttactgcccttcaaaatggcgtcagtatagata

SEQ ID NO: 622294 - DNA, 148 bp, Homo sapiens
tctcagtacggagcctcagtaagcggtaaggggcatcagtagcgggcatcagtaacggagcatcagtaagcggagcaacacaacatacccccagcaggcgtgaccgctccgcttactgaagtccgcttactgatgctccgcttactga

SEQ ID NO: 622295 - DNA, 1235 bp, Homo sapiens
ttgagttccatatagtgatcacgagattacggccaagaagaacagaagctgtatgtgatggcttctgtgattatgtctgactactcctttctggcataggctgtgttttatcctctttccctcgctactatcgacgtgaaatacattggtgtcaacatcagacctatgtcagtatatgatgttcagcaacgccgctacaactatatttaaaatatcacaagacacacataaatataacaaaccaataactattactctggtcgaagcttgcacacacaatcactgcccaagttcaattattcaacaaacaagttcattgcgaaaggcacgactataatacaacccactaacgcaatcactatggataccacatatgatcatgacaacaaaattgattacacagataccataccgacaatcagcacgaggaaaatgagctatatactgtactgaattctctagtactcctggactatcccatcacacagtgcacataaccatagatacgtcatgcatgccaacgtatacctggtgaacaaacaaagcataccttgtggagcccacttccgtggaacacagaataattccccccgagaagaagggataatcacagataatgttccgcaccctggtggagaaatgtacatacaccaaacatcatatacaagaaaagcacgaccaagctcatggccaactactctctacacaactgatccactatcccagacatcagacccaatcccacgtctcacacacacattggctccaactaagcaattggcagcactccgacattagtatcgacgaaatatagttcataaatcgagcatatcattttaccacttcattctccatatctctacactatgtacaacgccccgggttatcgtttatcctctcacacctacagcagaagcaaaacccgacgtcaatctttatggttatcaacaatgcagcaattatatacagcttatatcacccaaatgatcactaacatagcatgcttacaaaccagtctaataaactttgatatatatgattgtaacaacattgacaccgcaacctctctgcttctcattatcccgaacgtctactaccgacgtagtcatacacatcacgacacaataacaactctctgtgcaccacactaaacgagactgtcatcgacacccatacgagacaatctaactagcacactagtcccattcgaagtcatccatcgttacatccgtacg

SEQ ID NO: 622296 - DNA, 160 bp, Homo sapiens
ggttttcccccatccccatactttcagccttccatctccggtaataccaggatcttttttctattatcatattcttattaaattactaaagattctagatcagagaaagaattactcaattggcacaaaattacattcaccacaaaattttatttgaaat

SEQ ID NO: 622297 - DNA, 1008 bp, Homo sapiens
tctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622298 - DNA, 129 bp, Homo sapiens
tctggccactgctcacgaacagccttgactgggtggcctctgccctttaaggtcctggggctggatactggccctcagaccttggtctttgtcaccttctcgggggtgtctctggtgggctgaaacact

SEQ ID NO: 622299 - DNA, 1095 bp, Homo sapiens
  misc_feature (153)..(153): n is a, c, g, or t
  misc_feature (156)..(156): n is a, c, g, or t
tgtctggacacgcacccctggcctgtccttgcagcttcctcccgacatcccttggcggtgtctgtgtctcgccccagccccagccctcctttcctgggcaccctcccagccatctggtattggggctgcccccattgcctagtccctgggccncangcagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaacctccttggcggacactgggggaggagaggaagaagcgcggctaacttattccgagaatgccgaggagttgtcgtttttagctttgtgtttactttttggctggagcggagatgaggggccaccccgtgcccctgtgctcccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622300 - DNA, 371 bp, Homo sapiens
  misc_feature (44)..(44): n is a, c, g, or t
  misc_feature (70)..(70): n is a, c, g, or t
  misc_feature (79)..(79): n is a, c, g, or t
  misc_feature (98)..(98): n is a, c, g, or t
  misc_feature (111)..(111): n is a, c, g, or t
  misc_feature (116)..(116): n is a, c, g, or t
  misc_feature (121)..(122): n is a, c, g, or t
  misc_feature (129)..(129): n is a, c, g, or t
  misc_feature (143)..(143): n is a, c, g, or t
  misc_feature (207)..(207): n is a, c, g, or t
  misc_feature (231)..(231): n is a, c, g, or t
  misc_feature (259)..(260): n is a, c, g, or t
  misc_feature (362)..(362): n is a, c, g, or t
aagcattttgggactcaacactgacccagatcacagctgggctngacccatttgggagaatccaaatgangacccggangaccctccgttggcacctngcaaagatctatnccatncactnngggaccnactcaaggcttctngtcagctcctcccaggattggaagctcatcatctgggacagctacaccaccaacaaggtccacnccatcccgcttctctcctccttgntaattaccttttcctactctccctcagnnaacttttttgccttttgggggttggacaacatcttctccatctacagcctcaagacccgcgatgcaacgtcagggtcagccgggagctgcctggccacactnggtaccttt

SEQ ID NO: 622301 - DNA, 171 bp, Homo sapiens
cctatgtggaactgctcgtggccgtgacgttcaggatgccgttggcttgatgtcgaaggtcacctcgatctggggcacgcccctgggggcccggagggatgccgctcagctcgcaagcgccccacacagattgttgtctttcgctcatggccctcgtcgccctcgatacac

SEQ ID NO: 622302 - DNA, 110 bp, Homo sapiens
aatacatccatgatgacagtaccattatccagtgagatggagcaacacgtctgcacctgaagcataatagcaatagtaacccatttggttgtaatgttcggaaattaaaa

SEQ ID NO: 622303 - DNA, 1177 bp, Homo sapiens
  misc_feature (153)..(153): n is a, c, g, or t
  misc_feature (156)..(156): n is a, c, g, or t
tgtctggacacgcacccctggcctgtccttgcagcttcctcccgacatcccttggcggtgtctgtgtctcgccccagccccagccctcctttcctgggcaccctcccagccatctggtattggggctgcccccattgcctagtccctgggccncangcagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccaagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctcccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622304 - DNA, 891 bp, Homo sapiens
agatttctgtggtctcaacttcgctttggtataatttctggcactcaccagcctctatcattagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctcccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 622305 - DNA, 295 bp, Homo sapiens
tgagacgaccttctcggctcactgcaacctccacctcctgggttcaagtaattctcctgcctcagtctcccgagtagctgggattacaggtgcatgcccccacacccggataattttttgtacttttagtagagacagggtttcaccatgttagccaggatggtctcaatctcctgacctagtgatccgcccacctcggcctcccagggtgctgggattgcaggcgtgaaccaccgcacctggccctggtagtgatatttaatccaatccaacaactataggctgggttaaataa

SEQ ID NO: 622306 - DNA, 229 bp, Homo sapiens
gccaaagaaacctgaggaaaatccagcttttaagttcagttttgcaagcaagtatgctgctctctctgttgatggtgaagatgaaaatgagggggaagatttttccgaatagacctctacatcctgtgcttttctcctagtttctcccccccctggaacattcgggagcaaatcaaaacctttttcccggcaagacaaaataaaactcaacatctcctgaaaaaaaaaa

SEQ ID NO: 622307 - DNA, 285 bp, Homo sapiens
cgtcgtgcgattcagagtattcgttattgtgaccgtcagtacgagactgatatatcaatggcaaagtgttaatacaggcaccccaggcctggtgaccctcctgtgcctctggagtgggctgtcctgggagaggctgaccgggaacaagtccccgccctgggtttatcgctctgagtcagagaaggaagagggcttagtccatctccacaccagcatgtcctctcctgcaacgggttgtgactccgtctgggatccgggattcgttggaggccaggaactccacag

SEQ ID NO: 622308 - DNA, 775 bp, Homo sapiens
  misc_feature (510)..(510): n is a, c, g, or t
gtagagaaaaacgaagcgtctcatcacggcagaccagtagggaatatcagcaggaactcaaaaagaacgtatagacaagctaccagagagaacctcaggccaatgatcgagcggaaaattccagaagctgtacaagccatactattcagagtgtgagagtcaaaagagggactccttccacagatctagtgtcatggaagatgtgaaagccagtcgtcacatgggcagctaaagaaaagccatcttcattcgtggagactgtggcccgtgcaatccctggagaaggacttgctggtacttaaaagaatgggacatttgccacccagggactgactgtgacactccctgatcaggcagcagctctggaagcgttgggatcccaggaaccatggaattattcccaaagggactctgagcagattgtgccatactgtggggtggcgggatggaggatgggtactcaggcatgactgcgtatatattaaagtgtgttgtgccacaatgtaccanaaaggcataagcagtgctcctgctgatggcaatcactggcctctgagaaagattcctcggggccatattgaattctcggagtaactcaaatgcctgggaaaaagggaatttccccagcgaccaatgaattatctttcggaggggcactgtcggtcacatcacaccaagggcctcaaccaaaccccggacgcggagtgaggcgcctgaggcaggaagcaagaaccaaactgtgcccctcccaatcttcacactgttctgtgggggg

SEQ ID NO: 622309 - DNA, 168 bp, Homo sapiens
cggcggtgactctagaggctcccggctcacaacatggcacagggccagggactcagttgggtaacaacatcctaccaagacggaccaataaaaaaaagggtgggttttttttttttttttttttttttttttttttttttttttttatagtaattttttaaaaaatct

SEQ ID NO: 622310 - DNA, 494 bp, Homo sapiens
  misc_feature (57)..(57): n is a, c, g, or t
  misc_feature (59)..(59): n is a, c, g, or t
  misc_feature (64)..(64): n is a, c, g, or t
  misc_feature (67)..(67): n is a, c, g, or t
  misc_feature (69)..(70): n is a, c, g, or t
  misc_feature (72)..(75): n is a, c, g, or t
  misc_feature (82)..(82): n is a, c, g, or t
  misc_feature (84)..(85): n is a, c, g, or t
  misc_feature (209)..(209): n is a, c, g, or t
  misc_feature (250)..(250): n is a, c, g, or t
  misc_feature (253)..(253): n is a, c, g, or t
  misc_feature (256)..(256): n is a, c, g, or t
  misc_feature (259)..(260): n is a, c, g, or t
gagctgtgcacagtggtgtgtgcctgtaatcccagttacttgggagactgaggcagngngtccntgncnngnnnngcagagntnncagtgggcatctcaagcttggctcaaaccagcttcctttcctgtaagacttcaaggacttcctttgtttcatgtactctttgggttatctcaaaatgtctggtcctagaactaccaggtgtgtngcaagaagaacaaagagcggagtacagcaaactgaaatctnccnttnggnnagttatagattggccaccatttaattcttccccagaaatggtgtttgaaattgccacatacaatgcagtgcctaattgaagttagagccattatcacataataatttgaaatccaggccgggtacatggctcacacttgtaatcctagcactttgggaagccaaagcaagtggattgcttgagcccaggagttcgagatcagcttgggcaatgtggcaaaaccccatctctaca

SEQ ID NO: 622311 - DNA, 113 bp, Homo sapiens
  misc_feature (1)..(1): n is a, c, g, or t
naaatatgccaatgggttatcttgtacttatctctgtcagaacgttactcttgttctcccagcagttttggtttaatttctaatgtgtctaatttgtgtggcatcgataaaca

SEQ ID NO: 622312 - DNA, 238 bp, Homo sapiens
cccccgtatcagtagaattagaatagtgaagatgataagtgtagagggaaggttaatggtagatattagctagaggtgacgcttccaattaggtgcatgagctaggtggcctgcagataatgttagcggttaggcgatacggccagagactattggattgaatgagtaggctgtatggtatacagataataactagatatggggactaaggggatagtaggatgtgccattgtgagta

SEQ ID NO: 622313 - DNA, 286 bp, Homo sapiens
caacattaagtatagtgcgcatcagaagttgaaagcctggtcgcaatcgatatcgtaccgcgcgggaaagatgaaaaattattaccctaaagtcactacatatatctaggactaacccctataccttctgcataatgaattaactagacatcactttgcaagcgagagccaaagctatgacgcccgaaaccagacgagctagctaataacagcttaaagatcacacccgtctatgtagcagaatagtgggaacatttataggtcgaggcgacaaacctaccgagcc

SEQ ID NO: 622314 - DNA, 104 bp, Homo sapiens
  misc_feature (45)..(45): n is a, c, g, or t
cctgaggttatggtcgtcgcgcacggcggcgtgtatcggccgagntatctagagtcaccaaagccgcggcgcacgcccccgtgcgggccgaaaggggctaccgg

SEQ ID NO: 622315 - DNA, 149 bp, Homo sapiens
gaaacaactgcagagatatgcagatttatgcaaaaggtcctgtgtctacaggtttacggcttttggttttcatgaaggtgatgtattaaaattcacaggacctagggccaggattaaggagggttcaaatcctaggtccttcttattag

SEQ ID NO: 622316 - DNA, 265 bp, Homo sapiens
  misc_feature (114)..(114): n is a, c, g, or t
  misc_feature (117)..(117): n is a, c, g, or t
  misc_feature (123)..(123): n is a, c, g, or t
  misc_feature (129)..(129): n is a, c, g, or t
  misc_feature (133)..(133): n is a, c, g, or t
  misc_feature (163)..(163): n is a, c, g, or t
  misc_feature (244)..(244): n is a, c, g, or t
cacagatgtagttttctctgcgcgtgtggttttccctcctcccccgccctcagggtccacggccaccatggcgtattaggggcagcagtgctgcggacatttgcctttgcagcngcngcacancaccangttncagcgcaacccccagcggcttaagcatggntagagtaccggggcgggtcgtccagctgtgctcctggggccggcgcgggttttggattggtggggtgcggcctggggcatnggcggtgccgcaagggggaag

SEQ ID NO: 622317 - DNA, 916 bp, Homo sapiens
ggcagctgttcccggaagtttgctgctagtcgcggacgcaatggttcaaggttacttcgcggagtggaacgctggcgcgcaggcctgagggctcgggccccagtgcgcggccgagaatggcctccatggcatcgtgagggtggggttcccccattgattgaaagagcaggggccgagtgtgtgtgggcagagggaagatcaatggctgggcggccaaagaaaggggacggggacccaataacaaatggtagggggccccaaaagggggaaggctcccaggggcacccagcagagaaagaaccccttaagtttgaagggtccccctgtcaattcttcccaaaacagagggaggaaattaagtaagggggctggccatcctgggtgacacacgagcggggaccaatttacccaaaggcggtccggccgggaggtatcatgaggccgttgggcacaaaaagagcgcggcaggaaggggcccaaaggggtgggaatgcccccccctcggctgggggggggacgccccaagttcaacacaagggcgtggggtgtgggcccccacaaggcagcgtgtggggcacaccatcgttggtagggcacactcggcggagtgtaaagttttacccttcaaacaacgtgggtggtcggcgacaaaagggtgctcttttctttgcccaaggtaaagaagaattaaaggccaatggggttgttgggagttccctttgtcttcccatattaaagaaacaagaaggaagagcagagaagagagagtagatgaaagaaacactggttgtggtgtgggggagggatgagagagtgagcactcaatagagaagagagagtgatgttttattagaaaaccacacagttgaatatgagagcaggaggagaggaggagagacgaccacacaagaggagg

SEQ ID NO: 622318 - DNA, 217 bp, Homo sapiens
  misc_feature (114)..(114): n is a, c, g, or t
  misc_feature (117)..(117): n is a, c, g, or t
  misc_feature (123)..(123): n is a, c, g, or t
  misc_feature (129)..(129): n is a, c, g, or t
  misc_feature (133)..(133): n is a, c, g, or t
  misc_feature (201)..(201): n is a, c, g, or t
  misc_feature (217)..(217): n is a, c, g, or t
cacagatgtagttttctctgcgcgtgtggttttccctcctcccccgccctcagggtccacggccaccatggcgtattaggggcagcagtgctgcggacatttgcctttgcagcngcngcacancaccangttncagcgcaacccccagcggcttaagccattgcgcgttctcacgggcattcagcagcagcgctttctgtnacccacaaagacaacn

SEQ ID NO: 622319 - DNA, 263 bp, Homo sapiens
ttggaaaagacatagaaaaggcctgcccatctatttatccccccccagatgttttcgttaaaaaagtaaaaatgctgaaaaagccccagttttaattgggaaagctcatggagcttcatggtgaaggccgtagttttggaaaaacccctgggggccaaacaggtgctaaaatttaacgagctgatggatattaaccccccgtcccagaatttgttttaagttccgacttccaaaagtggccaataaaaagggctttttgttga

SEQ ID NO: 622320 - DNA, 191 bp, Homo sapiens
  misc_feature (73)..(73): n is a, c, g, or t
  misc_feature (161)..(161): n is a, c, g, or t
  misc_feature (171)..(171): n is a, c, g, or t
  misc_feature (188)..(188): n is a, c, g, or t
taagaggatcctcgctgatacacgtatggagcggcaggagggctggcagctgggcagcctcccggttccaggnaacactatacctgacgtgaagtggagacaccgaacgctcgggcccagaggcttgcttcggcaccgctcctccgggagcttatgtacantgggatacanacatttgggcagtacantgt

SEQ ID NO: 622321 - DNA, 176 bp, Homo sapiens
cctgatctgctctccatcactctggattagtttttcttaccctaaaatttcacatacatcgaatcatacaatatatactcatttcttgtatgtcacgttagcataatgttttatgaggttcatccattggtgcttgcattgtataaatttcttttttatttgcaaaagttggtatt

SEQ ID NO: 622322 - DNA, 214 bp, Homo sapiens
cgatcaggtggggtctctgaaacaagtacaggagcgaacaaagagaaaaaatgcgccgagatgcctcaggaaatgtcatctgtgaccttgagaggatttaaggtattagtgttggacagaaagcctggtcaatacatacttgttgaatgaatgaatgaatgaatgaagtcctattgggatgagactgccccctgccctgtctcccagcagctcg

SEQ ID NO: 622323 - DNA, 236 bp, Homo sapiens
  misc_feature (66)..(66): n is a, c, g, or t
tgtagactcagcttcttggagagaaaaaaagaggtccgggttgacaatggtgggtaacagaaaggnactggctaccgttcggactatttggtagtcatgtacagaacattggaccatgggtggtacactgggcttccgtttaccagatgaggtctgtgtatgcttcactttccccatcaacggtttgttatcccaggaggaatggggtctctttgttggaaatcccgaaaattttc

SEQ ID NO: 622324 - DNA, 1567 bp, Homo sapiens
  misc_feature (1255)..(1255): n is a, c, g, or t
  misc_feature (1383)..(1383): n is a, c, g, or t
attcagaggagatcctcaccctgcctgcagtctgcagaagagggtgtacaggtggctgtggacacagctgcctgtgtggctcagtatttgactgtgtccaacgctgatctggctgggctcgtcctgaagtagaaccaggtgcacgctggtggctggactggtgatgaacgctcactggttggacaactgtgagacacgaacgttggacgacaacggccatgtccactacgaccgaccatgactcccctgcccaagacagtacggcgacctagcccaacactgcccaaccgaaccatggcttgcgaccacccatgaacaagatggaagacgcgagccctgtgacaccaacacaatgaagatcacatggcatcaccatacaacatcagctacgaccccccggcacccacacatagatcacacaagaatgatccccaacacgtgggaggggcatcatacattccaaaaacacgtatcctatcaaggaagtataacccaagagtatcacaacgcccacggaagtttatcccacacgcacaaatgcgggaatcccaatacccgatccgtgcagcattacgttggacaccactatgacagctatcattcaatcaccatggacaaggggtattcactccttttacaattgaaacccacaaggcaggccgtaaccaacacccacaaagagcaggggaaggacatcctcacgcaaacacaactgagccggaacgcatacacccaagggaacaacacaatccgagcacgcccattgtgtggcatctaaggacgtccccaccggcacaacaaggacagcacgtaaaaacttaaacaagcgcagagtatggagatggagcaacaaacaccgacaaacaacaacagcacactcaataaacacgacagcaacaaaacaacaagcagccgaccaacatagctgaggtgcgaggagcagcaccagaagagcgacgcaccgcacacagagagcacacagagacagagtaagacaaacagtaaggataaagttgaggcagaagcacacagcagaggcagcagcaagaccagaggccagcccaacgcccaacacgtggggtcaccacagtcagacgaagagacacacaaactaacagacgaccgaggggagagtgacagaaacacagtggcgcggaggacaccacccaacacacacaagaaccaagcgcgccagcggagacgaacacgcaggcgagacctgactacacagcacaaactaagacgaaagacgagngcggacatcgaaagccgcaggccgacacacacgaaggacacaacaacagaagccgtagctcaacactactacacccagcggcgccggtgcggagccaagcacgtcacacgcctagaggcctagccgcnagcagacaaaagctacaagtaacaagtcagataggcagacagtcagcagagcagaggctcataagcatgaaacaccagaacgaagcaaagccacgccagagaaccaggccgcagacaacgcagcgcacgcatcacaaccgaacagagaagcgacgacagcccagacggcacagccgcaaacacc

SEQ ID NO: 622325 - DNA, 141 bp, Homo sapiens
gtgtcactgcatagtcaaagtgttacaaatccttgacacgtacagagtgtagtattaaaactgatatctgagccaggtcgcctggttcaaatccaaggttctgccttaagagtttgattcttctgtgtctcaactttgtca

SEQ ID NO: 622326 - DNA, 290 bp, Homo sapiens
  misc_feature (284)..(284): n is a, c, g, or t
gaattcggcacgagaaggctcacacctgtaacccaacactttgggaggctgtggtgggtggatcgctttaggccaggctggtcttgaactcctgacctcaggtgatccacccgcctccatctctgaaagtgctgggattataggcatgagccatcatgctcagccaataaatagatatttccaaataattatttttcatttctgacagtcctaagcctccgttgatgtacttttgccaacctcttggaaaatcactttttagagtcacagtttcttccgggganacacaa

SEQ ID NO: 622327 - DNA, 173 bp, Homo sapiens
ccatctggaaaggaggctgctacttccccaaggtgttaatatgttttgcaattcttaccccaggctcattcatccacgaagtgctcaccaatcattgcaggggagagagagcacgcgcagtggaagtagagagattagtcatccatcctcggtaactatgactttgctactga

SEQ ID NO: 622328 - DNA, 700 bp, Homo sapiens
  misc_feature (3)..(3): n is a, c, g, or t
  misc_feature (88)..(88): n is a, c, g, or t
  misc_feature (120)..(120): n is a, c, g, or t
  misc_feature (171)..(171): n is a, c, g, or t
  misc_feature (228)..(228): n is a, c, g, or t
  misc_feature (250)..(250): n is a, c, g, or t
  misc_feature (261)..(261): n is a, c, g, or t
  misc_feature (269)..(270): n is a, c, g, or t
  misc_feature (326)..(326): n is a, c, g, or t
  misc_feature (328)..(328): n is a, c, g, or t
  misc_feature (351)..(351): n is a, c, g, or t
  misc_feature (353)..(353): n is a, c, g, or t
  misc_feature (395)..(395): n is a, c, g, or t
  misc_feature (407)..(407): n is a, c, g, or t
  misc_feature (411)..(412): n is a, c, g, or t
  misc_feature (420)..(420): n is a, c, g, or t
  misc_feature (422)..(422): n is a, c, g, or t
  misc_feature (429)..(429): n is a, c, g, or t
  misc_feature (482)..(482): n is a, c, g, or t
  misc_feature (484)..(486): n is a, c, g, or t
  misc_feature (509)..(509): n is a, c, g, or t
  misc_feature (512)..(512): n is a, c, g, or t
  misc_feature (514)..(515): n is a, c, g, or t
  misc_feature (534)..(535): n is a, c, g, or t
  misc_feature (545)..(545): n is a, c, g, or t
  misc_feature (660)..(660): n is a, c, g, or t
tgnaactggtatatatactgtgtggtatcagaagcttggaccaacgtggtgttgccttacctgtatcaggaacatcaagagcaacagntatcacaaggacactggtttaacaatacaccncataggtccagtaataccctgggaatttcccaatgcaatcaccaccccttnccctttttataaatatataaaaaaacaaaaagtcagcaaaaccagcattatgatgtngcaaacagagtataactctgangtcagtggggncagtaaannccttatcagaccatccatagttttacaatgtgatctgctcttcctcagaccactantntagaatccaaacaggtgaaaaanangtcactccttagaatacaacaatgatctgataagggtttganttagtggaaggngaannaaaaaaananggggatngcggggcatagcccctattggaacaagctaactttccagattttacaaattanannngcaaaaacaaaaacaaaaaaccnctncnncatgccgccacccctcccnngctttttccntttttctttgtaaaaagttcagagtttgcaatttaatcctgggtttttaatgagaaggacagttttggcctggacttccccttgcccaggataattttttgttcttctttttgtngacgttgtcgttcttgttctagtttcatcctttcctcatg

SEQ ID NO: 622329 - DNA, 456 bp, Homo sapiens
  misc_feature (24)..(24): n is a, c, g, or t
  misc_feature (34)..(34): n is a, c, g, or t
  misc_feature (69)..(69): n is a, c, g, or t
  misc_feature (454)..(454): n is a, c, g, or t
aaatttttttgtaatttttaagtnagagaacaangtttcacccataattggcccatgccccgtcttccnaactccctggccctaaaagtgattcaccccacccacggccctccccaaagtgcctgggaggacctgccttaaggcaaggagtctgagacccagccctgggcaatacagcaagatccccatctctattttaaagaaaagtttcactttgggaggccaaggcgggtagatcacaaggtcaagagatcgagaccatcccggccaacatagtaaaaccccatctctaccaaaaatacaaaaaattagccgggcgcggcggtgggcgcctgcagtcccagccactcgggaggctgaggcagaagaatggcgtgaacccgggagcagagcctgcagtgagccgagatcgcgccaccgcactccagcctgggcgacagagttttttttcttnct

SEQ ID NO: 622330 - DNA, 300 bp, Homo sapiens
tttgttacacaactctgctccaggtcagtattctcctgctcagtctctctgggatacaggcatgtgcacatgccggtaatttgtattttagtagagactgggtttctccatgttggctaggatggtctcaaattcccgacctcaggtgatccacctgcctcgcgctcccaaagtgctgggattacaggcatgagccaccatgcctggccaatcaatgctagtcttttttttttttttttttttttttttttttttattagggggggggggccctttacacccacaattttgggggggggg

SEQ ID NO: 622331 - DNA, 1547 bp, Homo sapiens
agtgtttagtgtatgtgcagctgcctttcatggaagactaggcggcaatacatgttttcatcctgcaacaaacagctaacgaaatactgctcccaccgaggcacagttgaatgctgctgatgcttcgacttggactccatgagcctggcaaacgaaagatgagaagacagacaccccttgaagacgtgatcgccaagccaccagagaagtccccaagactccgtcgacatcccagacgactcactgccagcggctctgcctgacacagcagacgctctaaccatccgccgggcagcccccctaccgccgcacactccacgcccacgcccagtaatgcacgcgcacagctcaactagccgtcggcacactcgcctacacccgacctgcacaggctgcaaccacaccaggacaaacgagacctcaacgaatccaccccacatacgtccctccacacacactacacacgcacccacatgaacagccccatcgttgcactgaggaacgacccaaagcacacacccacgcgcactccacccgctgcacctcgacctccaagccggagacagcctacacccaaccgcacacacagcgcacgtggacccgcaatcgggcaaccctcacgaactgcccacacccccacaatgtcaacaccgcaccctccgacgccccaccgagcaacgcagaaccccccccacccctccccagcgcacccgacacctgcccccacgactcctgcgaccatcgccacgcaggccaaccctcgcccccccgcccacatggaacagggcacgcaaaacgcctccgaccacctcacctcgcccatccgcacacaaccccatcccccccaccgaatagcccccagacaccggaacacccccaccacgacaagcccaacagccgaccccagcgccatactcggcccgaacgcaaaacaacgcccacggcgccaccccacccagcggacacccccaccttcgaccaccgttcacacaccgacatcgccgcgccaccagcccaagccgccgtcaccgcggcggagacgctccacctaacacgtgcgcgcaccgccaccgccgccgccactctccctcccactgcaagcaccacacgggccacatcacacacccccgtgacaacttgcccgctaccgccccatctcccacggccacgcacgaacgaacacagcgccgactctccatacacgcccgcaccgccacgacacaggcgacagagcgaccggacagcgcccatcatcagcacaaaacccacgcatcacccccagcatcgacgcgcccccgtatccacacacgaacaacaacacacacccagcgagagacgacacctatacacacggacaaccaatacacagctcacaaacgcaaccacgccacaccacgaagaccgacgcacggcagctcaccccgacacaactgagctacaagcacacaacgccggcaacggaccaacgcaacacaacccaggagcaagacccacctgccggaagcaaacccttagacgacaaaccacacatagagccacggacaaga

SEQ ID NO: 622332 - DNA, 269 bp, Homo sapiens
ttctccggttgtggtggctcttgtcgccttgtgggttccttcttcctgcgttcctgggttgtctcgcggctctacccataggctcgggggctgccgagcactgctgttgagctgtcatgccggtaccctttcttggggagaaaggccatgcgcctagtttctagcttctctctcagcactagcagggtcctgaacaaaatggtcgggcttgggagcctcctcgtcagcatcgtcttcctcatcgtcgtcatcctcctcctagccttctc

SEQ ID NO: 622333 - DNA, 639 bp, Homo sapiens
cccggcacccggcaacagttacagatctgcaaactaacaccaagtgccatagtcctgaactagtgcactctgtgttaacagttgtcactgttcctaggatgaacacagcttgtcatggaacagcacgctcagaacgatgtcgacgtagaggctgctgctcacctttggtgacctgagcaatcccatgccttttttaaattcaaaaccccacaatgcagcacatgatgccagaaatagcactgaatcaagaaaatagccattgcggagctgccctcttgagtctttctgtccatcccattctattctgtactgtgacttcagttcaggaagttttgttaagtgtaaaaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtaatcaccgggcacttgatactctt

SEQ ID NO: 622334 - DNA, 117 bp, Homo sapiens
actgcagagaaccgaaaccccagctgcgaggtccaccaggagccggtgacatacactgctatagaccctggcctgcaagatgctcttcaccagtgtgtcacccgcaggtgcagtcag

SEQ ID NO: 622335 - DNA, 837 bp, Homo sapiens
gtcggctgcccttccttggccctcttgcttgtgtcagagagggtgttgccgccccgctgtgtaaagacgctgtgggtgggcccctattagttgagtggtcgcgggcggcggccaccttgttggacggggtgctcgcgcgcaagccacacgcgggtgtggagcggtttccctcatagggccacccccagtggtggttgccgacattatgctgctgtttgtcggtgacatatgagcaggcatcccacagacatgcgacggtgggggtgttcattacatacaaagccaggcggggtgacacacccaacagggcgtttcttggcggaagtcggcacactgagtgcgcgcccacatagtgcgcgcgcctcaggtcacttctcagaaagagcgcgctgacaaggagcgaacgatctcaattccccccgattattctcgctcctcccccccccccctcttttggatacaccaatgtcggttcgaaaaacaccgcgctctctctcagaacgctaatcttttttttccacagtttgccgcccctctgtagacaccgattctgattatctctgtataataacacatgtgttcttacaaagatacaccacacagccgtctcgtttacaaccctccccacgtaaacgaatacatcaaaaaaaaatttcttgttaggacaccactgtgagagttctaggttgtctgtagggctgcacagtttgaacgtattttgttgttataaaccacggtccagttcttatcaggcacgcacactgggtgcccaccaacaattgccaaccgatacttggaggacccctctataaaagctacacccacaaatgacaaaca

SEQ ID NO: 622336 - DNA, 288 bp, Homo sapiens
agatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgggagatttaggctgcagtgagctttgattgtgcattttatttttttttatttttttttttgatgctgtagtgtttgtaattggttgttaatggccaatagttgaataaatcagatttca

SEQ ID NO: 622337 - DNA, 876 bp, Homo sapiens
  misc_feature (22)..(22): n is a, c, g, or t
  misc_feature (120)..(120): n is a, c, g, or t
  misc_feature (130)..(130): n is a, c, g, or t
  misc_feature (140)..(140): n is a, c, g, or t
  misc_feature (144)..(144): n is a, c, g, or t
  misc_feature (164)..(164): n is a, c, g, or t
  misc_feature (180)..(180): n is a, c, g, or t
  misc_feature (189)..(189): n is a, c, g, or t
  misc_feature (193)..(193): n is a, c, g, or t
  misc_feature (198)..(198): n is a, c, g, or t
  misc_feature (221)..(221): n is a, c, g, or t
  misc_feature (241)..(242): n is a, c, g, or t
  misc_feature (250)..(250): n is a, c, g, or t
  misc_feature (277)..(277): n is a, c, g, or t
  misc_feature (283)..(283): n is a, c, g, or t
  misc_feature (296)..(296): n is a, c, g, or t
  misc_feature (298)..(299): n is a, c, g, or t
  misc_feature (309)..(309): n is a, c, g, or t
  misc_feature (318)..(318): n is a, c, g, or t
  misc_feature (330)..(330): n is a, c, g, or t
  misc_feature (367)..(368): n is a, c, g, or t
  misc_feature (382)..(382): n is a, c, g, or t
  misc_feature (395)..(395): n is a, c, g, or t
  misc_feature (437)..(437): n is a, c, g, or t
  misc_feature (450)..(450): n is a, c, g, or t
  misc_feature (454)..(455): n is a, c, g, or t
  misc_feature (463)..(463): n is a, c, g, or t
  misc_feature (482)..(482): n is a, c, g, or t
  misc_feature (495)..(495): n is a, c, g, or t
  misc_feature (514)..(514): n is a, c, g, or t
  misc_feature (529)..(529): n is a, c, g, or t
  misc_feature (537)..(537): n is a, c, g, or t
  misc_feature (545)..(545): n is a, c, g, or t
  misc_feature (550)..(550): n is a, c, g, or t
  misc_feature (563)..(563): n is a, c, g, or t
  misc_feature (578)..(578): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (601)..(601): n is a, c, g, or t
  misc_feature (632)..(632): n is a, c, g, or t
  misc_feature (720)..(720): n is a, c, g, or t
  misc_feature (807)..(807): n is a, c, g, or t
  misc_feature (847)..(847): n is a, c, g, or t
aaatagtacagatatgatctangggaaagatggacaaattagagcacatagactctttctaaattgttacaggattgatactgctagatccaatttttttaaagggaagctacgactctnggtttttaanatactatgcnagcnacacaaaacacttccacaanccacattcaacctaanagctattanattnttatncctacaaacttatctcatcccancctcctcatttttcaaattnnatatattntaaatatctattccttttatccatatncaatanacctatatagctnannggatccttancaattctanctactcccctgntttcccacacccatggccatttttgccccatttgagnnaaactcagtttatncttaacaaagaanagaagtattagtttcttgtaagtggattctgaatgggggggntagccagtgagtngagnnttatctgntccactttaggctgaaggnaaagctaagtggnatatacacatcatcttggnaggtatagatagggnaacaaagntagagagnttcgncaacacaacaagngttacacagcaagtnagccgcnggnacaaacccnaggngttctgttttcaaccctcagccccaaactgnatcttctgagttaggcagaatgtgttaacaagtagcagaataaatataacaacagcagttatcaccctttatatctctagagtgactntttccatgctttccccacactcttaaaatgttacagtctgcagggccctcatgcagacctctcacctgaccatcccaacaggtaagnataatgcaatgataagacaatgagagaagaggagtagggnttctccctcatttcacagaagaggtaact

SEQ ID NO: 622338 - DNA, 489 bp, Homo sapiens
atgtggaggatacagcatgaaagacaggcgcagagctcgtgcatgtatcacagcactttggggaggccaaggcgggcagatcacgaggtcaggagttccaagagcagcctggccaacatgatgaaaccccatccccactaaaaatacaacaattatctgggcgcggtggcgggtgcctgtaattccagctactcgggaggccgaggcaggagaactgcttgaatccgggaggcagaagttgcagcgagccgagactgcgccactgcactccaccagtgggtgacagagcaagattccgtctcagaaaaaaaaaaaacaggttcctttaaaaccccttcgggtatcaaaattctgtatgagtcagtgttctcacagagggaccgaaattataggatatctgtatttttaaaagggagtttataagggagaatgggatcaaacaattcacaaggcaacgtcccatgacgggccgtattagctggtgggaag

SEQ ID NO: 622339 - DNA, 268 bp, Homo sapiens
  misc_feature (168)..(168): n is a, c, g, or t
tccgcatggcagcacactcggctatttttttttttggtattttacagtagagatggggttcaccatgttagccaggatggtctcgatctcctgacctcgtgatccacccacctgggcatcccaccgggcggggatatacaggggtgaaccaattgtgcctggccgaangatggttatttcactgagtatttgagagtccacagcgttgctgtgtgaatagtaaggcaaagtaacgtgcactaccacctttatgttctaatgaaagtag

SEQ ID NO: 622340 - DNA, 716 bp, Homo sapiens
  misc_feature (259)..(259): n is a, c, g, or t
  misc_feature (544)..(544): n is a, c, g, or t
  misc_feature (546)..(548): n is a, c, g, or t
  misc_feature (676)..(676): n is a, c, g, or t
tggagtgcaatggcacgatcttggctcactgcaacctctgcctcctgggttcaagcaattctcctgcctcagcctccagagtagctggaactacaggtgcccgccactatgcccagctaatttttgtgtgtggtagtagagacggggtttcaccgtgttggccgggctggtctcaaactcctgacctcaggtgatccacccacctcagcctcccaaagtgctgggattacaagcgtgagccactgtgcctggccctttnttttttttttttttttttttttaaagagatggcatcttgctatgtcgtccaggctggtcttgaactcctgagttcaagcagtcctcctgcttcaacatacagctacaggtaccccccactatacatttttaataaggattcatggctcagagggattttctgatggttttgctgatttgtttctagtttttttgtgtttatatttaacatgaagaccaagtttatataactaggtatctgtataacgcaacaacattggaacacaataaagatgtatttttgtanannnttactacatggttttattggtttgatgcctactatttatttgcgctcaggcacaggaaatactatggttaaaaataccagtgagtcagccgggcgcagtggctcatgcctgtaatctcagcactttgngaggctgaggcaggcggatcacgaggtcaggagatcgaca

SEQ ID NO: 622341 - DNA, 341 bp, Homo sapiens
gggcgtgcacctttaaaagtgccactctctttgtcatacctgtgtattttattgtggggcacacatgtctactaatgcatgtaagccagctcagaaagttccacctatttagagtgcagattgcctaaacgaaggcaacagttgggtggaatattaatcattttcagacagaaaacagttatttttaaccctatttcacaaaacaaaaaaatcatcatttccatggatggtcccagtaagagagtttggtcaagagagctctcattaaaggaactcagatatcataaaaaggtatgactttagagaaatgaggaaggtacttcccaaccccgagctgatgt

SEQ ID NO: 622342 - DNA, 359 bp, Homo sapiens
  misc_feature (187)..(187): n is a, c, g, or t
  misc_feature (189)..(191): n is a, c, g, or t
  misc_feature (319)..(319): n is a, c, g, or t
caggcggatcacgaggtcaggagatcgacaccatcctggctaatacggtgaaaccctgtgcgcaagggttttgctgatttgtttctagtttttttgtgtttatatttaacatgaagaccaagtttatataactaggtatctgtataacgcaacaacattggaacacaataaagatgtatttttgtanannnttactacatggttttattggtttgatgcctactatttatttgcgctcaggcacaggaaatactatggttaaaaataccagtgagtcagccgggcgcagtggctcatgcctgtaatctcagcactttgngaggctgaggcaggcggatcacgaggtcaggagatcgaca

SEQ ID NO: 622343 - DNA, 449 bp, Homo sapiens
  misc_feature (277)..(277): n is a, c, g, or t
  misc_feature (279)..(281): n is a, c, g, or t
  misc_feature (409)..(409): n is a, c, g, or t
ttttccttcataaaatacagatggggttttacaatgttgcacaggctaatctcgaaatcctaggctcaagcagtcctcctgcttcaacatacagctacaggtaccccccactatacatttttaataaggattcatggctcagagggattttctgatggttttgctgatttgtttctagtttttttgtgtttatatttaacatgaagaccaagtttatataactaggtatctgtataacgcaacaacattggaacacaataaagatgtatttttgtanannnttactacatggttttattggtttgatgcctactatttatttgcgctcaggcacaggaaatactatggttaaaaataccagtgagtcagccgggcgcagtggctcatgcctgtaatctcagcactttgngaggctgaggcaggcggatcacgaggtcaggagatcgaca

SEQ ID NO: 622344 - DNA, 373 bp, Homo sapiens
agcccaaccgcaaagccgacgacaacgccaccatccgtgtcaccaacttgtcaaaggacacgcgtgagaccgacctgcaggagcttttccggccttttgggtccatctcccgcatttacctggctaaggacaagacccctggccaatccaaggggtttgccttcatcagcttccccccccgcgaggatgctgggggtgccattgccggggtgtccggctttggctacgaccccctcatcctcaacgttgagtgggccaaaccgtcccccaactaaaccagctgcccccgtgtactcggtccgggacccttggcgacaaaaaacagcctccgaaagggcgggctccaagggcaataaaacagctcccctcccca

SEQ ID NO: 622345 - DNA, 229 bp, Homo sapiens
cctcacaagacctgtggtacttttctgacacctcctgcttaaaacccaggcagaagcaggaagcagcaggaagcggcagaagcaggaagcgcttcctgcttctgccatcctctccctcacttggtttttgaacagtcgtctaagttgacatgagttagatgtccagagcaagaaagatatgaatgtaagatggtgagggttttgttcatttgggaactggactttagag

SEQ ID NO: 622346 - DNA, 594 bp, Homo sapiens
  misc_feature (12)..(12): n is a, c, g, or t
  misc_feature (73)..(73): n is a, c, g, or t
  misc_feature (403)..(403): n is a, c, g, or t
cccccaaaaccnatctgagccccacaactccctcacttgatggtgcaaagggactgtgtgtttgtggcccccncctaaaaatatacatgttgaaaacacctaaccctgatgtgatggtatatggaagatggaaactttggggaggtaattaggtccatgagagtggacccctttatccaatgggattagtgccccttacaaaaaggggcccagagaccctagctagttctccttctgcccatgtgaggatacaatgagaaagtagacagttggtgatatggtttggctgtgtccccaatcccaagtctcatcttgaattgtagttccccacaatcccccacgtgtggtgggaaggacccagcgggaggtaactgaatcaagggggcagtttccctcatgctantcttgtgatagtaagttctcacgagatctgatggttttagaaggggcttcccccttcagtcggctctcattctccttcctgctgccctgtgaagaagaacatatttgcttccccttctgccatgaatgtaagtttcttgaggcgtccccagccatgccaaactgtgagccaattaaacctctttcctgtaa

SEQ ID NO: 622347 - DNA, 180 bp, Homo sapiens
actttttcgccgatacggttacagcggcgcgttctattacggtaaagttgcttacaacttggtaacagcttctcgtaacaacaaaggagacataaggcgatttgccatgaccgccattgaatctgatcttttgcaattggcttaccctccgcggctcgatctggggccgcaactcactca

SEQ ID NO: 622348 - DNA, 740 bp, Homo sapiens
caacttgaattgtaccttccagaattcccacaggacccaggggaggtaattgaatcaagggggctggtctttcccatgctattcttgtgatagtgaataagtctcacgagatctgatggttttatcaggggttactgcgttttgctgcttcttcatttctctcttgctgctgccatgtaagaaatgcctttcacctcctgccatgattctgaggcctccccagccaggtggaactataagtccaattaaacctcttttggttcccagtctcaggtcatgtcttgatcagcacgcgatgaaatgtggactaatcagtaccagtacgagtggggcattgcttgcaaatgtataccctagcaatgtggacagcgacgttgtggaactgggctgcttgaatataatctggagggcgtcagtaagcaagataggaaaatgtaggaaagtctggtacctccctagagactgtgaatggcgttgactgtgatactgcttgtgatatgtacaacttttggtccggctgacggtggtctccgatggagatgtagatcttgtgggccctgagtagaggtgacccttgtatgtcttaggcaggagaccgctggctttcactcttggcctagagccttgtggcctttgcgcttgacagcgctgctaagcggtctgcggggaaaatcccagggccagctctcggggccgggcggcgacctctcgttagggggccgcatacggaacccccggag

SEQ ID NO: 622349 - DNA, 133 bp, Homo sapiens
ctcatgtctggcgacctatcccccattctcctcctatccctcaagcccgactcgtttcctcttgtaaatatagtttaatactctgagaaagactcaaagaaatgctaactcatgcccaccatgtctaacaaaa

SEQ ID NO: 622350 - DNA, 1446 bp, Homo sapiens
tgggtttaatggtacaaccttggaaagttacattaagtgtgggtaagtgatctaattactatttaattagccatttcagaaaacacttttccctctcccctcccaacaaccactccggggggaaataaaagctccgtgaaaaggaggccagtttcaacgagtggccttctaaccgcgtggtgtagaaaacacaaaagagtgtgaaagagagagaaagaaaacacgagaaacactcacacttagagagagggtggtgtgccgaggtggtcctctctcgaggagagtgtggcgacgcccgtgagcgtgagtgcgccgagaggagctcaagtagtaaacaggtggcaaagagcgctgtgagcaagaacatgtggcaggatatgtgggacaggccgccggagtagagacccgtggcgcaggacccaaacaatatcttactcctctcaccgcgcgcggggacaaacatctcacaacatatctcacagagtatataggggtgtgtctcaggggggagaaatcttcctcttctcacagcacaggggggggtctccttcactctcgcggctgtggcctccgcgccaataaatatgttgacatctccgtggggtatctctcacaaaggtctcctgtggcatctcaaagagagaaacaccaagcggggtgtgtggtgccttgtgacagtgtgggcccacaggggacagcgtggggagagaccagagggggaagtatacggcccaaagaggcccaacaaaaaaaaaacgctctctcccgagggagactctctcgcgagagggggaggtctccaccaacacacaagcgtgggcgccccgtatcccgccgatttatctttataggcagaaggcagagcctatcacccgaagtgtggccaaacagaagaggccacaaaacgacagaggtccgtgggtcaaccgctttatatttagacccatgtgtgagccaggggtccctttctataccctgtggcaatattaatctgaagaaattccccaagagaaggggaccacgtgtaaggggcacgcatttaacccccctctttttgttcaaaaaaccgtgtatctggagaacgctctcacaaatttttccagggcaagagggggtgtgccggaaacccaacaggccgtcccaagagttgaaccccggcgtgcgttactcacaaaacggtggtattagcggaatgagacgacgcagcggggcgccacaatgagcgccgcacaacgaagaagaagaaaaacccacgggaggggtccccaagaaacgggtggcggaaggagctcacaccaagggagtgttcacaggaataaaaccccctgtgctgggggagacagaagtcggccaagaagacgcctccaatagtattcccccccatgtgcgacaacgaaggaggttttactaaccaactcgatatacctacccaacaagccagcgtcg

SEQ ID NO: 622351 - DNA, 438 bp, Homo sapiens
tgtatttctctctatctcttcatattgcttcccatctgcatcccccaactgacaaaaaaacatatcaaccatcaaactaagtgtagtacttgtgtaatatttttcatatctaggttctgagagaaaaatctttacaattcatttttataaatatttttatggaagtaagttatgggttataaggggatctgcaatcagatagggatgagattgttttgggggtcaaaaaaggaaaggaagagagagagatatagtgttagagagaaagagccagagggagagcaaaagagagagattcaaagaggttcttcaagggaaatagcacctatgctggatatattgttctgagagattttaggcaatgggagattatgcatgggtggttgttgacagttacgggtgtggagctcatccaagcagagtgttggaaatgagaat

SEQ ID NO: 622352 - DNA, 944 bp, Homo sapiens
agatatagtacctgcaagggtaggaacgatgaagaattataaccaagcataatatagacaaggactaacccctataccttctgcatgatgaagttaactagaaataactttgcaaggagagctcaagagctaagacccccgaaacgcagacgagctacctaagagacaggtaaaagagaaaatcccgtctatggtaggagaataatagtggggaagatttatgatggtagaggcgacatagatgcgtacgcgagtcgctgtggtgataagactgggattggtcacgagaagatagcaatcgttgagattgcgaaactatgtaagattgtgtgcccacaagaagaagcctagataattaacaaaagaaagaattaactacaaaagaaaacaagagtggaaaaattaaatagtgaaaaaagatataagaaggaggcaattaaaagaagacactgaaagaaacaatccagcgtaagagatgagtttgtgaacaggtatgggaaggaatttgaagtgaatttgaaatcaatgacttgatcccgaggcaggtggcaagaacaaacggggcttggtgccttttgtaaacctttttgacggaccagtggactcccgttgggataaagactttgtcattcaagaaaattaccatacgtggtggaaactggcaaccaaactgtgaagtttaggaaaaggccctgttcaaaagccaaggagatggtaagttgctttcatccaagacccaaaagaggtcgaagtgggttcctggaaactttggtgggtgggtcgcaggcacagtgggtcaccggggtggggaatgaccaacattcggtcgtgggagcgaaactttcagtggacacaggtgtcttagagggggggagaatacaatgagaggggtaaatttggggggggggggaagggtaaaaagaaggtggggaatgggggagaag

SEQ ID NO: 622353 - DNA, 150 bp, Homo sapiens
agcgggacgggggagaaagtaacagtaaatcataatagcctattaacctaatgggttggttcataaatcctattactatgagccctaatcatttccactgaggtcctgagtgcatagcttccatcccatctaagtgtatagattcatatc

SEQ ID NO: 622354 - DNA, 449 bp, Homo sapiens
  misc_feature (25)..(25): n is a, c, g, or t
  misc_feature (48)..(48): n is a, c, g, or t
  misc_feature (158)..(158): n is a, c, g, or t
gacctcgccgccctgcccgcgccgntgatgcaagccctggccgacctntaccagcgccgcatcgcgccgcaagtgcaccacttctggtagccgctgctgccagacactggcatttttcccagtgacaatctggccatgcagcaaccggagtgctggangacaacctcgaggtgctggccaagggcggttcgtcggccggcgaatggggtcgcgcggccaccaacgacctggtgcgcagcaagatcaagatcaagagcctgaacttcatgcgcgggcgcaccttcctgaacaagttcgtcatcatcgacgaggcccagaacctgacgcccaagcagatgaagacgctgatcacccgcgccggcccgggcaccaagatcgtctgtctgggcaacctggcccagatcgacaccccctatctgaccgagggcagctcgggcctgacctttgcc

SEQ ID NO: 622355 - DNA, 420 bp, Homo sapiens
  misc_feature (364)..(364): n is a, c, g, or t
cacgaggccaggcagtggggataccattccatcatgacgttggggtagtagatggcccatagcgtcccgtacttgggcatctcgcccccggtgtagcgcagcagcgcgtcgcgatagcgggcgtatttgggcgagccggtcttctgcaactggttcttcacgcccatgtactggatcgaccagcgcggcccgaactcccagcggaagttgcccgcgtcgacgaagtcccgcaggcccggatggaacggttccacgtggtagagctccaggtagatttcgagaaacgtcttccagttgaaggggcactcgtcgatcacggtgcggtcgtagacatagccgctgaagtcgtaatcggctgccgcgntgaagcccttgagatcttcggccgggtcccgggacccggcgaaaagcatcccgttc

SEQ ID NO: 622356 - DNA, 291 bp, Homo sapiens
gtgctgggtgatctagaggatcccgggcagtacggatgtgttggctctcttcaccttccgccatgatggtaagtttccggaggcctccccaaatgcagaagccggtgtagctggcagaactatgagccgattaaaccggtttcctttaaattaaccggtttcaggtatgtctttatagcagggtgagaacagagtaatacatcacccatccaatccattcatctatcttaccggaaacacaacacatccgtacacgggtacacgcgtccgaatccggggtactgggctcga

SEQ ID NO: 622357 - DNA, 237 bp, Homo sapiens
tcaggtactttccacaggtaggtacaagtagtgggatgctggatcaaatggtagatctacttttagtttgttaaggaatctccatactgttttccctggtggttgtactagtttacatttccaccagctttgtaaaagtgttcccttttcactacatccacgctaacatctattatttttgattttttgattatggccatccttacaggagtaaggtggcgttgccctgtggaaaag

SEQ ID NO: 622358 - DNA, 188 bp, Homo sapiens
attcgcgggcgcgttgacccgcatcctcagcttggtgtagggatcctacttgaactggtccttcaggcgggagaagagaccgccgcggtgcttgacctgcgagccttcagtgagggattcaccgcgcagggctgcgaactggcgcaacagttcacgctgttcttcggtcatatgtcgacgcgagcgcg

SEQ ID NO: 622359 - DNA, 651 bp, Homo sapiens
tgggttaaaacgggaataaaagctaccttgtttatttctaggcctactcaggtaaaaaatcaggtgcgagcttagccgctgtgatgagtgtgcctgcaaaaatgggtagagtagatgacggggttgggcgccaggggattaattgagtcacggggaaggggtatacaccaactattttcggggtgtatggcgcccagatagctttatttagaacactcctattttgggtgggttgggtttattacacccaaacctcagtgctatttttataaaattatgttaaagaatccacaggtcagaagaacatcttgaaccacaccatagaagggagaagacccccgcctagacataagatttggcaggttacgggccttggatcgccagtcgccagcccagttgtccccctcgggaaccatagagggtgggtgggtgggccgcacgcagatgtggcgtatcatatttctggctgtgggtccacagtaaggagttatcccccgaaatttcgtcttgtcctggggtcaccctgctatccctaaagcctatgtgtcttgtccctgtgtctcccagggtccccaggggccagtgcggggagcccagagccaccccattatgccgaaggccgccctaccccaccttcaggcagcctatggg

SEQ ID NO: 622360 - DNA, 112 bp, Homo sapiens
tggtgttctctgaggatcccgctccacccgagcgggtggcggcggcggtggacccttgtgtgtctgtaccgcgactggtgagcgggatcatgaatcgccccgtccatgctct

SEQ ID NO: 622361 - DNA, 873 bp, Homo sapiens
ctatgtagaggcttgggttttattggccgaggtgcgcgtgctggggttacatacggccactgtggcgggagtgtgctggctgtgctgccccgtgcacatcactttccttgtgctgcctccccggtggtgcatgtgactgggctgaactgatgtgctgctggactgtgacatgtgctgtgacatgcatgtggctgtgacatgcagtggatgtgacatgcatgttgctgtgttgcatgtggtgtgctgtgactgtgccactgtgctgctggttgtgtgctgctccctgtgctccctgcttccctgctgtcccctgacccaatgtgctgtgtgccctgtgcccctgccctgcgtgcctgactgatgctccctgtgtgccctgtgcctgccatgtgctgccttctacttccagtgattggagtgctgtccttgcctagatgcttggctgcttggcatgtggctgagctgtcttgttgcaaatgtgctgtgggctggactttcaatgactatgttgcgttgtgccctttctttttgaagtgcttgcttgttgcatgttgttgtggcacctgattgtgacctttgagaggacaacttgagtttgccaattctaaacatgcacatgcttggtgcaaactgcgctaactttctacctttgaatgtgagcactggccctgtgtgctggctgtgaataaccacaatgctattgaccttccttgcttggctgcggaccaatcgtgtgacctgccattgtgtggattgccaattgccagttggaaaaccttgtgaaacacactcaagggtccttgggggcgcttcgacgaggcttgccgtcttgctgacaagcggcgcatcttgagctatctgcccaagaagcag

SEQ ID NO: 622362 - DNA, 138 bp, Homo sapiens
  misc_feature (127)..(127): n is a, c, g, or t
agtatgccgaagatctgcttctttatcttttgagaggaacttagctagaaaagcgtgactctctggctgcactttacaattctcactgcagtcctgtttctgtttgcttcctaatcaagtcctttanttggaacacag

SEQ ID NO: 622363 - DNA, 138 bp, Homo sapiens
atactccacaacaggcacatccacttatgctttaatcactacttatttcttcttccagataatctcttctttctgcttagatctcttgtcatgagatctgtactttcaccaagagtgactgtttgtggaggtagcact

SEQ ID NO: 622364 - DNA, 101 bp, Homo sapiens
ttccttcttcccttttagtttcacttgaaattttgggggtcgtggttatttttatcgttgggatctttctgtcttctgggttccattttttcaatgtttgg

SEQ ID NO: 622365 - DNA, 177 bp, Homo sapiens
cagaaggcagaaagcgttggcagattatgcatcacacggaggcccggatcatgaccataggatgcagggaccgctactaaacttgacacggccaggcgagctgtcaatccgaagggtaattccgcatgactgggcctactgggggcaggcttacaacgcacgcagagcgcgtcgatc

SEQ ID NO: 622366 - DNA, 755 bp, Homo sapiens
  misc_feature (259)..(259): n is a, c, g, or t
aggaggggtgaaccgggccaagtcggaaacggaacagggcaaaactcccggtggctgatcatagtttactggaaactcaaattcctaaggtcaagcaatcttcctggctttggctcctggaatactaggaataaaggtggactccaactaaggcccaggctgatttttttttttttttttttggagagaacggggtctcactggcattggctaagtctgggtcacggaactcctgggcctcaaggtgaattctcctggnctcaggactcccaaaggtggttgggattacagggggtgtagaccagggtggctggtccctggacatccttttggaagcccctacagctccaacccaacagagaggcttatcaggggcttctcatatgaataagctggacactggaacatcattggaatatctaggctggctcaagcctggtgggcttaaaatctggggcttagaatatgggcaggggaccagattggagcatctggctgcaacctacactcaacagggtgtggggccaagggtaagcaggcctggctccctggtccaactggctccatattcacgggtgacatcaagggctccccatcacggtccggacacaccgaacgagggacagggaaaaccaccaactccccggatggtccctccgatggggggccgagacacggggcatgcacaccagttcgcgggaccacactctggcgacggcctgagaggggacggggcagccggccggcccccccgg

SEQ ID NO: 622367 - DNA, 1173 bp, Homo sapiens
tcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgaaaaaaaaaaaaaaaaaaaaaacctgggaaacttatttcttcttctctcccaggttgaccttaggcaccgggctctccccggggcccgctggggggcccccggtcttggtctattgctcctgtccgcgcccgcggggtgtcgcctactcaatgggggcggcaccgcggcgccaatgccaaggtggccccttgggagcccccggggtcctcacaccatatcttgtgtccccaagcgcgggctcatatggtaactgtggaaatgtggtctcataccccagaggtgggggaatatatgagagcctcttttcctctcacaacaaatatagcgagccggaacatatatttctcggaggcggcgggacaaaggtggtttgtcagcgtttcccgagggggacactctttaaagagtaattggcctcccagacaacatttttgcccagggatactcccgaggcgtgcaggtcccccagagagtgtgtgtccccccacggaggctttatagcctcccccagagatctgggtgtgtcccgggggagcagccccctttgggcgacacctgtttgggccccccgcggggcaacaactgttcttccaccgccggtttttcccacgggacaggagttctccagccgcgggttacgagggtgtttaggcgcccctcgggggaaattgttgttcccgaaaaagagaaggtctctctaaaaatttcccttgttgagagaccaccggttttatctgggggggaagaacccatcgtcaaaaaaagatgaacacgcgctcattgggagtatatcacccccacaaagaagaatgtcccctcccagtgtgaaacacccccttggagaaaacttgtaggcaccccactctggggggagaaaaccaccaacatgtgcaggctctgtcattccccctataagca

SEQ ID NO: 622368 - DNA, 815 bp, Homo sapiens
agtcccccttgaacgcacctcaggatggtccgtacttggaaccactagcaagagaagatcttgaaaggagtttggtagccgagactagtaggctgttgggagcatattctagtctagcaagatgcacacaagccaagatttcaggcatcacaatgagcaagagatatcccttcaggtctgggaatgttcttatccagcaaatccagctgagaagtctggaatgtatggcatcagagagctagatcagaaaagatggttgaacagcacagattagatccagtcatcacgtgcagcctcccatctaagctgttgagagcttgagagaagagagaaacagatgagggtactagcagagtgtagatctctgtggtggtcccacggaatgatgggtgcatgagtcaggaggaacttcgttagccgtgggctttgggcgtgtgggtttccgcgagccgagtatagcgaaagcacagtgggttgttgttggttgacttctcatattgattggtcaaaggataaatgtttgcaagagaaatgactaaggaaggaaaagaagaagaatggtctaaagatttttctctcaccaggcacttttactggtgacattgcaaaccagttaccatcgatttgttcgaaggcccgattgcctaaaaatagtattcggtggcgacgctcagtgacctggttagtctaaagattgggattaggtttgccggggaaaaaaaggctctcggggggaagccgaaaaggtgaaattcttagcgggggggcccggttccttggggcggaaggctggggagaaccggcccggacgttaa

SEQ ID NO: 622369 - DNA, 321 bp, Homo sapiens
gcacgaggatttaaagagaattcttaaggtcctaaagaaggactttgcatgtaatggtaacattgtcaaggatccagaaatgggggagattattcaattgcagggtgaccaaagagcaaaggtttgcgaatttatgatctcccaactgggattgcaaaagaagaacattaaaattcatgggttttaagttcaaggcttacgccgagtcgcttactcgctgctcgctttctttcttagtgttgttatcctatataaaacgtaactgtttagttatttaagtccaagtgcatatttacactataatatataatataacatctc

SEQ ID NO: 622370 - DNA, 223 bp, Homo sapiens
  misc_feature (185)..(185): n is a, c, g, or t
  misc_feature (192)..(192): n is a, c, g, or t
tcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaaggggaacttaaaacatactgtttgattttttnatttccncttacaatccatgttttcaggtagaattatg

SEQ ID NO: 622371 - DNA, 340 bp, Homo sapiens
ccttgtaatcgggctgtctgagcgctgggattgagacctgggggatgtggggtctcggtgctgcggagtcacagtggcgtctgtgcaaagccccagctggggggtatgattcccactggacctcaggaggaaacggctgttctgaccttcctggagctcgtgggaagggagggggtgtctcgccccgaagccacagtcgcctgagcgtgaagcgagtgtaagtgtggttttataccacggagtctgtctagaaagtagcatggaactttaggaggccgaggtgggcggttcacgaggtcaggagatcgagaccatcctggctagcacggtgaaaacccgt

SEQ ID NO: 622372 - DNA, 871 bp, Homo sapiens
  misc_feature (2)..(2): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (361)..(361): n is a, c, g, or t
  misc_feature (384)..(384): n is a, c, g, or t
  misc_feature (391)..(391): n is a, c, g, or t
  misc_feature (407)..(408): n is a, c, g, or t
  misc_feature (411)..(411): n is a, c, g, or t
  misc_feature (415)..(415): n is a, c, g, or t
  misc_feature (431)..(431): n is a, c, g, or t
  misc_feature (452)..(452): n is a, c, g, or t
  misc_feature (535)..(535): n is a, c, g, or t
  misc_feature (594)..(594): n is a, c, g, or t
  misc_feature (781)..(781): n is a, c, g, or t
  misc_feature (785)..(785): n is a, c, g, or t
  misc_feature (790)..(790): n is a, c, g, or t
  misc_feature (871)..(871): n is a, c, g, or t
tntccaaaaaaaaaatctacattaaaacccttttttcccaatcctttacactttccacaaaacaaaaactaaaataaccttttatacaattaatcacaaatacaatcctcaatttttttccccatacacataattatttttctaaaacatttcttctttttaacacctaccccctcccaccactctccttccctcaattcacaaatctattctaacctctaccttccctttcacttctctccctctcctctcctcctaacctttttttcctaattaaaatcttctcccactcccataactactccnccnccnccaacccccatacccaccttcctttcctttttttccaaaatatttcccnccacccccataacccccacaccntctcccnccaaaatttccccccnncanaccnccaaaatttcaaaacnaattcttctaattcccaaaancattctaccctccaccacctccaaaattccctccactaccacccccaaacccccctccccctcccttcttatacctatcatanccccactcccaccataaccactaccctggtttccataaccctgtccaccacttccatancctctgcttcctcctgagtaaccagggccgcctcctccataaccaccatcattaccaaatccattatagccatccccactgccaccatatccaccaccaccacggctgccaccaaagccaccacgaccactgaagtttcctccacgaccgaagttgtcattcccaccgaaaccacctccacgaccancacnaaagnttccagaaccacttcggcctcttttggctggatgaagcactagccatctcttgctttgacagggcttttctaacttcacan

SEQ ID NO: 622373 - DNA, 985 bp, Homo sapiens
ggagcagccccccgtggagacccctacagacgctgctgtcttgactcacccccagcacctgcgcccccggatgacccctagcaaacaatggccggacacacagacctgagaagaagccatcggctcttggcttgagacatgctggctgccaggccctgggagcagtgggagcagctgaaggagcagtgagcggaggcttgcaggcagcaaagttgacaagcgaattgcggcagcattgagcaagcattggcactgtgtagtgccgagtgccctgtggctggcagcgtggagcgcgtgacagcccgtgaggctgggatggatcatggagtgcccccgcagacgcagaggcggcctagtgcgtcctgatgcaattcacgtaacgcacgtgagcgtgcctgcaagacaaggccgtaacacactgcatgtgcagggcactgatagccttcgatatctgtctgtgtagaaagacagaggcgtgaagacgtggcaaagctgatctgtggcaatgcggcgtgaacacagccacctattccaatgacacagcctcagtggcaggccaacgtgatgatcgtgcaaagacggacagacaacacaaaggcggttcgtgggaagcgacaggaatcccgttcacgcaggggaacgtcggagacgaggactccacgcaaggtcccttgcaaacgacacacaggaacgacagtgaacaagaccaaggcagagcacacacgtcccacacgggtaacccagacccacacatacctattaaaacgactgtgagaaggactcgagctccaccagatgaattgcaaaacgtacggcttggtcaaaactgagtgaagccatcccaccagtatgcctcagatggcagatctccccaaagcgatagaaaatggcaagaggatcactgatgaaattgacgtacacacgtctccagacacaccaaggagaaatggattatcaaaccaacggagccatgtgtgtaacaaca

SEQ ID NO: 622374 - DNA, 291 bp, Homo sapiens
gtgaggtatgtcccttggcagagaactgaattggcccctcggcctctgtatgtgagagcagcccagccacagccagtgaagaaacatcccccatgcactgaggcacatcctccttagagggagaactgcctgcaggtttcggcaaagaaccaaaaaaaaagggcctgccagaattcccagctgattggaaagcagcggacagttcttcagccagagggtgagcaccaagtgtctggcgcctagatgggcccgtccaatgcgcgtcactttccagttgagtccagcaccttt

SEQ ID NO: 622375 - DNA, 151 bp, Homo sapiens
ttcctagaaacacttggtagactacattggtgacatatttgcatctatgtcacactaaggtacagagcagcaattagtcccaggatcgcactagcaattctagtagacagggactggtagacagcaaccactacatagcttcctaccaccc

SEQ ID NO: 622376 - DNA, 153 bp, Homo sapiens
tgtgactctaaggatctcaccatcgtcagcggcagtcgccgtcttgcacggccttggcgatacccaggtatgtcgagccccagcactacatagaccatatagcaatgccagcgcgacaaggccaccccggggggcagccgcatacggatagag

SEQ ID NO: 622377 - DNA, 975 bp, Homo sapiens
gcgaaagcaagccagaaacagtagatgccattgggcgcaaactaactggggcgccaagacaaggggaccgggccccgggagcacaaaatgggggtcccgcaccgttgacagaggaggactaaccggcgcggggtgtacaaacgccgcgaggacaatatgggcggcccggtgcaccgccagaattgagcggcctcggacaaggggcagcccctcctgccgacgggtgggcccccccggccggcaaccccaggggttccgacagaccgccgcgcggccgccaagagttcgggctggaggtgtcccacggcggtcttgcaccagaagagggccccctccacagaagtgtggaaagcggctaaagcaaacgttggtcctcagcaggggggccccgcaaaaacgtcagaggcaatagaatccaactcgtctttgtgaaaaagtctcttcttcttgaaggcggccttctcttcaggtattcctccatgaaccatgcgcccgccgctgccctctccaattgtttgagaacaaccttgttctggttgtcagtccgcccccacgttggttccacaacacgtcaattcaaccttgggcccagacaatgatatagtggtgacaacgctgtgtctccccactacaagatagccggccaaaacgcagcgggtggtgtaaattgtcgtggcaaaagcaagagggtggtatccccagatggctttttaacatcagcagtgcaatcgggtgtgtgtcgggggtaccaccacgcctttgtctgctgcactacccgcggttcctcgctgatatacgccgccacttaacaccgtcgctcctttagactcccgtaagtgggaccgccgacaatagtggagaaagcagtcttctatacctgcggagaacgagcgcagagcgagctcgtctctcaatgggagaaagtcaaactgttgctctttctctagaccacaaaaaaaagaagccaccaataca

SEQ ID NO: 622378 - DNA, 618 bp, Homo sapiens
cctcctgagcaggccccagactagttgacgggcccgaacataccaactgtgtaggtatgattgaagtgtattagggcgcgcttatagaacttgcagaggctgtaacaacatgacagcgagcacgtgttatgaggaagagaaaagagtattatactgttgacgtctgaacctggcacttaggatgattataacaacagagggagtccatattcgacagcatggcgaagagaaagggacgatttacacgtttgagatcaggcacaggctgcaggccatgcttatgccctcagggactggcagcctctggtatgcaacaggctgagctggctgcagactccgcagcgtacaccgagctggcccagtgtcccacgagttctcaccctgtgccctggcagcagacttgcacagaggccaccaagactgcccctgtccatttagaggttggcccatgaacatatggcctgaaatgtatgtccaataccttgacaacgacttttagaccctactgcaagcccttcccccatatatctgcaaagccggggaggctctaccagtaggagaaggaggactcccggaggctctccaagggacctcactctctatcgcgccaactaaaga

SEQ ID NO: 622379 - DNA, 490 bp, Homo sapiens
catccgtccattgcagacacgaggtttgaaaacttaccagcaagacggtccagtgcatctatctgcatcagcttcatcacgtcgaccggccagggcaagtgggtacggcataatggcattgtgctgcttgctgccccaatggcatggaaggcatgggcccagagcactcgtcagggagccccgaaagggttcctgcagataatcaatgtatggactcggatgcctacccctgcattcaccaagtacttcgagggtgagccagctcaaagcccaggacttccgtaactccgatgaaggaacccggttgccacacggtgtacggggcctggtccacggccaaagacttgattcatagggcacacacggtccctgcgattcaaccatcctggcattgcagaacatggtgccggtgactgaatgtgcccttcttccaatcctgcccgttgacccgaacgttgatgccttccttcaagcagggaagccaaaaggc

SEQ ID NO: 622380 - DNA, 114 bp, Homo sapiens
caacagctcatgggcttatctcacaagactgttccctacttcagatgccagttccaagtcttgggtgcctgggcacccacacttctgtccaacttggctaccaaccagtggggt

SEQ ID NO: 622381 - DNA, 227 bp, Homo sapiens
ctggccggtaagcggccactataaattggttctaagtatgagtcatttcttttttgcacattcttttacaccatttttattagagtccacatattagcgatctcatatgatgtttgtctttctctgacttacttcacttagtataataatctctaggtccatccatgttgctgcaaaaaagaatgaaagaataaagacttttaatcaatccaacaacagtttgtgtc

SEQ ID NO: 622382 - DNA, 391 bp, Homo sapiens
ttcggcttttttcagggaaatttcaaacatttccccatttttactttgtcctcataaaaactttaaagggggggggagcaggccattttgtttttgaacggtaatttgcttaagctttttgcattgggcatttaagggagaccctatgtattacagttgttggggggccgggtcccattgttgggaaggtttttagggaaaagacttttatgtttgttgggccttgtccaaagtttggggtaggggtcaaaagattgggttccagtcccattttttccatttaaaataaaatgccctcaaataagttggtcggcatttttagggttgggtttcctcatttgtaaaaaaatgaaaacccccccttcccaccattaaatgggatgataatgca

SEQ ID NO: 622383 - DNA, 205 bp, Homo sapiens
cagcactgtggtgtgacgaagccaggggcgtcagtagtcgtggatacgactcctgtgatatcgccgaaatcgtcgagcgacggttcgagcaccaagtgacgtcgtacgcacgagcccgaaccgctcgccgatgcgcacgcaggcgagtcgccgctgaaatcccacacggcgtcgaacgagggttcgcgcacgatccgcatctcgt

SEQ ID NO: 622384 - DNA, 436 bp, Homo sapiens
gctgtgcccggatctgattgatggtgtgctcagtagactggtcctcgcgagcagggtagtccatggctctgtggaaatcacggatccgacccgagaacacaaagaaacgcactttcgtggcagccgacggtaaatcctatcaagtgccaatgctggcccagctctccgtgttccggtgtgggtcgacaagtgcccccaatgatttatggtacaacttcattgaactgccctagcacggggacagcctcagcatgctgatggcactgccgagtgagagctccaatccgctgtctgccatcatcccacacatcagcaccaagaccatagacagctggctgagcatcatggtgcccaagagggtgcaggtgatcctgcccaagttcacagctgtagcacaaacagatttgatggaagcgtcgcgcatgggtaccgagct

SEQ ID NO: 622385 - DNA, 752 bp, Homo sapiens
cttgggggagggcgtcactattcagcttctagtgtggaggcatgagaaggccttggcctagccctaccaggtcccatactgtgcgaagttatggaggggcaggtactggcctttacctgggtcagcctagggcaaccaggtgaggggcacaggtgtgaagccacgcccccaagcccaacccagcacggcaacacgaggacaggagacggaaatcaagctaaaggtagtacagggaccagcgatgaacaaacaacaacacaaaaaacaaaaacaacaacacaaaaacaaaggcgcggcgagcgaacgcacacagagacgcacaccaccacacagcagaacccccccacaaaacacaccgcaaccgccctggacatcacatacgcgatcacgacaacaacacaggagatgaagaacacagacaccggcacgacgagagaccccgaacttgtaaaacgccagcgacgcgaggaagaacacggcgcagcgggagagagcagccgaccccgacgcaaaagagagcaaaacactgacagcgtacaaacgccgaccgcaccagaaaccacaagcgacaccaaacaaaagcggacacaagaaggagcagacgcaccgccacacaacacaacgaaggacagagacccgcggcacgaacaaacgagagaacacaaacaacaaacacaccacgcgcaccagacgacacaaataccccacaacaactcacacccaccggaagccgcaacacaagccaagcaaca

SEQ ID NO: 622386 - DNA, 114 bp, Homo sapiens
gggatcggaccctctctgtatctctgcacgtgcacactcgacatgcagtcgacatgcatacacactttgacagcatacaaggagacacgcacagtggcaaggaaagccgtatgc

SEQ ID NO: 622387 - DNA, 248 bp, Homo sapiens
gggggggcccccccccccggggggggggggggggggggttttttttttgtaacccccccctggtccccccccccggggtcccccccggggttccccggggggggggggccccccttttggggggggggggggcccccccgggggggggggggcccccggccccgccccggcccccccgggggggggggggggcccccggggggggggggccccccccccccccccctttattttttggggggggaaga

SEQ ID NO: 622388 - DNA, 197 bp, Homo sapiens
ctcatcagaccctggcagaagcaggaagcatggctgaggcaggagaatcgcttgaacctgggaggcagaagttgcagtgagccgagatcgcgccactgcactccagcctgcgtgacagagcgagactccgtctaaaataaataaataaatgaaaaaaatgcacgaaggggccatgacccggtggcagaagcaggaag

SEQ ID NO: 622389 - DNA, 250 bp, Homo sapiens
actagttcaaagatagaaagatatagtcttaccttatggatataaaacaaaatctcaagatacaccaaaactgttttagcttttactgaataatttttgtgcatatgtgtttagctagcaagtgcctaacaagctgtgatataactattccttacctttccctatataaattatgtcttgagacagccttggactgcacactacattctactccatccttcagcacccttccatctctacctatcatctt

SEQ ID NO: 622390 - DNA, 1736 bp, Homo sapiens
  misc_feature (1205)..(1205): n is a, c, g, or t
atgcttgccctctctcgtgtgttgatcttcctcgcatggtgaaataggggggtgttgttactccctgtcactggaggtaggcttcttgtcgccgcgcgcgtctgttcttgtgggacggagcagattatcttgccttgggtgcggaccagcctcctcggaggattatcctctcttgttcttacaccctccctactttcctatgagggggttgactggcttggtgaattctctctccccctctaaagagtccgcttgtgttggcgcctccacgactcacacacagggtgttattttttttgtgggggcgacgcagccgcaccccccaccagatgtttgtcccccgctggcgcgcatgtgctctccctcgacacggtggtgtgttcccctccatagaggggagagatcgtctccactgctccctccgctggtgtgacactctcctctcgtccgcaacttctgtgttatgagtggttttcccaggagctttcccccttgtggtcctcccttctccctggggggccccccatgagtgtgattctcctccgctctcgtgtggggggatttttctgggccgtcgggctgatctacacaaaacgccctggggggcgctcttactctgtgtgttccccacaccgcctcgtttcctctccgcaggccacagaaattgtggtgagtgatcactgccccaacacttccaccgcggggtggttttttttgaaccagcggagttgatctcgcgggcccctccctctcgccgctattggggttgtccccccccccccggcgccacaaaggggcttgatttttaaaggcggcggggactaatattgagatagttttatataggtgtgggccggcgtgtataacacaccccccccttgttttgttgtggtagacaccacaacaaactctcttgatacatgtggtggcggcgcaccacagtgttagcccacacacagtgttgtgagaggaatttggtgcgcactcggcgtgcccgtgtatatatgtgtggtctgttatttctgtttgtgtgtgttttttgtggcgtgtttgtgtttgtgtgtgtttgttgtgggctcttgagacctcccaccgcggagatttttataaaaaacatctgtggagacccgcggtgtaaaaagggtggacacacagcccacacgtcgcggttgggagaggcgaggcaacttctcccctccaaaagngtttcacacacacatggggtgccccgcgagagagaccttttgagattgcaccacagcttgggtttggttttttgttataataaaggtccacagttctcccacaataatgagagagatgcggtttgtttaccacaggagaagttcccccttgccacatctcctataatagccacctcccaccgttcttcttttataagagaggaaatgtgcgccacaggtctctctcttctccacaagttctcacacacacacaggggagaggtgaataagcacacttgcgtttctggggaaaatataatggataacgccaaaatttttttaaatctttctcgcccttaataccttttttaattttgttttaattttgagaatgaatgaggcccttctgtgccccccccttctcccccttttttgtccccccacattgagaagtatgaaggcttttggtctccctgggagatgggtggaggccacccgggcttacctgtaccctgacttgagaccccgttgaatataaagtgcacccccttt

SEQ ID NO: 622391 - DNA, 300 bp, Homo sapiens
ttctatcaaagagagattctgtattgcgatccaaagctttgttctctatgcctttggcaggagagttgcttgaaccggggcggtagaggttgcagtgagccgcgatcacaccactgcactccagcctgggcgtcagagagcgactccgtctcaggaaaaaaacagtaaatctatccaagcaacctagcaattcctttcccaggtatatacccacagagaataagcactgaggttctccaaaagcacgtacaagatgtacactacagctttcttcataatagtcaaaagctggaaacagct

SEQ ID NO: 622392 - DNA, 183 bp, Homo sapiens
tcgatgcgagcacacggctgagcgtacgtgggaacgtacgagtggacatacgtgggaccgagcatgtgagcatccctgtgaccgaccgtgcgagcctccgcgtgaccagccgagagagcttacgtgagaccgtacgtgagagcatgtgtgtgtccgttcgtgcgagcgtgtgtccgtccgagt

SEQ ID NO: 622393 - DNA, 119 bp, Homo sapiens
ataaatgacaggaggccatgagaaaaggtaggaatatgttgcagtgaaaaaatgctaatgtcaatggagagaattacacagatgggtggaatattaatggagaggatacagtcgggaga

SEQ ID NO: 622394 - DNA, 813 bp, Homo sapiens
gggaaccatcagattgtacgacacggcacgttccagaggaagaatctgggcccagcgaggcagactggtattactgcgtgatgcggaatgaaagaacgaatcaggaattgaaagacgatccaggcccatctgtcgtaggccagagggtagaaccaccagagatcgtatacaatctgaggcaactgacacgcacacggctcccgaaatattcaggctggcccagaggtgcagcaagtgtgggcgtctatggacaaattccaggaggaggttatactatgcatatgagggccctactaggagccctagcataggatcgataaatatcggagcagcataagtgcaggctatccagttgcagttgacgggaggaggaagagttgagtagcggtaggatcaacagcacagatggatgaatacgtgtgtacatagtgctcgtaccaagaagtcctcttgcaatccgaaagcatagaatatacggcataagagaatgccatatttcgagggtcacacacacgatggtatgacaacaggagttaccacatgctgagcagcaaggcccaaaagctcaaacgccctttctaccttcacctagggtactacgaccttgggagaagcaacaatcttggcacaggcaacttcagatccggtgacattgcgcaccgaaaaaacgcgctcttgaggactgtgaaattgtcaaacggcaagatagggtagcgcatacacacagatattgcagaaaaggatggccctcgaacatgggtgtaggtcaccacgaaaagaggggaatggctctacatctcgatacctgagtcg

SEQ ID NO: 622395 - DNA, 1043 bp, Homo sapiens
gctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccttgtgctttcctcaagctgcaggcttgatcccagcccacaaatatgagagaattctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtgggctccagtgggtgtttctactctgccagtgagaggcagcccctagaaactcttcaggcgtatggaaaatcagtcaaatgagatcaggccccccaggggcaacaacagagcactaagagctctgaaagacagtaagaccaggggagcgcttagaatccccatggcatcggaaagggcacgaaggggaaagggagacaaaaggcccgacagggaacaagcccagggagtgccaaccgacgaaaatcggagggtcgggatacgccagggagcgagacagagtccagaaaaaagaccccaaggtagaaagaaccacaagaaggagagggggcgcccacaagcgtcccaccagcgaaggtgtaaaacgcagcaatcaatagacgagcagatgaaacaaccaacacacacacgtacatagttagcctaccccctcctagaccactctcagctgatactagtac

SEQ ID NO: 622396 - DNA, 286 bp, Homo sapiens
agagacagtgcaggtaacgggatgtcaggctgtgggaccagagtctgcaatgccaaaccagcaaggttatgataggaaaataacaccttctgtgtgtttaagggaagtaactcttttttttgagacagagtctagctttgttgccaggctggagtgcagtgacatgatctcagctcactgcaacctccgcctcccgggttaaagcgattctcctgcctcagcctcctgagtggctgggactacaggtgcatgccaccatacctgactaatttttgtatttttagta

SEQ ID NO: 622397 - DNA, 814 bp, Homo sapiens
gtagggtgcacgtgcactgagtctacctgttcgggtgcggtgtctcagtgacgatcgcggcgccgtcatgattatctttgcgacctgagagacagaataccatacaaaggcaggctggttggaggtattggcctcaggagcgccgggtccggttgcagcctcgaggtgcaagcgtatgattattcttaaggtgcaactgagaatgccttctatgctcctcctgtgctggtcctctctggctagttcgggaagatgtgctcggcaaggcgaagtatgatgattatcgcacatgcatgagagaagacactagcaagcagtatgatgcataactggattgatgctgagattctgaggacgttcactggaacattctgtgacggagtcgcctcagcgagctgatcatcactgaacatgacgaggacgaggccagcgtggagtcggaagggcaggatgagagccgctaaggtgattaccaatgatggcgcataccccgagggagggacgagtacgatcacataggtgcagccatgatgatgaactgcagtgaactaggcctgggtgatgaagagggaccagatagctgttctatacaactcttaaagatccgagataaacgagtagtctgatgtccggtgtgatgaccgtccggaaacagattgaggagcaagttatggacctagcacaaattttcgatggttgatctggtggtgcccgggcgtataatcaggaacggtaccatggtcggggcaaggagattaaccccaggcgatgttggtccctgtcctggtcattctggggaacagcttagggcacc

SEQ ID NO: 622398 - DNA, 348 bp, Homo sapiens
  misc_feature (75)..(75): n is a, c, g, or t
aagcgtcagaagctggaagtcgcgatccccaagggcgtcgacaatggcaaccgcatccggcttcagggtaagggngaggcggggccgaatggctcgccggcgggggatctctatatcttcctgcatattaagcgccatgcggtgtttgatcgcgaaagcacgacgctgctgacccgtgcgccgatcagcttcacgacggcggctctgggcggtcagatcgagattccgggcatggatggcgtcaggcacgtcatcgacattcccgcaggcatccagaccggcaagcaattgcgcaagcgcggggccggtatgccggttctgaacgggcgcggcatgggcgatatggtg

SEQ ID NO: 622399 - DNA, 704 bp, Homo sapiens
gcgaacccgggggctgcaagccgcgggcgggcgggcgagcgagaggaagcaacaaagacaggctgcagctggggctggcgaaaggggccgcggccgccgggctcccagcgcgggcggagagggcgccctgggagcggcgcgggccgagctgcagccttgagcgggggccccgtaggggaggcgcagcgccgcccggccgggacgtggcgatcacgggccccgggcgaagatgcgtcgccatgagcgcccgcgcgggccccgtcccggggcgggcgtgaccccgtgctgaacggaggacctccccttcccccccgacttcgggacggcgcaggccgggcgccgagggatagccctcaccggacagcgcccctttcccaccccgggagagagggcatctgacccccgagggagggcttccttcgagggcagcctctgccactccttgctttggcttgcgaccccggtcgagcgggaggcgtcgatggtaggcgtgagacctggttgcccttcgacgggcctggcttgatccggggaccccagtcgctagagcgcaccccattgggggacccccagctcagccatgctggcctgtctgcagaggacccagaacgcccgggccaacacctggcctgcccgagcatgagccttgagctgcgcaagttcgaaggcggttggcagcgccatgcattcctccgggtacccga

SEQ ID NO: 622400 - DNA, 284 bp, Homo sapiens
atacagtcagtacggatagcggttcacgcgcatcggatacttacgagcacgtgatgagatgagtatgaagtagctcaacttcagaatcgcggatcgggtacgatatgaacgcgcttggcatcaggcacgcatactgcgagctgacggactgcgcagcaaaacccgtgcgcccgagtcggtcattatgtacctcgagttgacggactcttggtcaacttcgtcgccgtgacggtcgatgacttactctttcgagaggttggccatcatcgcctaggacacttcgt

SEQ ID NO: 622401 - DNA, 484 bp, Homo sapiens
ggacaaggagtaagatctggtgtgaaattcagcttaacttatagagatatgacagtatatatgcgctactatgaggaccataccattctgctacaaactgcagcatccctgtgttagaatccttcactgctgaaggtgtgggctccttttgatgctctctgaatactcttcaagggtgcacactcatcagaatgttagtcccaattcagtgctttcattcctttaagattagaatgtaaactaaaatgtggacagtcccgtcttggtcacttctctgagacaacagattaggcaacatgatattttcatcatgtcaagtctgactctgactcatatcaagccaacaataactagtttcagtgcggaaccagataaattcctattggaaggtatccctctgcagagggcccagatggcagctcccttcccaggtaatgtaggccgatggtctaaggaccgagccgagggctttcaggtgcatcct

SEQ ID NO: 622402 - DNA, 587 bp, Homo sapiens
  misc_feature (334)..(334): n is a, c, g, or t
  misc_feature (422)..(422): n is a, c, g, or t
  misc_feature (429)..(429): n is a, c, g, or t
  misc_feature (524)..(524): n is a, c, g, or t
gctccacctgtgtgctggctggcatggccacagacttcgggaacatgcctgagcagaagggtgtcatcagggcggagcacggtcccacttgcatggtgcttcacccgttggctggaagtccctctaaaaccaaacttacatggctactcaacatcaacctcaaggggtggctgcccaaaagcatcatcaaccaaatcctgtcccaaacccaggtggattttaccaaccacctgcacaagcgcctggagtcccaccctgcctctgaagccaggtgttgaagaccaacctgctattcccaactgtgcccaactgcactggtacacacactcatcangagaatccctactggaaacctgcaaatctaaaatctccatctggtgacagtgggatgggtggggttcgagtttaaagtatgacactangattcanattggtgaaagtttttaataccaaaaaaacacggattaggctcttagatttaaaaggaacttcattcacttattaactatgacattaaggttcangccccttaaataaatatgaaactttttttcttgacccttatatacccacctaaaaccattttt

SEQ ID NO: 622403 - DNA, 232 bp, Homo sapiens
cctgctgcaggaagctgtactttgcgcatcacggtggaggactcaaacgagcaggtacttcataaggccaggaatttgccttcaccccaggctgagaagggcctcccccagctgtgtctggtgatcatcgacaagtacagtaagattcgcagtactggacatccggggcaccacgtgcaccccgcagaagtgtgtgcaacggccgatctaggcgagccagcgtgcgctgctc

SEQ ID NO: 622404 - DNA, 511 bp, Homo sapiens
  misc_feature (35)..(35): n is a, c, g, or t
  misc_feature (61)..(61): n is a, c, g, or t
  misc_feature (85)..(85): n is a, c, g, or t
  misc_feature (87)..(87): n is a, c, g, or t
  misc_feature (100)..(100): n is a, c, g, or t
  misc_feature (108)..(108): n is a, c, g, or t
  misc_feature (112)..(112): n is a, c, g, or t
  misc_feature (116)..(116): n is a, c, g, or t
  misc_feature (119)..(119): n is a, c, g, or t
  misc_feature (124)..(124): n is a, c, g, or t
  misc_feature (130)..(130): n is a, c, g, or t
  misc_feature (136)..(137): n is a, c, g, or t
  misc_feature (139)..(139): n is a, c, g, or t
  misc_feature (144)..(144): n is a, c, g, or t
  misc_feature (154)..(154): n is a, c, g, or t
  misc_feature (158)..(158): n is a, c, g, or t
  misc_feature (162)..(162): n is a, c, g, or t
  misc_feature (175)..(175): n is a, c, g, or t
  misc_feature (186)..(186): n is a, c, g, or t
  misc_feature (195)..(195): n is a, c, g, or t
  misc_feature (203)..(204): n is a, c, g, or t
  misc_feature (207)..(208): n is a, c, g, or t
  misc_feature (215)..(215): n is a, c, g, or t
  misc_feature (218)..(222): n is a, c, g, or t
  misc_feature (250)..(250): n is a, c, g, or t
  misc_feature (252)..(253): n is a, c, g, or t
  misc_feature (268)..(268): n is a, c, g, or t
  misc_feature (284)..(284): n is a, c, g, or t
  misc_feature (300)..(300): n is a, c, g, or t
  misc_feature (311)..(311): n is a, c, g, or t
  misc_feature (313)..(313): n is a, c, g, or t
  misc_feature (318)..(318): n is a, c, g, or t
  misc_feature (357)..(357): n is a, c, g, or t
  misc_feature (363)..(363): n is a, c, g, or t
  misc_feature (371)..(371): n is a, c, g, or t
  misc_feature (386)..(386): n is a, c, g, or t
  misc_feature (390)..(390): n is a, c, g, or t
  misc_feature (416)..(416): n is a, c, g, or t
  misc_feature (422)..(422): n is a, c, g, or t
  misc_feature (442)..(442): n is a, c, g, or t
  misc_feature (507)..(507): n is a, c, g, or t
gcttatggttatgccaacattaacagactagtggnataagccgtcgccggggggtcgcttngggcccgcctttgggttcccggcncntcctccccccccntccctgcnaaanggcnggnccctncccccntcccanncngtggnggttagtggntagnggtnctgccacccggcncccccccgggntccggtttnggccgggnntcnncggggtntgnnnnnttcccggccaccccttcccttccccttncnnggggttggggccccngccttcgggcgggggntcccggggccccgggngggcccatatncnccccnggccccccatggggccagggggaccccgatggggccccnaccctncgcgccgncgcgcgtcgcgcggngtcngcatagagttatagctcaacaccttntggaantggtagcagagacatttgcnaatatctaagtagtttcttttatagtttttaattaaaggttgtataataaaacaaatagcctagnggct

SEQ ID NO: 622405 - DNA, 800 bp, Homo sapiens
agcgggcattgcgcgccggtcctgaccaccggtgaacggacagtcccccccagaacactctgctccagacaaaggtggtgagggcagctgttcctaaacagcgcaaaggcagctaaggttggtgactttggagatgcaatctaattggcccactacctggagagatagcccacgaatgagtgttcagccatcatgtcccaacaagccatcagcgctatcccgatagatagcatgccgacccaaagtaaggacgatgaaggaacgaggagaaaggagaagggagtgatagtaaggagagtccaataataggcaaagtcagagtgaagtcatcgggaggaaaagaatggagatgaggattgccagcgaggcgggtcagaagaagaaaggaatttaataagcaagtggggtatccattacaaatagacatgaaggcctgaagtgcccagagaagaaactggcttcgagcgcacccgactcgtccgaccggaggcctagatcgcatacctgccaatcgcggagagatcaaagggtctgagtctggccagcctactgtgcccggtggtactcccccccaagcccagactggacagcaaagatcaaacacggagcctgcgctggcaagaccagggatgagaccatcgagctgtgaagagtgatgggggctagagtggaggcgacgagcttccttccgtgggcgtggtacgtggacgtgagccgcagactggggcacagcgcgcccggggtggccattcgtaaccctatttggaccaccagttagggctaccgctaagttcgatggc

SEQ ID NO: 622406 - DNA, 275 bp, Homo sapiens
cggctcccctcctccgccgcagccgtctttctctgctctctgcgctccgcttctttctcttgcctcgcggccgcaccctctgtctcctctcctcttcttttttctggcgttcccctcggccctcgttccttgtggcctcctctgtctcctgtcccctgccgggtttgctgtccgggtcggtgtccttgccgcccctctcctcccgcttcccgcggcgatcacagctcatcagtgccgcagctgcgtcggcggagggggtaccgcagctcgcaatc

SEQ ID NO: 622407 - DNA, 847 bp, Homo sapiens
  misc_feature (33)..(33): n is a, c, g, or t
  misc_feature (84)..(85): n is a, c, g, or t
  misc_feature (100)..(100): n is a, c, g, or t
  misc_feature (106)..(106): n is a, c, g, or t
  misc_feature (112)..(113): n is a, c, g, or t
  misc_feature (124)..(124): n is a, c, g, or t
  misc_feature (126)..(126): n is a, c, g, or t
  misc_feature (128)..(129): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (149)..(150): n is a, c, g, or t
  misc_feature (154)..(155): n is a, c, g, or t
  misc_feature (165)..(165): n is a, c, g, or t
  misc_feature (392)..(392): n is a, c, g, or t
  misc_feature (394)..(394): n is a, c, g, or t
gctcgaccaagaagatatgagcctttgacaaanagatccaccatgatgcccagttccagcagcctggctgagcatctggttganntcttgggaagataancttctntacatnnatgtcaacaanangnnatgancnttngacaaaaagnnccannatgtgcccanttccagcagccttggtgagtcatctgatttggctcttggaaagacaaacttctctacatgaatggtgaaagtcagaaacagggtatgagccattgacaagcagacccactatagttgcagtttgagccttggtaagccatctggttgaactcttggaaagttaaatttctctacatcgatgtcagcaacaaagtatgagccattcacaagaagatccaccatggtgncnatttccagcagccttcgtgagccacctgcttgagctcttgggagataaccttctctacatcaattctggagagaggcagcatgctacagtttgggtacggtttgttggtcctgccaggtttcatgttgaaatttgaccccctgtgtggtaggtgggacctggtgggagatgtttaaaccatgtagggtgaatcccgtatgaattggctgggtcctgccccccatagtcatgagtgagttctcattctcagttttccaggagagctggtttgttgaaaaagaaccctgggaactccccccccgctctctctatgttcctttctgcccatgtggtctctccacacaacaatgtcttcctttcaactttctgttcatgactggcgcaaggggacggttctcaccaaaacgaggtcaaaaccacggtcctggacaactgggaacactttgagccgaa

SEQ ID NO: 622408 - DNA, 168 bp, Homo sapiens
agtgacttggacagctttgggaggagattcaggctgactgggtcattgcgtctggctctcactgggttccgtatttcacattcatagggtcctgcactatatttcgtgacaccgaatattaacattctcctgatggttgcacattcttccatatgtgttctgtgttct

SEQ ID NO: 622409 - DNA, 740 bp, Homo sapiens
  misc_feature (30)..(30): n is a, c, g, or t
  misc_feature (67)..(67): n is a, c, g, or t
  misc_feature (144)..(145): n is a, c, g, or t
  misc_feature (152)..(152): n is a, c, g, or t
  misc_feature (162)..(162): n is a, c, g, or t
  misc_feature (176)..(176): n is a, c, g, or t
  misc_feature (179)..(179): n is a, c, g, or t
  misc_feature (184)..(184): n is a, c, g, or t
  misc_feature (187)..(188): n is a, c, g, or t
  misc_feature (190)..(190): n is a, c, g, or t
  misc_feature (194)..(194): n is a, c, g, or t
  misc_feature (197)..(198): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (215)..(215): n is a, c, g, or t
  misc_feature (218)..(218): n is a, c, g, or t
  misc_feature (224)..(224): n is a, c, g, or t
  misc_feature (226)..(226): n is a, c, g, or t
  misc_feature (246)..(247): n is a, c, g, or t
  misc_feature (249)..(249): n is a, c, g, or t
  misc_feature (268)..(269): n is a, c, g, or t
  misc_feature (279)..(279): n is a, c, g, or t
  misc_feature (284)..(284): n is a, c, g, or t
  misc_feature (291)..(291): n is a, c, g, or t
  misc_feature (294)..(294): n is a, c, g, or t
  misc_feature (296)..(296): n is a, c, g, or t
  misc_feature (304)..(304): n is a, c, g, or t
  misc_feature (307)..(307): n is a, c, g, or t
  misc_feature (311)..(311): n is a, c, g, or t
  misc_feature (317)..(317): n is a, c, g, or t
  misc_feature (325)..(325): n is a, c, g, or t
  misc_feature (327)..(327): n is a, c, g, or t
  misc_feature (331)..(331): n is a, c, g, or t
  misc_feature (354)..(354): n is a, c, g, or t
  misc_feature (364)..(364): n is a, c, g, or t
  misc_feature (368)..(368): n is a, c, g, or t
  misc_feature (375)..(375): n is a, c, g, or t
  misc_feature (383)..(383): n is a, c, g, or t
  misc_feature (392)..(392): n is a, c, g, or t
  misc_feature (409)..(409): n is a, c, g, or t
  misc_feature (418)..(418): n is a, c, g, or t
  misc_feature (420)..(420): n is a, c, g, or t
  misc_feature (427)..(427): n is a, c, g, or t
  misc_feature (431)..(431): n is a, c, g, or t
  misc_feature (433)..(433): n is a, c, g, or t
  misc_feature (437)..(437): n is a, c, g, or t
  misc_feature (447)..(447): n is a, c, g, or t
  misc_feature (456)..(456): n is a, c, g, or t
  misc_feature (462)..(462): n is a, c, g, or t
  misc_feature (465)..(465): n is a, c, g, or t
  misc_feature (467)..(467): n is a, c, g, or t
  misc_feature (472)..(472): n is a, c, g, or t
  misc_feature (476)..(476): n is a, c, g, or t
  misc_feature (480)..(480): n is a, c, g, or t
  misc_feature (501)..(501): n is a, c, g, or t
  misc_feature (503)..(503): n is a, c, g, or t
  misc_feature (515)..(515): n is a, c, g, or t
  misc_feature (536)..(536): n is a, c, g, or t
  misc_feature (539)..(539): n is a, c, g, or t
  misc_feature (542)..(543): n is a, c, g, or t
  misc_feature (631)..(631): n is a, c, g, or t
  misc_feature (651)..(651): n is a, c, g, or t
acttagatatataaattatttccaaaacantttaatactcaactagtcggttctatcaaaatcagtnttccctgaagtaagcactgttcccagctacaagcgatcctcatttcacatggtactgtgggaccataaaaatggatnntgcaatntataataatnaaataggagaaaangangattntannangaantannaaagattntnatnaaanatnaaaaantnttaagaaaagaaaaaaaatnnanaaaaaaatgaaaaaatganntaaaaaaatnatagnaaaatgnaanantaaaaaantanaaanaaaatnaaagtgtntnattnaattgtaaaaaaaaaatagtttnaataagagcntaanttttttnatggaaantaaataaanaaaatgagtaagaatanattatgtananggaaaantgananaatncttctaagtntgggtaaanatccanccnanttatngaangaanattcaatgaaagaaaaataantntatattcacatnaaatataaattaaagtaaagnttntannttttaaaacatcacttcctctgggacgtatctgtctttattgcaaccactttgcttatttgtgttggtaagtttgccttcactaagcncctatgaatacacagcagcnagaacaacattcccatggtcagtgacttcttctacaaattcatttatgtttgattaaaatttcacttccagtgttatcatttttcattg

SEQ ID NO: 622410 - DNA, 154 bp, Homo sapiens
atgccacaaaataccagcagcagcaacagtcccacgagatagaactagttgctgctgcatggtattttagtagaggctttcaaatacagataacaattaaaattatgtaacatgtcctatctaaatgttctttataaatcttgtggtccagaca

SEQ ID NO: 622411 - DNA, 177 bp, Homo sapiens
tggcggtgtgaaggtctcacacagcagtatatgaaagcacctgtgaactataatgccttgatatataatacattgatctattgtctcaatagtcaaatacaattatccagtgcattaagaatgtgatatgactaggatgtcaatacatcttgagtacatcacatctgcatttattaa

SEQ ID NO: 622412 - DNA, 326 bp, Homo sapiens
  misc_feature (110)..(110): n is a, c, g, or t
  misc_feature (260)..(261): n is a, c, g, or t
tcctcgatctcctttccagcctcttattccccggactcctggctcaccctggggccccgtggtccagcttctcccttgggaccaggctttccaatagggcccatgcgttnataaccagttgggcccaaaggcaagtagttgccccttggcccctcaggaccagtgggacccacgtcacccttattccccttctgcccctgaggcccagtctctcctcggaggcctttctctcccatgggccctgcaagccccttgcgcanntgttttcctggggatcctcattgagccttgatcaccttttgatgccttttgcttcaacttttcca

SEQ ID NO: 622413 - DNA, 447 bp, Homo sapiens
  misc_feature (91)..(91): n is a, c, g, or t
tggcccattttctcaattgcaattatttcctgagataagattatgggtctcaagagtgaaggacatttttcacttatttaaaagtatttantatttttataatttaataaaagattaaacagatcattgaattagtaaaagacaaagtaactctacaaataaatggaaaagacacagataccccaggcatggtggctcatgcttataataccagtactttgggagagggtggtggggggattgcttgaggccaggagttccagaccagcctaagaaacaaagcaagacctcgtctctagtaaaaattaaaaaataaaaataattggccaggcatagtggcatgtgcctatagtcccaactactgaggtggaaggatgtcaaggctgcagtgagttgagactgtgccactacactgaagcctaggagacagagcgagacttcatctca

SEQ ID NO: 622414 - DNA, 198 bp, Homo sapiens
ccatgcagagttataccatactagatattacagtaattatccaagacctatacccaacaactagtttctcctgctccaaggtactagtggatgcagacttttatagcttgtctccttcctcggatttccatgcctgactgccaggctgaccctagttggtttggcaatgtgtccgtgacagaacagcaggaggaattg

SEQ ID NO: 622415 - DNA, 814 bp, Homo sapiens
  misc_feature (167)..(167): n is a, c, g, or t
  misc_feature (169)..(171): n is a, c, g, or t
  misc_feature (179)..(179): n is a, c, g, or t
  misc_feature (187)..(187): n is a, c, g, or t
  misc_feature (197)..(197): n is a, c, g, or t
  misc_feature (202)..(202): n is a, c, g, or t
  misc_feature (205)..(205): n is a, c, g, or t
  misc_feature (220)..(220): n is a, c, g, or t
  misc_feature (231)..(231): n is a, c, g, or t
  misc_feature (233)..(233): n is a, c, g, or t
  misc_feature (249)..(249): n is a, c, g, or t
  misc_feature (272)..(272): n is a, c, g, or t
  misc_feature (282)..(282): n is a, c, g, or t
  misc_feature (298)..(298): n is a, c, g, or t
  misc_feature (315)..(315): n is a, c, g, or t
  misc_feature (321)..(321): n is a, c, g, or t
  misc_feature (324)..(324): n is a, c, g, or t
catagttttagatatagtagagatatggatatatatcaggaaacacgcgcatcgttgcgacgcggctggggctggcaggagcagttgcgctgcacagcagaaaaccgacatctgaacagcctacatttcctgtcgtcagacactattgaagaactggttggagattntnnncaagaaanaaaattanataatactantaatnccntgctcacccctttcncccgccaaatnanaaacgcaagcagaccncgatgattgtagaagtccctccngccctggttntgcacgttacagttancagacgagcaattccanttgttnttntccagcatctctaaggcccacttgaatgcaaaggaaaacacttgcacagcaaagcaagagaagtcacagcagcaagacacgcacagtcaaccattttccgagaaaaaaggaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcacccttcccccaccccacacccttcaccctctgtgtactagacgttctgagggccacttggagtgaaccttcttttaagtgcgtaaagcaaaagaatccaggaccagaaaccgacccctcaggacgggaagtccacattgtctgctaatggtttctcattatgaaggtgcagattgtaggaggtttgtactgatgtgctcttcaacctatgtatattac

SEQ ID NO: 622416 - DNA, 489 bp, Homo sapiens
ccagttgccgactccccagtgagatgaacctggtaccttagtgtggaaatgctgaaatgactcgtcttctgcatcgctcatgcatgggagctgtagacggagctgttcctatttggccatcttggctccacccccttggctggcttctttaccatatgctgttttatcagcaaggtctttgtgacctttctgtaggttgcctgttcactgtgatgtaatgttattaagttttacttttgctggaaaatatgatttgacctcctatctcatcctgtgactaagaatgacttaacctcctgggaattcagcccagtaagtcccagccttatttttacccagcccctattcaagatggagtagctcttggtcaaacgcttctgacatatttcacccttcctttttataagagaacccttaatcctaagtgttctagagcagcaaagatccatcttctgtaacttcttcaggcggcgtcggatgcagtcgggt

SEQ ID NO: 622417 - DNA, 335 bp, Homo sapiens
tactcgaccggtcacagcttctgagtactgaactatggcgttgcacatgctcaactaatttttgtatttctagtatagactgtgtttcactacattggccaggctggtctcaactcccgacctcatgatccacccacctcggcctcccaaagtgcagggattacaggcttaagccatcacgcgcagcctgtttgagatctttattcatttttgttttgttaactttgttgtgtaatatcagaagagctatactttggtagtaatactttgtgtgtttttgtgtgccagaagttgtcttttttagccctttatattgggctttttttagaccgtca

SEQ ID NO: 622418 - DNA, 309 bp, Homo sapiens
  misc_feature (88)..(88): n is a, c, g, or t
gagtgcggagccttaggcggcgcgttgagaaccggtcgcggcaatcctagcgcgcttcagcagcagcaaaaacaaaagccgtcgtgtnggtttttttgcccccgcatccgctgtttggagtttgtatcgcccccacacccaagtagccgcccttccctcttctgtcatctcaccgccccaccacagaccgcgttccccgaggaaaccggccgcccacgcccggagcatcctcccctgttgggcgggcgctggcggacccggcggcttgctgcgggtgcgaggcttggggatgctgggggacctgcttct

SEQ ID NO: 622419 - DNA, 127 bp, Homo sapiens
ggcataagatgatatagtcgttattttacacacatataaaacaacttttcattaacagattaaggtggctgatataaactgataaaaaaagatttaaaaagaaactgaaataaagtatctttgtcac

SEQ ID NO: 622420 - DNA, 416 bp, Homo sapiens
  misc_feature (55)..(55): n is a, c, g, or t
tcccatgggttttaaaaccgtttgcccttcacagccctgggttttggtcaggacncggccctggcggtgttaaaaaaccggttccacccgaacattacgctggaggctgctcaggggctgttggtggaaaccgtcccccccgggtttttgggtgacctgggctccgggggcaatgtggacgcatgtgtgatcccaaaaactggggcccaactttttcggaccctgggctcccccccaaagcccgtgaaaaggtttggccgctccccctttgtgcctggaaccccagctgtcctgaccccgccagtgaagcccctaaccctggggctagtggaggaaactgtgccggctatggaggtggggtaagcttaggcttaaagcttggaacaagggggaataaaccccgaaaatcccgttta

SEQ ID NO: 622421 - DNA, 347 bp, Homo sapiens
cttgcacctgatcctcactgctctaaatggcaggacagggctttgaatccagacttccttattttcaaactttactaggtaatattgtctccaatttacttataaaacaatgagcttgagaagagcttggagaatatcttcttctatggcttgcaaacgactatgaggtacgttaagataaatacattaaggtattttatgtcatcagtatataccccacatgcaactgacacaaaagtttcaaaaaatataacacttacccttactatgggtaatttaatgatatcctctattctgctttatcctattatttacttgcacatttacatgtggagacacaatatatt

SEQ ID NO: 622422 - DNA, 125 bp, Homo sapiens
tgagaatacctgacggcgctagacctgcaaacgccgttgagcgatgtgcaacagcgagcccaccagcaagcggtaaccagtgctcgtaccaccttgatgcccgacctctgggcgatactccgccg

SEQ ID NO: 622423 - DNA, 197 bp, Homo sapiens
  misc_feature (187)..(187): n is a, c, g, or t
cggtacccctagcacttcctgtacatatttaacaagacggcatctgcctgaaatgaggtatggcttgtccccaccactgtagtaatcaatgcaattcacgcctttctcatgtccttccaaagtgaagtttggtgacgaagagcccaactgccacaccttgatagtcctgtccaaagaggcactgganggttgctagg

SEQ ID NO: 622424 - DNA, 643 bp, Homo sapiens
ggggagccatggcgatgccccggcccgtacgcgccgccgccatgtggcccccagaccccgagcccgacccggaccccgagcctgccggcggctcccgtcccggccccagggttccccgggctccgtgccctgctgccggcgcgggctacctctgctctctcaaaggcacgcctcctagctaggccgaagatcgggtctcatcaatacatcacattttaatctgcatatagtggaagtcctcagaatcattgccttccatcacagacagcctctagctggagttcctagctggcctatgtacattcctcttttgctgatagccatgcaagctgacatgacaaagtggacagggcttagtgcatagggcccaatagagtaggaacattcacttgcggcatgtcgtcacacccgacagcgcacccttcaatcatacatatatagactaattcatcccaagtcaagcaggacaaaatcaggcacaaagtaactcaggagattgagagggctatcccaaaaaagacccagcaagagagaagtaggttatgacattatcctattggctaaccaatccagtagttacatgcacactagcatttcttaccattgaatccttaaaaccagacgttggccaaaaattcattca

SEQ ID NO: 622425 - DNA, 424 bp, Homo sapiens
ctatatgtatcaggtgcattctcatgctgctatgaagaaataccagacacaggctaatttaaaaaggaaagggattgactgactcacagttctgcagagctgaggaggtcttaggaaacttaaaatcatggtggaaggggaagcaaacacatccttcttcacacggcggcagcaaagagaagtgcagagtaaagttggggaaagccccttataaaaccatcagatctcctaagaactcactcactatcatgagaacagcatgggggacgccgcccccatgatccaatcacctcccactgtgtccctcccttgacatgtggggattgtggagattacaattcaagatgagatttgggtggggacacaaagcctaaccatatcagttatgaatgaatagctgagctaacaagaaagagagagaact

SEQ ID NO: 622426 - DNA, 176 bp, Homo sapiens
tatagtcatcaagttgtatccatgccagcctccctccacaagaggtggcagcagcgatggctcaatctgataccacctccatggcacccactgggaggtgcttataaagctttaccgagttaaatgtgaacaaggctacactttgcttgggagctgacaaattagaatttcagacg

SEQ ID NO: 622427 - DNA, 524 bp, Homo sapiens
tcgatctagaggatccgacgctctctctgtggggaacgctctagctccgcccgatggggacgagggtttgcttgtgtttttacaggagatggacaatccgtgtgggtgccctcaaggtgtgtgcgaccatggaacgggagactggagaaatccatggatctcaactgtgggcccagctcctccagtacgagccatgagctagttgaatctgaatgcaaagacagaacaaggaccgacgggagtcacactgacatcaacccccataaaagggggacagctcaagaaaaccacacaggaagctgagaaactgctggagcaaaacccctgactccatgtttatggccatgctagctgtaatatcctgtgcggtatgttttccctgtgcagaggcaaaaacttattgggcatatattcctaacccaccagtagtacgaccggtactggggagcaacactcctcctgagatatatcatgatcagggagcatggacaccaggacccctaactcccccacagagagagcgt

SEQ ID NO: 622428 - DNA, 314 bp, Homo sapiens
agcttcatcttctggccactgtctccaggtggctgttgctcctccgcccatgagctgtagcatcgaggctgcccgcgtgtgcaggtgtgcagcagtgtctagcaactgtacacgcacaccgtctggtagctggcaggcacgccttcgtcctcatcatcatccatctgcccgacccgagaggaatgtaggctggaaggttcgaggcctggagcaaccttgctccctctttggattacttcttgaagcggttccctttgctgtcatattagttgactcttgccaagtttctcctgggcacttgcatccgccaattc

SEQ ID NO: 622429 - DNA, 846 bp, Homo sapiens
ctatcccacgcggtccgcccaacgcgtacgctttgccacaaaggtgcaccctgagagggcatccaagaatgggccacaagctccaccatggactacatcgggccttgcaaatacatccccccttgcctggactctgagctgaccgaagttcccccgtggcgcagtgcgggactggctcaagaacgtccgtggtcacccgtgtatgagagggatgaggacaacaaccttctgacgtgagaagcagaagctgcgggtgaagaagatccatgagaatgagaagcgcctggaggcaggagaccagcccgtggagctgctggcccgggacttcgagaagaactataacatgtacatcttccctgtacactggcagttcggaccagctggaccaggaccccattgacgggtacctctcccaaaacgagctggactccacatgcgtgctcccgcgtcatcacgccatggagcattggaccacccgcttaaaacgagacactgtgacctggacaaatgacaagtacatcgacctggatgagtgggccggatgacttcggcatcaagcagaaggatatcgacaaggatcttgtgatctaaatccactccttccacagtaacgagattcatactcttataaccctacccctatccgatgtaaaaccacaaatgatttaaaaatgtatggaatggtaaagaaagatacgtgccctggcagaccaaaggtcgactaaccattaggatttcaacgtgaatacataaaaccggagctaacaaatgaaaatgctaagcccaagaaatgacataccttaggctgtaactgcaactatgacaggacacttgccacacgcatta

SEQ ID NO: 622430 - DNA, 337 bp, Homo sapiens
ctcccagattccttagggtagactactctagggacctcatgtaagtggattccagagtgaatacgagaagagactgctaggttgccaggagctgggagtggggagaatcagaagttgttcatgggtgggcagtttcttttatgcaagatggggagtttctagagatctgctgtagagcttgatgcctatagttcacacagatggagtatttcttatgcctacaacttaggacaaaaagtgttttgcatttctttcattttttgattctgaaatatttgtcatatacttactggttacgcatccccaaatctgatagattcaaagtctaagatgcttc

SEQ ID NO: 622431 - DNA, 232 bp, Homo sapiens
acccttcccttatgagcatgcctgtgttgggttcacagtgagggtaataatgccttgttggttgattgtagatattggcctgttaattgtcagttcagtgttttactctgacgcaggcttatgcgagagaagaatgttctcatgttacttacacacacattagttcttctatagggtgatagattggtccaattgggtgtgaggagtctcagttatatgtgtggtattttat

SEQ ID NO: 622432 - DNA, 406 bp, Homo sapiens
  misc_feature (377)..(377): n is a, c, g, or t
  misc_feature (402)..(402): n is a, c, g, or t
tgagacagtctcaccctgtcgcccaggctggagtgcagtggtgccatctcggctcactgcaagctccgcctactgggttcacgccattctcctgcctcagcctctcgagtagctgggaatacaggcacccgccactatgcccggctaattttttctatatttagtagagactgggtttcaccgtgttagccaggatggtcttgatctcctgacctcgtgatccacccaccttgggcctcccaaagtgctggggattacaggcatgagccaccgtgccgggctgaaaaataaccctttagatatctacagctttaaactgtgtggcagtcatggaaaaggcagacatttaggaagtcattgggcatttaattaaattngcagttaaaatttttacagttaatnacat

SEQ ID NO: 622433 - DNA, 1340 bp, Homo sapiens
ttgattttacgtatcttctatctacgacccttcctgtgcctgatgactctcccacaaattgaccctgttgcctctgagctcttctgcagctaacggcagccttcagctccctatcagcgcctccttctacttcccagagcacacttcacagcagactctgctccttccatgcaaaggcttcctgaaactagggacgactgactgagctagctcacttctcgctgacccttacacgctgccaaccactctcaaacacaagtatgaaacactgactcctatccttcactactgcacgtactactccactcaccgcaactggctcactacttccctgctacctctccaacttcacaccactgctagcagccactactcctgctctactactgctccactgctaacctatccaaactgcgcttactccgctctacctcacaacgcctactactctcctgatacaaaacaactactcactacgcgcactacactctgcccctaccacgacggcgcactccaactctaaccactgcactgcctgcgcaccactcctgcaccatgttactacccacacccaactctctcaccctctctggccactattgcattcatcatactcacccactctacctcttcccccaaacacgctccaccacattcccaacgaacatcttccgtgagaaccacttctggcactagcccacttttcacaaggggtaacccaacgtcaccgctaccccttactttttcaacgtacgaacaccgacttacgacacgcctcccatcaacttatacacacactcccatatctaaatatagtcctgagactggcctatgcgtcacacatatcactggacggttcttaccccacgcacactgcacttacggtcgtacccacaatggaacttaacccacgtctaagcaccgcgcggctggcctgtggcacaccctataacaacaatccttgcgcagtttcaggagctaagcaaatcacaatgcgagcacatcgatacgacactccgcacgcaggtactgctaatctacccccgctgtccaaacctgttgcgcacaaacacacaaccccacaacggtgccccgacctaagccgctagtccccacacggcccacacacaacaaaccgggcaagaatcaactaggcaactcgacgacgcgactatctacaaccatacctcgctgacgccagcgtgacaccccttgccagcaaacgtcgcctgtccaccagtgccatacgctcaccacgacaccgccacactaacaacctcggcgccaccacagcacgtcgaaccccatactagcgaccatacactcgagcaccacaggcc

SEQ ID NO: 622434 - DNA, 794 bp, Homo sapiens
  misc_feature (2)..(2): n is a, c, g, or t
  misc_feature (4)..(4): n is a, c, g, or t
  misc_feature (22)..(22): n is a, c, g, or t
  misc_feature (740)..(740): n is a, c, g, or t
gncntttgtgtaggtttttgcntagagggtggctctagcgagggccactgcttgatgaggggggaagtgtggacataggtgggaggttggagtaaaaaggtggctgggccaatggcacagaggtgccagtggtaccaaagaagaactggatccagcgttcacaagaaaggagctggaaataaatatagcaggcaggtggttcaacacctggaatgcctgccattgagattttagaggtagatctgataagtagtgcccttgggattagttggttgagatggtgcacaggacaggttcattggaggtgaggcagatggcttatctacatgaatagtggcacctgaataatgctgctggaatcttcagtgaatgcaggatgggtctaggtgggaactaggtgattgcaagaggtgagcccgtagcctacaggattagagagttgtaaaaaattactaatcaaattattactcgctttggaatagactcagctgcacagaaccaatgcttgatttgcaaaagtatgaaactggagttgagtatgcagaaagcgttgacgttccaagcttcataggaagctgtttaattccaatatagagaggaggcaaaaactgaggaatagctgtctggagctgcagggaaaacctataagctgatttttagaatccaaatcctagtccacaggaaatcttccatttcgataacctacaagtatcatcagaagtccttgacacaagtggatnagaattgctgtgttttgatggtactctagaaacatagacacaaatcattcaagt

SEQ ID NO: 622435 - DNA, 124 bp, Homo sapiens
  misc_feature (102)..(102): n is a, c, g, or t
  misc_feature (107)..(107): n is a, c, g, or t
ctcaccattactgcgtggccaaatccttcccttatttcaaggcttagttcaaatgttacctcttaactaagccttccctgctaaccccaaatattaataganttggngtcttccttctctgatg

SEQ ID NO: 622436 - DNA, 219 bp, Homo sapiens
agctcaggcaccaggaggctctgaagaccgacccggagagctgtcgggagcttctgacagatgaactcagccactctgagagggctggcggtggatttgtgctgctctgcaggaagctctgggaagggaggcaaagcttcgccggtgctatagcgtgcttgctgtgagacagcacccgactttccagaagctgagttccagacttgagcagaccaggag

SEQ ID NO: 622437 - DNA, 242 bp, Homo sapiens
ttttgctacatcacaaacagcaaactgaaaaaacaaatgctgaaaaaaacacatgttccatccaattatgtaattagtgtaacagcagttgaaatgtcattaaatgaataacaaaacaattaatgcttgatgtgaagaagtcttatccatagtgcccatacatttttgaattcccactctctgtttgtccaattggacacaccatgtcagggtatatgcgccagcgcagagatgcatgatga

SEQ ID NO: 622438 - DNA, 4443 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622439 - DNA, 4317 bp, Homo sapiens
tggccaggctggtctcgaactgctgacctcgtgatccacccacctcggtctcccaaagtgctgcgattacaggcgtgagccaccgcacccggctttacttatttgagtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622440 - DNA, 3806 bp, Homo sapiens
taggctaggtcgaggctgggttgaatcggccgagggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622441 - DNA, 3686 bp, Homo sapiens
gagcttgcagagttcactggccgggtgtggtgactcgtccctgtaattacaacactttggggggctgaggcagaaggatcccttgaagccaggagtttgagaccagcctgggcaacatagacctcatctctaaaaatacgtatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622442 - DNA, 233 bp, Homo sapiens
attgatttacaacgtgttctttgcttggaaaaccctttgggggtatcattcttatctaatacttctttttctaacaacagaagagcaaccttctccacgtcagctttcttttctgtgagaagagctactgttcttttataagcatcattaataagtattcgtacttcatcatctatcaatcttgcagtggcttcactgtaaggtttctccaataccatggacacgaatgttca

SEQ ID NO: 622443 - DNA, 4603 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgattttgtatgtggaccactgctcctgatttcccaggtcttaggccacctttgactgtttctccgtttgtttgtgggcagcgattccagtcccaacggaggcattctcgtgtgtcccggggggttatgtccttcacaaaacacttaatgaaatgaattacttc

SEQ ID NO: 622444 - DNA, 176 bp, Homo sapiens
caggtcagactctgagtaggatcccctgctatatgtaacctagacgagaccccacaggtcctaaactaccaacctgcattataaatttcggttggggcgacgctcgagcataacccaacctccgagcagtagatgctaagacttcaccagacttggctaccaatcttagtccatta

SEQ ID NO: 622445 - DNA, 4499 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaacatttaaatcttctaaaattctcacaccctcaaagtgaggagtaataattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622446 - DNA, 540 bp, Homo sapiens
  misc_feature (534)..(534): n is a, c, g, or t
agagagagagatagagagagagagagagagagagagcgagagagagagagagagagacagagcgactgacagagacagccatagagaggctcaccctcctaagttcctcgcccatcacccgtgtacctccatgttcttcccctcgctgttcacctccagccccttcagtccagattccttccttttaatccctgtccgctcacctcttctgaccttgaactgtctgcctcgctcctgcttctcagtcctgctcactgactaggcgttggctcccactcatgtatcggcttcttacacctaaccttgatgctcccccttttttcctagcctcctgtctcattagcatcttgacctgccttggagcttactctctttaagacccactctcactatgtctccattctcttctgaatcttacttcctggactgctgcctgcctctcaccgttcttccctgtgatcctctcctcatggctctctcctatcagtgctagatctcaccatactctgttccgcctagatgctctccccctcntctgcc

SEQ ID NO: 622447 - DNA, 3485 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcactcaccaagatgaactatttgccgccctgtcttttcctgggttggggggtggcatctgatggtggcagagtgcctgttggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622448 - DNA, 392 bp, Homo sapiens
ctagtataatacgtcaacgctagagccacaaatgaaatgaagtacattttgcaagtataggtaaggatgttaactcaggaataaattatcattaattaaaccatcaagtactttgaagtggtgacatgggcatcggtatgctttcccttataagttggtataagttagttttgatcatttatatataataggcgcttgcaaatagtacaggctaaccctggggaaaaaatagtagttttaactaagcccaattcccccaaacatctagttcatgatataattaactggaaaatcaatcaaatttaagcccttgtttttcaaattactttttttttttttccagacagagtctcattctgttgtccaggcgtgaattaaagtgacaaaatctc

SEQ ID NO: 622449 - DNA, 4147 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaacatttaaatcttctaaaattctcacaccctcaaagtgaggagtaataattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622450 - DNA, 392 bp, Homo sapiens
cgtacagctgctccggacgagctcgggtgtattggtgcgtagaaccggctccggggcccgataacggtgcgccccacagcacccgggctggcgtgaggggtctcccttgatctgagaatggctacctctcgatatgagccagtggctgaaattggtgtctggtgcctattggacagtgtacaatggtccctgtgattccccacatgtgggcactttgtggccctcaagagtgtgagatgtccccaactggatgtgagtgatgtgttggatgtgatgtgcgcttcccagtcatgcagcagttctgttgaaggtgtggctttacttgagtggcgacttggagtgctttttgaggcatcccaattgtttgtcctggcttgatgtgacggtcttga

SEQ ID NO: 622451 - DNA, 883 bp, Homo sapiens
ggtttgtagagaatagtcaacggtcggcgaacatcagtgggggtgaaaaaaaaacaaaaaaccaaaaaaaaaaaaaaaaaaaaaaaaaaattttggggccgccgcagcctagaagaaaaggtttacaagacccatccggttggggcggcggcgcgaccaagtagcgtaccgtgcagcacctggtggcacagagaggtgtgccaaagaagaacaatccggtgggcacgatcaacaatacgtcggtgcggtggtgttgttcccacaccaagtagaaaaacacgcgcggggggggacagccaccagaggcgtgtttctgtagcacaacaatctcccaaaggttagggaagtcatcgagagcagcagacagcacacgcgggcgatcttcatacaccaacgcagaggcgcggcgtccacagagggagaggcgaccgagttatcaaaaaaaaattaaacgcgccccgggtcgtgggtagggtgaacaagaagacagagaagacgcaactaacaaccagcgcacgacacgaagacaacgagctcgagaggagggcgcaagcgggagagaggaggagcggcgcgagggacggagggaggggcgagggggcagagaggcgcggggggagggggagacggaagcggaggggaggagagaggccgcgcgcggagagagaggaggaggcaaagaaggcgggacgggggaggggagcgcggagagagggtagagagagagcggagcgagcgagagcagaggcgaggagagtagaggcagagaggtaaggagaggcacgaagagagacgagatgagacgcgagtaaggggagcggcagcaagagcgaagagaggggagaggagggagaagccggagaggtgagcgagaagagagagg

SEQ ID NO: 622452 - DNA, 3804 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcgtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622453 - DNA, 326 bp, Homo sapiens
gtatagctccaggatcgtaactactacaaccatataatagcgttcaagctggtaagacgcggtgtggaagtagtacgtgaccgatcataactcctagttctagtctacgcagagaagagcgggaaattccctctcgtcaacctgataatgtttagattagtcaggtgaggtggctcacacctgtaaccgcagcgagatagggggccacggtaggatgattctgaagccaggagtttgagaccagcctgggcaaacacagtgagagcacgtctccactaaaaaatagctgggtgtgttggtgcatgcctatgtttgaaatgcttgtt

SEQ ID NO: 622454 - DNA, 3208 bp, Homo sapiens
cacgaggaccacactcttcacacgttttctgagtgtgagctttattaaatctttagcattaagatactattctactttactgagtttaaaactatttttctgaaatcattgtaatgataaggaaatgttgcgatcaaataagatttagacacacttttttttccaataggtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgat

SEQ ID NO: 622455 - DNA, 155 bp, Homo sapiens
atcttcctgctgaacaatatgaatggcattaacatcgtacaaatattttatccgtcatgagatacttttaatatttgactattctaggctacacctactatgtatccacaaaaaataaaaattaaaaactaacaaatttttttctagaactacac

SEQ ID NO: 622456 - DNA, 324 bp, Homo sapiens
  misc_feature (7)..(7): n is a, c, g, or t
  misc_feature (46)..(46): n is a, c, g, or t
  misc_feature (168)..(168): n is a, c, g, or t
aaagacngcaaacatattccgacattttccaagcggcaactctggnaaagcagctcccaccgccggacgcgatcgttccagcggaaaagtgtagatataaagaggggttccagtcagacatttttttactcccgtcagcgcgttaccccaattgtagataaaattganaaattcgctcacggcatcaaaccattgaacagacgttttttacgcggcccggtcattaaagattccagtttcgcgacacaggttttgtagtggggcgtggttttatggaacgccactgcgtcttcatctttataggcttcgtagatataaaagcgc

SEQ ID NO: 622457 - DNA, 237 bp, Homo sapiens
tgcacgccagcctcctgagtcagtagcctctgggactacgggcacccgccaccatgcccggcaattttttgcacttttagtagagacggggttcaccgtattagccaggatggtctcaatctcctgacctagcgatctgcctgcttcggcctcccaaagtgctgggattacagacattagccactgtgcccggccttttattttatcttattataataatatttatataatattatt

SEQ ID NO: 622458 - DNA, 616 bp, Homo sapiens
  misc_feature (425)..(425): n is a, c, g, or t
  misc_feature (527)..(527): n is a, c, g, or t
  misc_feature (535)..(535): n is a, c, g, or t
  misc_feature (556)..(556): n is a, c, g, or t
  misc_feature (583)..(583): n is a, c, g, or t
tagctcggtacccgttgctaggctggagtgagtggtgtgatcagactcatggtaatctcaaactctcagactcaagcgatccttctgcctcagcctcccatgtagcagggactttaggtacgcaccaacacacccacctaatttttaaattttttctagagatgggctcttgccatgttgcccagtgtatcagtctgttttcatgctgctgataaagacatacccaagactgggaagaaaaagaggttcactggacttacggttccacatggctggtctcagaatcatggtgggaggcgaaaggcacttctaacatggcggcgggaagagaaaatgataaagcagcaaaagcggaaacccctgataaacccatcagatcttgtgagacttattcactaccataaggacagtatggtggaaaccgnccccatgactcaaattatctcccaccaggttcctcccacaacacatggaaatcataggaatacaattcaaaatgagattcgggtggggacacagagccaaancatatcanccaggctggtttcagactctntggctcaagcaatcctcctatctcagncttctaaaaagtgctgcgattacaagcataagc

SEQ ID NO: 622459 - DNA, 280 bp, Homo sapiens
acgtatcaggtcgtctcggtcaccggcgctctcgtaaatcaagatgatggtgaccagcaccagcacctcatgccacgatgcccagtgaagggccagagggcggcagtgtggctgcgcacgcggagcgttgatgatggccgtggtcggagcccttggagcatggtgccgttgcaccgcgtactggccgggggtcggcctccagtgttcaggttctcaagtgtgtagctcatgagccggccaccagcacgacgtaattccgtgaccacggacgacagaattc

SEQ ID NO: 622460 - DNA, 345 bp, Homo sapiens
  misc_feature (37)..(37): n is a, c, g, or t
  misc_feature (71)..(71): n is a, c, g, or t
  misc_feature (117)..(117): n is a, c, g, or t
  misc_feature (119)..(119): n is a, c, g, or t
  misc_feature (152)..(154): n is a, c, g, or t
  misc_feature (163)..(163): n is a, c, g, or t
  misc_feature (195)..(195): n is a, c, g, or t
tcccctgcctccttttaggtcccattttatgagtggntggaactcaagtttgaatggcagaaaggcgcctncctcaaggacaaaatgcgcaaaacggtggcttaggagctggccaantnacttgtgccaacagcatggactgggtgcctttnnnccggaggtntaactgtgggcggccaaaaagggtcacccttnaggacaaacctttgtgcaggaccttggccaaagtggggagggtggccacccccttttagggacaaaacgtccttttgtgtataataaacctttaattttggtgttggacccctggggccttcccagggttggtccccctttgccctgtca

SEQ ID NO: 622461 - DNA, 314 bp, Homo sapiens
gagaagactgtattcaataatcaagttggaggccagacgtggtggctcacacctataatccctaccgtttgggaggccaaggcaagcagatggcttgagcccaggagttcaagaccagccttggcaacatggcaaaaccctgtctctaggggaaaaaaaaaaaatacaaaaattagccgagcatggtggcacgtgcctgtagccccacctccttgggaggctgaggtggaaagatcacttgagcctgggaatgtcaaggctgcagtgagccataattgcaccactgcactccagggtgacagcgagaccctgtt

SEQ ID NO: 622462 - DNA, 427 bp, Homo sapiens
  misc_feature (5)..(5): n is a, c, g, or t
  misc_feature (32)..(32): n is a, c, g, or t
  misc_feature (45)..(45): n is a, c, g, or t
  misc_feature (63)..(63): n is a, c, g, or t
aagcncgaaacacaaggacctaagggggccanggccttttcccanagcccacatgtcgggggnaaagcccctggacccacagcactgcagggttggggtcccttatttccatcaggattcccaaagtataggattcaggccccaggcacagtggctgatgcctgtgatccccagcactttggaaggccaaggctggtggaaagcttgagctcagggattcaagctcagcctgggcaacacggcaaaaccccatctctacaaaacatacccaaaaaattagctgggcatggtggcacacgcctgtagtccaagctacctgagaggctgtggtgggagaatagcttgagcccgagaggcagaggttgcaatgagccaaggtcacacaactgcaccccagcctggaagacagagcgaaactctgtctcga

SEQ ID NO: 622463 - DNA, 134 bp, Homo sapiens
ggatcctatacccacccaactaggaggaactctgtttcaagagagatgctgtcctgtgcttggatagtcaggcaattatttgtgtattaaaccatgttccaatcaatgttttggaaataatgatctcagacttt

SEQ ID NO: 622464 - DNA, 262 bp, Homo sapiens
ggcaaaggaggtatccacaagcacacatcacacacgcgaacacacatcacacactaacacacatcacacactaacacacatcacacgtgctaaaacacatcacacaagcacacatcacacacactaacacatcacacacagcgaaaacatcacacaagcacacatcacacacactaacacatcacacacacaaaaggacatcagacaagcacacatcacacacgctaacacacacacacaccccttctcttcttttggtttc

SEQ ID NO: 622465 - DNA, 1045 bp, Homo sapiens
  misc_feature (58)..(58): n is a, c, g, or t
  misc_feature (68)..(68): n is a, c, g, or t
  misc_feature (102)..(102): n is a, c, g, or t
  misc_feature (108)..(110): n is a, c, g, or t
  misc_feature (112)..(112): n is a, c, g, or t
  misc_feature (114)..(115): n is a, c, g, or t
  misc_feature (129)..(129): n is a, c, g, or t
  misc_feature (137)..(137): n is a, c, g, or t
  misc_feature (141)..(141): n is a, c, g, or t
gccccactgcgccgagggccgccatcgctattgcggcattctccctcggctccggagntaggggcaantcttctcttcctgtctgggaaaaagaccatagcntcaaannngnannggccgagggagaangttagcanaggngatgatgaacgaagcggtttctgagcgtggactgtcgaacgaccgcggttaactatccacgctcggcctagagctgcgtcggcacatacgcgcactcggtatgctgtcactggcctgccgcggttcacgctgagcgtccggcttggcggcctgtcctgggttattcgcgtctacccgtaggttcgtgtgagtctacggtgtctctcgactcccgtcttgtttctcgtgttgtcggactccgtatcatattgcgccttcttccctatagagagaactgctgaaccgatgtctgatgaatactttcggaaactcccgtacaacactgacagcaccgccgggttcgccagaaggggtacgaagactgtgggcacgcgcggcagaagatccctctttcgtttcctgcagagtagatgcattcgcaacacatcttcacgcaacatttttcactccaggtaacgttccgagcgtccgcatttatccatgaaggtagttccgccggagagaattacggtcaggctcaaggtgcctgagttgtgactatcgatttagtagggtcaccttagtaatgctgtcgtgacgggctacatcaggagcgtttcatactagcgagatgactgttgttgaaaggatgtgacatttctgtggcgtgaaaagtagccatcggatccctagtggtacccagaggttcacgataaatttttagcaccttggcatcaaaggtcccttttccaggaaggggagttaggcaatagaattccctatgggacggtatcatcccccaagaaaatagaggctttccagtggggttacaagacgtgttgcacaaatgttcgcgctaggcaacccttggaagccttgaattcgggacgcacagttgcactatcttccacatgttacatagcgg

SEQ ID NO: 622466 - DNA, 452 bp, Homo sapiens
ggtcccttaacacctcggcacaaaggctgttggcaagtgtaaaggctgcctctgtgtgtggtttaagtaaactggaaattagacattgacgtgctgctcctccaaaggtttgcaccctccacttcacatgccgttgactttcccagtttaagacttcagggccgggacctttgtccagcctgcacagtaaagttaggctgcctcttccgccaggcattgggatcccatttaaaaacggcattcccttcaaaagggactttttaactggtcaggttttgactattttaaatagtttgctgaaaactcctgataacccctgctacaaatcatgttttaattgcttggacagttaacccttaattttatttaagtaaagtggatcaaagtaggacttttttgaattgtaaataggtggttttattaaattaaaggccatggtaaattggtaaaaa

SEQ ID NO: 622467 - DNA, 1087 bp, Homo sapiens
gagtgtaggggttgcagggagacctaaacacagtcaccatgaagctggggctgtgtcctcatggcctgggccctctacctttcccttggtgtgctctgggtggcccagcatgctactggctgccagttttgagacgctgtagtgtgagggacctgtctgcactgatggagagcagctgacacacggaggatgacttgactgatgcaagggaagctggcttccaggtcaaggcctatactttcagtgaagccttccaacctgattgtgtcctatgactggctgatcctccaaggtccagcccaagccagtttgttgaaggggacctgatggttctgcactgccaggcctggcaagactggaccactgatcgtcatgtgagcgttctagccgagatggctcagctctgggtccccccgggcctaacagggaattctcgcgatcgaccgtggtacaagcaggcagacagcgggcagcagcactgtagatggcatcttccagagcccgtggtccttgggatcccagaaatgggatctgttgtggctaatcatagtcgaagaagctgtctccagcgccgatcctcagagctgtaacctcagtgaaacccaagcaggaagcccattgaccctgaagtggtcagacgaagttggccctgcagaggtcaggatggcgctctctttccttctacaaggatggccggttgtgcaaagcaagggggatcatgcgtcccgaatttgcaagattcgcccaggggttcagaaaagtcaccacgggtgccatactggtcttgaggaagccttgaggccatcaacttttgggaacgaagccccataggaaatattaagcacagagggcgtcacagattctggtgcctcccaataatcaggtcccagaaattatgccagacagactcgtagagccgggaatatcaggacacaattaggaaaggttattcctgggacgaatattaagcagaggtccacacaggagcgtctacaagggagtggaagtatagagagagagaagtttccagcatgatgtcttcagtctttcggtcttagctgtgtccaaggagcaagaaaaacaagct

SEQ ID NO: 622468 - DNA, 690 bp, Homo sapiens
  misc_feature (58)..(58): n is a, c, g, or t
  misc_feature (68)..(68): n is a, c, g, or t
  misc_feature (102)..(102): n is a, c, g, or t
  misc_feature (108)..(110): n is a, c, g, or t
  misc_feature (112)..(112): n is a, c, g, or t
  misc_feature (114)..(115): n is a, c, g, or t
  misc_feature (129)..(129): n is a, c, g, or t
  misc_feature (137)..(137): n is a, c, g, or t
  misc_feature (141)..(141): n is a, c, g, or t
gccccactgcgccgagggccgccatcgctattgcggcattctccctcggctccggagntaggggcaantcttctcttcctgtctgggaaaaagaccatagcntcaaannngnannggccgagggagaangttagcanaggngatgatgaacgaagcgttcttgaggggactgcaaccgcccagcggcaagttacccgcccctgacgctgcgcgctactacctgccatcggtagctgtcatggccgcctgggtcacgatgactcctggctctggcgccgatccctggttttccgtcaccctggttcatgtagtctcggttctcacgactccctctttttactcgcttgtggactccgatatacttgcccttcttcccttagaagaagctgcctgaaccagactgctgagacatgttcggaactgcccgagaaactgcaatgagccgccgggtcgcagcaaggggagcagatggggccaggggcagaaaccctcgtctggtcctgaaataaagattcgcgccacttcagacagcttcatgccaggaagtaggtggcacgcagtgtcatgacgaactatctatgtcgaagatatcggcagctctcaagtggctgactcgctgcatatttattggtacggcacatagatagtgtgaaattaggctattcaggtattgatatggaagattcgtga

SEQ ID NO: 622469 - DNA, 248 bp, Homo sapiens
ttttgtgttacaaaacacaaataaatccaagcagataatgaaataaacacatttttttagtgacccatcctggttctctgccaaactgaatgtattattcaggaagaatacgagtgccttcatttaactaaagttgaatgtaaagtcaatttgcacttctttatatcctggttagatatgtaactgatatgcattatattcaggtctgacagtcactagactctacatggcagcttatatgattcttg

SEQ ID NO: 622470 - DNA, 857 bp, Homo sapiens
cggcgccggttgctagagtcctctgcgtgtgtcgctcttgttgctgcttctctcgctgcgtctttttttcttctccgctgcagagtccgcctctgctgttgcgtgttgttatggtcccccccctcttcggggaggagtatgtagtgttgtatagtattgtttcttgctcgttggtgtaggaagaggcggccggcggcggggcgtgtgttctcccaccaacgagtgtgcaagtatggtgtttgtgtttgtcttccgcctctcgtctgcgtgcgtcaccgctcctccgcgcatatgcttttcttttgtgttgtgtacccccctctgggggtttttctcacggcgcgctcatggttgttccctcccggtgtggcgctgtttctcacagagtgatgtggagtgttatatgacgccctgtcgctcgctcgctctctgagtcagactctgcgctagcttgtgggtctcttgcggtgtgcttgggtgagctccgcgcgcgggtggagctttctctgttgttgcgccgggcgctcgcgcaggggcaccctgtttgggggcactgtcgccgcgttcctgtgtagcactcacctctgcctctttcgaggctctgtgagacctcgacctctgccctttgtgggcctatgccgcgggtcgtgagggccctcttctgggaggatcctccacgaggtttttggagcttattttcaagagagggaatgttgccccgagaatgcaggcttaacccagggctgggcaccctcttggattttgaatttcacaaatgggggcaaggcttttctttataggcccttctgagtcatttttttgggcctttgttccaaaaaaccctgttgccagtttta

SEQ ID NO: 622471 - DNA, 288 bp, Homo sapiens
  misc_feature (80)..(80): n is a, c, g, or t
ttggaaaggaaagcccaatcagagaagaaaacagcccccgaaccagcaggagtggcttggcacatggaccgggcttgagngatgtgcactccacccaagccaggctcccagggggcctgatttttttctcactgtttttttttttaaaatggttgcacggctttgccccatggggggccttttttacacactgcgaggcccagctttttaggggacttttgcacatgtcatgcagctcagttgggagctgtttaggtggaaaactccaaataaagtgcggctgtcgca

SEQ ID NO: 622472 - DNA, 144 bp, Homo sapiens
ccggtgtgtagtagtctaagatccggcggcggtggaagatgacagattgatactcttctcgaatcgtggtgtggtgcatggcgtcttagttggggagcgattgctggtatccgataacgaagagatcttgcatggctactagta

SEQ ID NO: 622473 - DNA, 84 bp, Homo sapiens
gcggccgcctactactactactgctcgaattcaagcttctaacgatgtacggggacatgaaggtaatatggtccatcgtgttaa

SEQ ID NO: 622474 - DNA, 824 bp, Homo sapiens
atacgaatgtcttcgtctatgctcgaggcacctccaatgctgaaaaccttgagtgatgccacaagcaaaatttgtatcagagaataacaatttaccaatagacaatacgcacagatagttaaagcacacatggctagctgtatgccgagtcatgctggacaacaccggcactacagaagcagatttacaactgaagagacagtgtcattctgcttgcacggtactggtgggtgtcataatactctatgaccacgtacataccagtgggagcatatgcttaacaaacttccaacaattgcctatgcacggctagtatcacacgtccttaaggaccaacctcctaatagtgtggaaggtcttctacaatgctctcaggtacacaaccacacacatttgcactgcatgacgactacctaccaagacaacatcaaagtccatgctgcacataaccaatcctggcactacagcacctgcctgtcagacagacagaccagctactccttgccagtgactggagaatggcagctgttcaacgctgatctgccacttacctactctcactagattcctggctataacatgccatcccctactggtccctctatcccttctattagaactcaatgatccttaaggactatcttacactggttgcctaacagtccagaacacagggttaccactacatgcaaggggcatatcaattcctttatccaaacgggggcccctctaaaggtgcagctctcacttatatgtgcccttggccctaggaggagacctcataatggtagcacacacattcttgctgaccttggaactaacat

SEQ ID NO: 622475 - DNA, 189 bp, Homo sapiens
gcctagaggatgctgtatttgcaccacagcaggtagacgggtaggggagttgtgttcaggcagagctgccacccacgtgctgtcccacggaccacgctgatcagggccctgcctctgctccccacagctgtccttgtgcccaagtgcaagcctggcacaggagctggtgcccagcgacacaggcgttaa

SEQ ID NO: 622476 - DNA, 1004 bp, Homo sapiens
  misc_feature (43)..(43): n is a, c, g, or t
  misc_feature (273)..(273): n is a, c, g, or t
  misc_feature (304)..(304): n is a, c, g, or t
  misc_feature (312)..(313): n is a, c, g, or t
  misc_feature (361)..(361): n is a, c, g, or t
  misc_feature (434)..(434): n is a, c, g, or t
  misc_feature (440)..(440): n is a, c, g, or t
  misc_feature (449)..(449): n is a, c, g, or t
  misc_feature (451)..(451): n is a, c, g, or t
  misc_feature (464)..(464): n is a, c, g, or t
  misc_feature (480)..(480): n is a, c, g, or t
  misc_feature (551)..(551): n is a, c, g, or t
gagtctcgtcgcgagaagcagcggccgggcgacctgagcgganaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaatggatgatatgagtagtcgcattgatgacttctggaaaagaatatcgcggacctcatgacancaggctggggtggaagaactgaaagtgaaanacaagatnnctgccagcaaaagagttgaaggtggtaataatttatactgaatctggntttttccaagccaagagaagatcgaatggttttggagctaactactatgtgtagacaggttttatattataangtatgnattcttatnanctagtatatagtnagttgtagagtgattnccccccagtttcttgaacatggtatcttcacatctgtggaccttggctcagttgtgctattcattattaanacactaaaactttgggggttcttggcataacattgtcagattttttagtgtatttctgtgaagtcatttctttccttgtcaattcctttgtagttagtgctggtcggatccaaagtcgactgtgtgattttttattaaacaaatagtaaacccttcaatcatagcttacgtctctgcgcgaccgtaagatgcttcgtaggactctagcagctcctttaactccttggcacaacgtgactgttgagctaacaccaaatagtgtgtctggcaatactttttcaacatggctgaaaacacctaaaaccttggcccattcacgaaattctctgtcactggctctgttgccaaacctcagacataagaaccttacgaccgtttgcctggagtccccttagatccactgcttaaaggtcgctcgacaacgttaacccctggccccggtctggtggttcc

SEQ ID NO: 622477 - DNA, 218 bp, Homo sapiens
  misc_feature (19)..(19): n is a, c, g, or t
  misc_feature (214)..(214): n is a, c, g, or t
tgatctagcaggagcttanagctcgcactcttccctcttatgaaaattaatgaaatccagatcagaattttcttgcttttaaattgccttttttaaaagatttatttaaagttgggatagtgtcactatataaaaatatttatgaaacaatgaaataccagccaccagcgtttctcaggaggctgtgttaacttcttagaagcaagtggcttcnctgt

SEQ ID NO: 622478 - DNA, 107 bp, Homo sapiens
  misc_feature (66)..(66): n is a, c, g, or t
gaaaaaagagaaaagagggaaaaaaaaaaagtctcatgaccgacatccaaattaaatggaggaggncggccccctcccccccctggattttttttttcccttggaaa

SEQ ID NO: 622479 - DNA, 5361 bp, Homo sapiens
  misc_feature (5336)..(5337): n is a, c, g, or t
  misc_feature (5339)..(5339): n is a, c, g, or t
  misc_feature (5341)..(5342): n is a, c, g, or t
  misc_feature (5345)..(5345): n is a, c, g, or t
  misc_feature (5347)..(5348): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatcatctctgtgcgtacagcaatgtggagccccggggctgtgcagtccagcactgctgtccggctcagcagatccggaaaggggaggatactcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622480 - DNA, 772 bp, Homo sapiens
  misc_feature (43)..(43): n is a, c, g, or t
  misc_feature (319)..(319): n is a, c, g, or t
gagtctcgtcgcgagaagcagcggccgggcgacctgagcgganaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaatggatgatatgagtagtcgcattgatgacttctggaaaagaatatcgcggaccacatggtatcttcacatctgtggaccttggctcagttgtgctattcattattaanacactaaaactttgggggttcttggcataacattgtcagattttttagtgtatttctgtgaagtcatttctttccttgtcaattcctttgtagttagtgctggtcggatccaaagtcgactgtgtgattttttattaaacaaatagtaaacccttcaatcatagcttacgtctctgcgcgaccgtaagatgcttcgtaggactctagcagctcctttaactccttggcacaacgtgactgttgagctaacaccaaatagtgtgtctggcaatactttttcaacatggctgaaaacacctaaaaccttggcccattcacgaaattctctgtcactggctctgttgccaaacctcagacataagaaccttacgaccgtttgcctggagtccccttagatccactgcttaaaggtcgctcgacaacgttaacccctggccccggtctggtggttcc

SEQ ID NO: 622481 - DNA, 1276 bp, Homo sapiens
  misc_feature (559)..(559): n is a, c, g, or t
gtttttttttattatttattgggaaacggagtcttgctcctgttgcccaggctggagtgcgggggtgtgggtctcggctgactgcagcctccgcctacccaggtatacaggttctggctggcctcagcctacccaagtacgctgggagattacaggtggtccaccaccacacagaggctagattctggtattatttgggtggcgaggcagaggttatcgccatggtggcgcctggctaggtattgagaacctctctgtgagaatcttcagggtgtgactccgcccaaccttcaggccctcccagaaggtgcgtgagaatttacagggtgtgttagagccaccatgtgcccgtgggcccagaagcttgtgtgattttataaccgccagtataacagcgtgtgttgtgagatatatttggggcctcataagcagaagtataggactattgcgccagctattaccgtggtcttattaacaagagggcacatcactgggcctcacacttttataccccaaactccaagattttattaaaacacattgtgcctatagaccacgncaattgtgataagctcctccagacacacagcgtatttacaccactacttgcaacatattttcacataaattctacaatattaaaacttctcgtgggccaccatatgagagaaggttgaaaggggcaagtgaaccccttttcccaagcttatatacaatacgatgtttttaaaaaacacatacaagcctcttacacgagttaatattcgcgtataccaacaaagtttatacttcccaggacaaacattaatctcggaggtaccacacaaccgcatggcgcacgcagacaaggtataaaacataaacttagtagggagaagcccccacacggtgtgtggctccccgaggagcctctccacaggccttgtggagattgtgtataatgaaaacggcgccaggagaccacattgtctggagatcagtcggacacgcacgaaaactttccgacacacgctaaaaggggggcactaccccaaccatcagtctggtgacctgtggccgccatgtacaaccccggggatgaatcaacaatctgccaccttttgaagacctcataaccatcgcattcgtcccaaagacagaggagagtacccaccagcacaggtatttcccccaagctagtatatccttcgtccaacaggcattttctacccaagcaaaaaaggaacgacccgacaagcgatctaattgagcgcacattcccataaaaatgcacaca

SEQ ID NO: 622482 - DNA, 5558 bp, Homo sapiens
  misc_feature (5533)..(5534): n is a, c, g, or t
  misc_feature (5536)..(5536): n is a, c, g, or t
  misc_feature (5538)..(5539): n is a, c, g, or t
  misc_feature (5542)..(5542): n is a, c, g, or t
  misc_feature (5544)..(5545): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622483 - DNA, 938 bp, Homo sapiens
agcggagtacctcacctcagacatacacagattgaaaaatgttagaaaccaggaagacaactctactttttgcattgggggaataaacaaaccaactaaccaactaaaataatacacttactccaactaagacaacataggaagaccagagagatgatcggagtcaccagttgaagtacattagtcttgggatgataattccttatgacagtgtttatccaaatctgtcatggcaaatactacatcttgacagtgcccttagacttctgtctgaacattgctaaactgctgatggatcatgaaagagaatctgctcgggtttcatttcctgacgattattcactgaacgttttaagtcatcggaacaatactctcggacaacgttctgactacctccatactgacactgcctctttacacacacgcgacgcgaaagaactatccttgccccacggcacgaaccgacttcgccacacactctcttctctagcctcaccaaaccacggaacgcaccacactgacccgccagcacactccaatgaaactgcgttaccaccaaccacttctgctgcgacgaccaaagcctgcccaggatacctcaccacgcagcgtacccacaaattaccaccttgaatgcccccatacacactgcgcttacgtcatacatatcctcctgcagcgcatcaactctcgacacgcttgcactcacaccacttggcactccctgcgccactttacaacacaaaaaccccttgcacgcagcggacacccaactgcgacctctgacttgcattcaacagcatcgaaaactacctggcccaccaaaccctacgaatacacgggcccaacaagcacggccacatgaccccaggcaccgccttggacaactgcacccttgcaaccccctcacggaaaacgctctgtaccaccccaaaccg

SEQ ID NO: 622484 - DNA, 5458 bp, Homo sapiens
  misc_feature (5433)..(5434): n is a, c, g, or t
  misc_feature (5436)..(5436): n is a, c, g, or t
  misc_feature (5438)..(5439): n is a, c, g, or t
  misc_feature (5442)..(5442): n is a, c, g, or t
  misc_feature (5444)..(5445): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatcatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622485 - DNA, 108 bp, Homo sapiens
cccccttgcatgtaccaggggggtgaggtggagcacgagcgcacgttttatgacccgaaagatggtgaactatgacttgggcagcgcgaatccagaggtaaactctgg

SEQ ID NO: 622486 - DNA, 5311 bp, Homo sapiens
  misc_feature (5286)..(5287): n is a, c, g, or t
  misc_feature (5289)..(5289): n is a, c, g, or t
  misc_feature (5291)..(5292): n is a, c, g, or t
  misc_feature (5295)..(5295): n is a, c, g, or t
  misc_feature (5297)..(5298): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatcatctctgtgcgtacagcaatgtggagccccggggctgtgcagtccagcactgctgtccggctcagcagatccggaaaggggaggatactgttgaagagcaacaaccactcaccctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622487 - DNA, 5831 bp, Homo sapiens
  misc_feature (5823)..(5823): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgcctgggccacagaacaatagaaggggaggtgggggcctcccctgggaccgggtcccgatccggattagatccgtggggcaggattagccctgttggtcccacgaagcctgggccactggtgcggtgacggtggtggggcgggcttcggaatccgtcaggagggaagcgcgcccgtggggccggagaggaagtaaacccgcgcgtccacctcnggaccgct

SEQ ID NO: 622488 - DNA, 5648 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgcctggtcgccatggtgaccggaaggagtaagcccgct

SEQ ID NO: 622489 - DNA, 537 bp, Homo sapiens
  misc_feature (1)..(1): n is a, c, g, or t
  misc_feature (109)..(109): n is a, c, g, or t
  misc_feature (129)..(129): n is a, c, g, or t
  misc_feature (136)..(136): n is a, c, g, or t
  misc_feature (142)..(142): n is a, c, g, or t
  misc_feature (144)..(144): n is a, c, g, or t
  misc_feature (150)..(150): n is a, c, g, or t
  misc_feature (178)..(178): n is a, c, g, or t
  misc_feature (180)..(180): n is a, c, g, or t
  misc_feature (201)..(201): n is a, c, g, or t
  misc_feature (205)..(205): n is a, c, g, or t
  misc_feature (220)..(222): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (238)..(239): n is a, c, g, or t
  misc_feature (245)..(245): n is a, c, g, or t
  misc_feature (249)..(249): n is a, c, g, or t
  misc_feature (253)..(253): n is a, c, g, or t
  misc_feature (263)..(263): n is a, c, g, or t
  misc_feature (266)..(266): n is a, c, g, or t
  misc_feature (300)..(300): n is a, c, g, or t
  misc_feature (304)..(304): n is a, c, g, or t
  misc_feature (326)..(326): n is a, c, g, or t
  misc_feature (332)..(333): n is a, c, g, or t
  misc_feature (340)..(340): n is a, c, g, or t
  misc_feature (377)..(377): n is a, c, g, or t
  misc_feature (381)..(381): n is a, c, g, or t
  misc_feature (401)..(401): n is a, c, g, or t
  misc_feature (408)..(408): n is a, c, g, or t
  misc_feature (410)..(410): n is a, c, g, or t
  misc_feature (416)..(416): n is a, c, g, or t
  misc_feature (422)..(422): n is a, c, g, or t
  misc_feature (425)..(425): n is a, c, g, or t
  misc_feature (434)..(434): n is a, c, g, or t
  misc_feature (440)..(440): n is a, c, g, or t
  misc_feature (445)..(445): n is a, c, g, or t
  misc_feature (456)..(457): n is a, c, g, or t
  misc_feature (459)..(459): n is a, c, g, or t
  misc_feature (532)..(532): n is a, c, g, or t
nattccaaagttaaatgtacaatccacagtacatcagagagagacacaataataaatgtataatcaaaggtactattattgatcacaatttattttaaagtcaggaaangcctgcaataggctggccanatccttncctggntncatggntgcgtggggtggggagcgggggtgagtncnacaatgagagcgacacttccntttncaccttcctgggaannngtntgtnaganaaggnnaagggngggngggnacggagtggnggnttgggccatgcaagagcagcaaataatagggaanaggngtgcagtaaacatctgagtgcngagtcnngggtganaaaggcagcaagaaaaatgaccacagaaggaaatggntganagggatttcaactctgaacnttttaananaatgcnagaganaanaagcgtttnaaaaanggctntctgccaccgnnanagagggcagcacaatccaaagataattttctcttctctgtgattttttaggttggtgcacagagtggtctgcntctgt

SEQ ID NO: 622490 - DNA, 5732 bp, Homo sapiens
  misc_feature (5712)..(5712): n is a, c, g, or t
  misc_feature (5715)..(5715): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgcctgctgggccggtcgagctgtgcggtgccctccgggacgcagggggcgctgcagccacgctgggtcaggctccgcagggccctcccaacccggggactcngcnccggtgacgacttcgct

SEQ ID NO: 622491 - DNA, 5668 bp, Homo sapiens
  misc_feature (5643)..(5644): n is a, c, g, or t
  misc_feature (5646)..(5646): n is a, c, g, or t
  misc_feature (5648)..(5649): n is a, c, g, or t
  misc_feature (5652)..(5652): n is a, c, g, or t
  misc_feature (5654)..(5655): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtccaggctgggtcttgtgccagatccccaccatgcttcagtgctgaggccttgcacacctgggtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622492 - DNA, 4825 bp, Homo sapiens
  misc_feature (4800)..(4801): n is a, c, g, or t
  misc_feature (4803)..(4803): n is a, c, g, or t
  misc_feature (4805)..(4806): n is a, c, g, or t
  misc_feature (4809)..(4809): n is a, c, g, or t
  misc_feature (4811)..(4812): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622493 - DNA, 4662 bp, Homo sapiens
  misc_feature (4107)..(4107): n is a, c, g, or t
  misc_feature (4110)..(4110): n is a, c, g, or t
  misc_feature (4116)..(4116): n is a, c, g, or t
  misc_feature (4124)..(4124): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgaaaccaacacaaaaaaaancanaaaaanaaaaacanacaaaaaaaaacaacagaacaagaaaacaaaaaaaaaaacagaaaaaaaaaaaagaacaaaagaggagaaaaccagacgagaaacaacagacgaaaaacagcaagaacgagagagggaaaacaacgagagggaggagcggaggaacagagaagaaggagaagaggacaacagagggacggcggaccagaagagacggtaaggtaaagaacaaccaacaagggacaacaccaaacaaagaaacgccgcgacgaacaagcaacccgtggcgaccacacaaaaaacaaacagcaaggaaaggacagccgaagagcgaaacgcccaaccgccgacatgctcgagacatagcacagacggcgccgcaccggacgaagcagcagcaacaaacacaaacccgagcgggcaggacagcacaaaaacaacacagacaacagcagacgcaacgcagaacaaagaagcagagccaacacagcagagcaggaaccacgccagcaaacccaagcacaacggagagcaccacagagcaagcaggaacgacga

SEQ ID NO: 622494 - DNA, 358 bp, Homo sapiens
cagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaaaagttttttttctttttatgggggtgcaaggaaggggtgcacccaggtccaagcatgtatagctgcatagattttttcccctgatcttgggtggaaagatcagaatgaagccagtggggggttaaattttcccctttccaaattctttaaaaattttttgggaggggtttgttttctccaaaataaagggtattcttttaaaaaa

SEQ ID NO: 622495 - DNA, 377 bp, Homo sapiens
  misc_feature (31)..(31): n is a, c, g, or t
tcgctccggttagcggtacagcctcctcccngcaactcaactactactattcgattcacttctatgcctgtatgtggtttgacaaaccggtttggtagacccacgttgcctattacagactggtaccaacaatgtactgggaggaatgctttgttgtcacctttctagaccctgtacatggtttgtgtcctccactttctgccttacctacttgtcattcttctgggggttggggcatctcagctacccgatgacagttcctgaacagcttcagaggccctgtggctgtaccgcataccgacgggatccgtgcacgttaacgattactaggactatgcagaaaccagtccgacgacactcttagtccgacgaaaacc

SEQ ID NO: 622496 - DNA, 231 bp, Homo sapiens
  misc_feature (3)..(3): n is a, c, g, or t
  misc_feature (9)..(9): n is a, c, g, or t
  misc_feature (19)..(19): n is a, c, g, or t
  misc_feature (24)..(24): n is a, c, g, or t
  misc_feature (34)..(34): n is a, c, g, or t
  misc_feature (43)..(43): n is a, c, g, or t
  misc_feature (66)..(66): n is a, c, g, or t
  misc_feature (81)..(81): n is a, c, g, or t
  misc_feature (89)..(89): n is a, c, g, or t
  misc_feature (91)..(91): n is a, c, g, or t
  misc_feature (94)..(94): n is a, c, g, or t
  misc_feature (104)..(104): n is a, c, g, or t
  misc_feature (173)..(173): n is a, c, g, or t
  misc_feature (194)..(194): n is a, c, g, or t
  misc_feature (201)..(201): n is a, c, g, or t
ganataganagagagaganagacngcagcaatgnagctcaaancgcttagcctagccacacccccncgggaaacagcagtnattaaccngnagnaataaacganagtttaactaagctatactaaccccagggttggtcaatttcgtgccacccaccgcgatcacacgattancccaagtcaatagaagccggngtaaagngtgttttagatcaccccctccccaataaag

SEQ ID NO: 622497 - DNA, 555 bp, Homo sapiens
  misc_feature (346)..(346): n is a, c, g, or t
gctcatggcaacctttagcaaagattgatcaaaccccggcgtgatacaacgacgtgcataatatacggctagtacgagctggtggatcgccgagctgactgttcggacaagatggactgctgctccttgcatctacagctctaggagatgaactatgcccggctgcagcctggtcagagaactgggtgagctggaaaagtggaagtgcgtgaagacccctagcagcaataaggatctcaaagttcatgtgtgaaaagaatcaggatttacgcagcgtaaacattcagatccgggaagtttttgcaaatcgtttcactcagatgtttgcagattatgaggtgctatntggtgctatcccaaacccagccaggataaggaatcctggtttaccaacagggagcaaatgcaaaactttgataaagcatcttttctgtcagatcagcctgagccctacctgcccttcctctcaagattcctggagacgcccaagaagtggttgtggcatctttcattgacaacaaaataatgtgtcatgatgatgatgataaagaccct

SEQ ID NO: 622498 - DNA, 341 bp, Homo sapiens
caccaggcgcacttctggcggaccgtgcggggtatgctgccccatcaaacaccaagcgaggccaggccgctctggaccgtctcacggtgtttgacggcttcccaccgccctacgtacaagaaaaagcggtatggctggttccctgctgcctctccaggatcgtgctgtctgaacgcctacaagcacagtttgcctatcctggggcgccctggcctcaccggagtgttggcttggtaagttaccacggcaggtgacacgccaccactggcagtgagaaagtgcgccatgaggtgcacgagagtgccgcctgggttgcagtagagtgcgaccttggctccgag

SEQ ID NO: 622499 - DNA, 424 bp, Homo sapiens
  misc_feature (79)..(79): n is a, c, g, or t
gcttcgtaatttgtcagcccaatttttgagaaatattctgtgccagcctgtgggttttaattttttaaacaaacgctgnttccagataatagtttttatataaataattgaaaaaaattttcttttgggaagagggagaaaatgaaataaatctccttaaagataactcaggagaatcttctttcccattttccgtttagaatgtttaaggttaaaaaaaaaatagtccatatgcttgtataaaaccctgttccctgttttttttaaaaaaaaaaacttgatttgttattacccttgatctgctgcccaaacctgggaatttgggttgggtatgcgaatgtttcagtgcccccgcccaatgtgtttttaacttatgtaaaaaataagtctggaaataaatgtctgtttatttttgtccttttta

SEQ ID NO: 622500 - DNA, 902 bp, Homo sapiens
  misc_feature (1)..(1): n is a, c, g, or t
  misc_feature (3)..(3): n is a, c, g, or t
  misc_feature (7)..(7): n is a, c, g, or t
ngntccnccccacgggagacagagacaacgaataaaaggtcaagcgagaaaacagacaaacccgatcgtactcggttgttcccggtcgcccccaaggtgcctccccggtccccgctcccggtgttcaacggggtgacacccggattaaatccccggaacaaactggactgcgtgataaaaaatggccgggcctcagaatccatgtccggggcagtcgcctcaccacaccggtataccttgccagcgtcaatactgtgaaaagcgaccccaaccaaataaggggggacgattcttgttgatcagcgccgtttaatctaatctcttgtgttcagcgcttcccggcccccctgttgggtgacgtcccccaagggttcggtgtgtcaaaagcttcccccctttggtggtccaacatgccccgtgttggtcttttctcaagctgatatgcagcaaaggggttgaagaccccgttgctgcacaataacgaattgcacggtctctcactcgagcccacatatgttgcggaactcgctccccctgcacggggtgtatagaaaaggtcccaaaatgctgtagacatgtggccgacacccacgcaatggagggtcacccacaggggaccgcctcaacccactttttgtcctgaaccaaaccgggaagagcggcgcataatatgggcatgacctacccagtggaaccaagagtctagagactccaaaagtcctccctcgtcgcttcgcgaacaagcggcggatcaccggggccagaaaagggcagacctaccacgcccacgcagaagtgcactccctcggaatcccgcggctcaacgagcaggaacacaaaagggggggggaaatcttttggggaattttctgaaaaaagttccaaatcccacccacaaaaca

SEQ ID NO: 622501 - DNA, 410 bp, Homo sapiens
ttaacaccataactagtatctctctgatccacgctgagattcaccccatttccccaaatttccttctttcctgttcctcaccctgatcacgcttgatttattgatggcggttccaccaggcctaatcaccacacaccagcaaaggcaggctatgctatagtacaagccactagcccgcctctcagaacctccatttcctttccatcgtggaactctatcttcaaggaaataacttctcagagttccatctgctattctactactcctcagggattattcaggccccctcccttccctaaacatcaagctcgaggatttgccccagcccggactggccaattagcttttctctaaatgccctgagtcaaattactgaaataactcttagtctaagtaaaaactttcaatgg

SEQ ID NO: 622502 - DNA, 154 bp, Homo sapiens
tccttcatcatacctacctaagccaccgcactcagacgcaaaaagttcttaacctaggaaggtgaactgtgagagttgcactttactctgtcagtttctgagttggatgagatcgttgagagcctgcagggagaactgcaggtcctttgaaggg

SEQ ID NO: 622503 - DNA, 115 bp, Homo sapiens
ccttatgtttactaatcacatgttttgtgtgctgtgacgactgtcaaaaagtatctggccatggcggaccctcagcatttgttgattgaataaatgttagctcctctccttttga

SEQ ID NO: 622504 - DNA, 392 bp, Homo sapiens
catagtggtattgcattttgttcatttttctgtacaatacattctggtttttattactatgtagtcttgaaatacagtttgaaattataagtatggtatctttctgctttgttctttttcctcaagatagcttgggctatcaaagttatcttagtttcatgtaacttttagaatcgtattttccactcactatgacaaaaaataccactggcaattttggatagcaaagtttattggaattctatacgatcacttcgggatcaatattgccaatttttcaacattgatttgggatctatctctcaattttttacttattttttattggtaacagattttttaccctccttggttaatttatttttctacagaagtatattatttaatggcta

SEQ ID NO: 622505 - DNA, 360 bp, Homo sapiens
ttgccattatgaaaacctaactagctgggcgtggtggctcatgcctgtaatctcagcactttgggaggccgcggccgggcagtccacctgaggtcaggagttcgagaccagcctaggcaacattgtgaaaccccatctctactaaaaacacaaaaaattagccaggcaaggtgacagccacctgtaatctcagctacttaggagactgagacaggagaatcgcttgaacccgggaggtggaggttgcagtgagtcgagattatgccattgtactccagcctgtgtgacagagtgagactctatctaaaaagaaaaaaaataacaaacctaatgaatatgattggtcccttatctccatac

SEQ ID NO: 622506 - DNA, 854 bp, Homo sapiens
  misc_feature (44)..(44): n is a, c, g, or t
  misc_feature (247)..(247): n is a, c, g, or t
  misc_feature (277)..(277): n is a, c, g, or t
  misc_feature (279)..(279): n is a, c, g, or t
  misc_feature (294)..(294): n is a, c, g, or t
  misc_feature (298)..(298): n is a, c, g, or t
  misc_feature (314)..(314): n is a, c, g, or t
  misc_feature (322)..(322): n is a, c, g, or t
  misc_feature (333)..(333): n is a, c, g, or t
  misc_feature (365)..(365): n is a, c, g, or t
  misc_feature (402)..(402): n is a, c, g, or t
  misc_feature (412)..(412): n is a, c, g, or t
  misc_feature (474)..(474): n is a, c, g, or t
  misc_feature (531)..(531): n is a, c, g, or t
  misc_feature (533)..(533): n is a, c, g, or t
  misc_feature (536)..(537): n is a, c, g, or t
gcccttgtcagtggaggtggagttcggaggtggtgcggagctcntgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaagttctggtgctgattaacgatgccgactgggagctactgggtgagctggagctacncagcttcaggaccaggacagcgtcctcttncnatctccactctgcancggncggctgagggcccttnctctgggncctgggcaccncttagaggggagaacgaagcaatcagacatcncccttgggccctggcttccaggtctcccgtgtccccncttgccgtgnccttcttccctgctctgtcccctaagctccctccaggcagggaaaagaggccaggtgctaanaatgagcctttctcaagcacgtgagcagcggaaggcagacaggcgccagagcccagnantcnnttttccagcagctgtggtgggggagggttcccctccagtttgtcaagagttgaaggaggtctgtggccaggtgacctgggttgcttccactccttgtacctcagtctaaacattggagttgggcgctgacaaggcgctccagcccccagagccagcgtcttcatggggaagatgaatggacctgagtagctgaagggaaggcacttccctaaccaaaagactggaaggtttctcacagctcaatttcccctgtctgtaacaagtgagggctctgcctgtcccccatgcttatcagtatggaacccagttggggtcca

SEQ ID NO: 622507 - DNA, 173 bp, Homo sapiens
atgagtctgacttcggcgacgacgcgtatgatgggcagtgaggggcgcatatgatcctaggctataaatatccggagtatacgtagccggtaatgtaaacaacgtacctctaaaggacactaatagctagcatgcgcaaaatttaaaaggcgctgatatcgatcgcggcgcag

SEQ ID NO: 622508 - DNA, 180 bp, Homo sapiens
ttcatttccaacttgacaatgtcagacttacttagaggactatttaggtctcaacttaccaagagagttcaacggatgaccctaaagatgtgcgtgccaggtaaagtcgtgactcttacgtgagctctggactgtatctatattatccatcaggagtgagactgagtgcatcgtcatatt

SEQ ID NO: 622509 - DNA, 131 bp, Homo sapiens
gcccgaggttaatgataacaatgcatcgtaaacccttcagaaggaaaggagaatgttttgtgggcccctttggttttttttttggggggtggcagttttaagttaatagtttttaaaacccgtccttttta

SEQ ID NO: 622510 - DNA, 118 bp, Homo sapiens
aagtatttcatgtttttatttcaaaagaaaaaaggataccaatgaagcagaagaatgaagcagttaaaagccagcaaagctgcaaaagtaggaaagaaagctgagggagagattgatc

SEQ ID NO: 622511 - DNA, 145 bp, Homo sapiens
gatattccatcaagtgcacttaatatagtactacacattatcagttgatcgacattcaagagatctccaagttagaaatgggatcttacaaaaatactattactaattatcaagttgtatgtatcattgtgtattctcagtgaaa

SEQ ID NO: 622512 - DNA, 601 bp, Homo sapiens
cgcgtaacgggaagataccttgcgattgcttggaaacaaatcgcgccttccgtcactagtaaatgggtgcatcgaggcgcgattgaggccctggatcgccaggtcgctcaagacggtctgaataaagcgcagctaatgcgcgatttctgtcggcgatggcggctcgctgattgggctggtgaacaaagcattgtgagatctgggccggtgactaacgccgtggaaattgtgcctattacagacagacatagtccctagacaatggtagtatcgcaagcttaacaattgtaagcaatgctcgactggaagacacgccattttcagcaacaccgttgacccgacacgtgaggcaagcgaccaattctacgcgtcggatagtgctatataacacatctatcgtatggcactggcactggcattggaccccaagatcgcccacaggcagcaacatgacagcagacgtgggacatgctatattgtaggcaccaaaagaacacaacttaggggttgcagccaaagtgggttaccccaaatccatagaaaattgggagataaatattaaggaataaaaggcctatactaaccaacaataataatacat

SEQ ID NO: 622513 - DNA, 389 bp, Homo sapiens
gctgacaacaaggtatgcaccaacagtacacaagccatgtaactgtgctttaaatatttcaatgtgtgggtaagctctttcatatggagctgctattttgattgggtaagtttgtattctgtagcagctctggaactaaattgaaatttcgagaaatcactgaataagaaaagatactacataaagtgtgtgtgtcttattcaagacgaattgagactttgtcccgctctaacagtgatttgctctaacgcatataagacaccgttagctcccagaagggcattttgccatttaaaaaattatagtattatagactacagtcaatgggggttattaatttaaaccttattaacctcaaaagtgctactttcaacaagattaagtaagac

SEQ ID NO: 622514 - DNA, 155 bp, Homo sapiens
agctggaagactgcaggcctgactgtaacttcagagtaactgatgtcatcggaggtacagaggtccagtttcaggttcgggctgagaatgaagctggagttggccacccagtgacccacagaattgctattccattggaggattccaacaggtct

SEQ ID NO: 622515 - DNA, 204 bp, Homo sapiens
  misc_feature (54)..(54): n is a, c, g, or t
  misc_feature (56)..(57): n is a, c, g, or t
ggggggccccccggaaaaaaaaaaaaattgcccccccacaggggggggggggangnncccccccccccggggggttggcccccccccctttttttttgtgggggggggccccctttttttaggggggggggggggccccccccccccccctggtgttttttttcggaaaaacccccccccctttttggggggggggccttttga

SEQ ID NO: 622516 - DNA, 483 bp, Homo sapiens
  misc_feature (342)..(342): n is a, c, g, or t
cgtctttttttttaaacgatcaacacgagcagtatcacatccttccattgctctgtaagcttttggcgccctggcccagctttgccctgctgtggcaagttttcgtttgggctacaatgttggtgccacttctgctgcatgtcctctagggggctctcatcccacagcagtcatctgtcataggttagacccctccctaaagtaaacaacacctgaaaggcatccatcggtgcatgccagtttctggtggcaggctgaacctgcagcttcagcttgccatgtaaattagagactggaaaggcttctctgacttcaatcttcctcttctgcaaaatggagatnagaccttcctggaaaggttaaaataatgaaccataggtgaaactgcctggtctagccccaggcttgtcctgggagctcaggaaatgctgatgaaagctggatggagatggctcaggggagcccatgcctttcattgggata

SEQ ID NO: 622517 - DNA, 4878 bp, Homo sapiens
  misc_feature (4853)..(4854): n is a, c, g, or t
  misc_feature (4856)..(4856): n is a, c, g, or t
  misc_feature (4858)..(4859): n is a, c, g, or t
  misc_feature (4862)..(4862): n is a, c, g, or t
  misc_feature (4864)..(4865): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatcgtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622518 - DNA, 5464 bp, Homo sapiens
  misc_feature (5439)..(5440): n is a, c, g, or t
  misc_feature (5442)..(5442): n is a, c, g, or t
  misc_feature (5444)..(5445): n is a, c, g, or t
  misc_feature (5448)..(5448): n is a, c, g, or t
  misc_feature (5450)..(5451): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatcatctctgtgcgtacagcaatgtggagccccggggctgtgcagtccagcactgctgtccggctcagcagatccggaaaggggaggatactgttgaagagcaacaaccactcaccctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagcctaagggaggacaatcataactgtggaagtacagtatacttggtttgggagaacctacagggctgggagtcactaaccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622519 - DNA, 109 bp, Homo sapiens
ggtgaggacggacgctgactggcgaacaggtacacattcaccacattgccacactgttaccgactgtgaggacgatggcggtggacggcaactgatggcgactggacgt

SEQ ID NO: 622520 - DNA, 5737 bp, Homo sapiens
  misc_feature (5712)..(5713): n is a, c, g, or t
  misc_feature (5715)..(5715): n is a, c, g, or t
  misc_feature (5717)..(5718): n is a, c, g, or t
  misc_feature (5721)..(5721): n is a, c, g, or t
  misc_feature (5723)..(5724): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacacctgcgggagaacgggcgtgtaaaagagccacggcacggggcccatctcccggccgcacggccccgcccggctcacgcccacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622521 - DNA, 265 bp, Homo sapiens
gggaagcgcgcctcaagccacatggataccaactcattcagctctggaaccttcatatagcaggtcagcgtggcctgactgtcgaagaacctgagggccacagggatggcactcagggcctggagaaggctgctactcagtccttactgctgaacatactgcttgtatcaggaaactcagaagccgcttgccttgacaaattcaatctcaatggccattgagcacataactgagcacccatggctgactctgctattatgtatta

SEQ ID NO: 622522 - DNA, 189 bp, Homo sapiens
gtaactcccaaactcaagcaatctgcttgctgtaattgtgctgagattacaggcatgagccactgctccagcctaacctttttttcaaaactaattttggtgtggtaaattgcaatatgctaggggaaaaaatcagtattcagaacttgaggaagccaatcatcagattcatcagtcagaacctaccag

SEQ ID NO: 622523 - DNA, 5830 bp, Homo sapiens
  misc_feature (5805)..(5806): n is a, c, g, or t
  misc_feature (5808)..(5808): n is a, c, g, or t
  misc_feature (5810)..(5811): n is a, c, g, or t
  misc_feature (5814)..(5814): n is a, c, g, or t
  misc_feature (5816)..(5817): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagcctaagggaggacaatcataactgtggaagtacagtatacttggtttgggagaacctacagggctgggagtcactaaccaggcctgggtggctgtcctcgggccaatgccatagagcctcttgcagctcagccagcacagagaggagatcctcagtcactgaaaagagaacagacaggtgctgagactgacaagaagcagagatgtgcccctaaccccctcctgccttttctggccctgctaggcttcaggtcctacccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622524 - DNA, 788 bp, Homo sapiens
  misc_feature (788)..(788): n is a, c, g, or t
gcgtgggatgaggagtcggcccagctgctgccgcagctggaaggagacgcaccgcttcattgaggctgcaagagcacagggcacccacgtgctggtccactgcaagatgtggcgtcagccgctcagcggccatccagtgctggcctatgccatgaagcagtacgaatgctagtctggatgcaggccctgctgccactgtgcaggagcttctcggcccaatcgccctgcctccgaaccctggcgttcctgcgccagctgcagatcataccagggctagtcctgacggccgaagccgccatagccatgtctgggagcagaaacgtgggtggggtctccccagagtgagcacccagccccgtgaagtcatctactaccattcccatcctcgttccgccagaagcctgagcggtggtggggcaggaagaaggtgtgtacgtgcatgggctgagagccgaggctcgtccctgaaagagacatccttgaggcctctggatcgacttagtagtactctctctgaggggggtctcttgatgggtccatcagctctctctggagggcccgtccccttgggagacttgagaagatcatgcgtcagtaagatccaagtggaccattgacatgacaggtcgttcatctttcttgcagcggaaggtcgttgcaccattgataggacgtccgtcatgccatgcccatttcgacataacgactttgcgacggtgacctgatgcggaaagagccagcgacaaggattggagcatggcggtccgcactcaagaccttggaccttn

SEQ ID NO: 622525 - DNA, 929 bp, Homo sapiens
  misc_feature (145)..(145): n is a, c, g, or t
  misc_feature (298)..(299): n is a, c, g, or t
  misc_feature (303)..(303): n is a, c, g, or t
  misc_feature (317)..(318): n is a, c, g, or t
  misc_feature (324)..(324): n is a, c, g, or t
  misc_feature (329)..(329): n is a, c, g, or t
  misc_feature (353)..(353): n is a, c, g, or t
  misc_feature (367)..(367): n is a, c, g, or t
  misc_feature (371)..(372): n is a, c, g, or t
  misc_feature (379)..(379): n is a, c, g, or t
  misc_feature (392)..(392): n is a, c, g, or t
  misc_feature (395)..(395): n is a, c, g, or t
  misc_feature (411)..(411): n is a, c, g, or t
  misc_feature (420)..(420): n is a, c, g, or t
  misc_feature (423)..(427): n is a, c, g, or t
  misc_feature (436)..(436): n is a, c, g, or t
  misc_feature (440)..(440): n is a, c, g, or t
  misc_feature (444)..(445): n is a, c, g, or t
  misc_feature (449)..(449): n is a, c, g, or t
  misc_feature (451)..(454): n is a, c, g, or t
  misc_feature (457)..(457): n is a, c, g, or t
  misc_feature (461)..(462): n is a, c, g, or t
  misc_feature (468)..(468): n is a, c, g, or t
  misc_feature (470)..(471): n is a, c, g, or t
  misc_feature (477)..(478): n is a, c, g, or t
  misc_feature (482)..(483): n is a, c, g, or t
  misc_feature (503)..(503): n is a, c, g, or t
  misc_feature (512)..(512): n is a, c, g, or t
  misc_feature (519)..(519): n is a, c, g, or t
  misc_feature (525)..(525): n is a, c, g, or t
  misc_feature (540)..(540): n is a, c, g, or t
  misc_feature (543)..(543): n is a, c, g, or t
  misc_feature (550)..(550): n is a, c, g, or t
  misc_feature (555)..(556): n is a, c, g, or t
  misc_feature (559)..(559): n is a, c, g, or t
  misc_feature (562)..(562): n is a, c, g, or t
  misc_feature (593)..(593): n is a, c, g, or t
  misc_feature (603)..(607): n is a, c, g, or t
  misc_feature (609)..(609): n is a, c, g, or t
  misc_feature (621)..(621): n is a, c, g, or t
  misc_feature (645)..(645): n is a, c, g, or t
  misc_feature (652)..(652): n is a, c, g, or t
atttatgtgaataatatagtactatcaacatagaaatcatgtgtataccatttaaaatcataatttaaatgattttcattttagcaattgctggcctgctggtatattataaacctgcttaaatattgatacatagtgtttaaanataatattataattatgcatttttggaaaataaacattcaataccttaattagttgcatacaattggatggctgctattaataatgttttacaactacagataatgcttctaataatattaaaaggtatataattccctttctgttatttgtnnaggnaaaattccgaaagnnttaggncagangatgcaatcttttttatgactctnaaactctaccatgnatgnnttttaanagggtcttaatanttnaccaacaatatgtggntctaccagngtnnnnnatctttggnagcnttgnntatntnnnntgngttnnattttncnnaattgnncagnnacaaaattgtgtctcactgnactcacgtngattttnttagcnacatttgggcattanggnactaacnatatnnggnacnatattttgagtatcttacatagatgggaacnttcatatttnnnnntnaagtttgatgtnattacgatggggtagatgcgcgtnagtaagngtgctggagctctcttgttctcaatctctccttttgtccttattcaccacaatgttaatttggagctgagagattcatcactgaccgcatctattacctttctgcttcaccttggctgctttggcaacttcgcctttggcacttctagcatgacagacatagctgcgcttgagatcctcagaggtaactttcttgatgctcaaaatctgagtgcttgtttcatcttctgttctactatgacttatactttcgttaatggtgaatcaatagtgatgtc

SEQ ID NO: 622526 - DNA, 5574 bp, Homo sapiens
  misc_feature (5549)..(5550): n is a, c, g, or t
  misc_feature (5552)..(5552): n is a, c, g, or t
  misc_feature (5554)..(5555): n is a, c, g, or t
  misc_feature (5558)..(5558): n is a, c, g, or t
  misc_feature (5560)..(5561): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagcctaagggaggacaatcataactgtggaagtacagtatacttggtttgggagaacctacagggctgggagtcactaaccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622527 - DNA, 1412 bp, Homo sapiens
gctgctcttgcgttcagtccgggtcgtcgggtccatcgagcgtcgcaccgtccttcgcaagtggcttgggaaaccggtgatcacacggctcctattcccaggtagcccactggtgctagctgtcggcaccagaaacgtagctcttccttgccggcttacggccacccgagagctctcagtagcctcgtgctgatctcgttttagcatgaagtccaggttcgacgcgcgcctcctagtagtggctgcgaccgtcctcatcggcccagcatcagtgtacctgtagatgtggattttcttggcatcagagctgcgagaatgtaggtcgcaaaactagtctgccagcatgcattatgctttcgcctggaatctgggtgctgtgcgtgtcactatcggcccacagttggggacctgcagtccaagaaaagttgaactcgtgaactctaatgccgattgatggacatcttgtgtcacttagcctttggatggggaggtgccaagtagcttggcaatggtatcacagagcgttttgacctcggcgtggccattgagtttgtttcccctcttcaatggcggtcgcacgagggggcccaaaagccgcaggaaagcgcgacgcgcaacgaggaattcccgagcagagtgccagcgttcgtggccgatggcaggacattccaaggaaacggtttatacacagaagaacaggaagagttcagaaagcacggggaccaacagcttacaggcgcacgcgaaagaaaccgaggtaatttcagcaacggtactataagccaagaaggagcgttatacccgttcggggaaagagaacttggcggccaccatatttatgcactaggaaagcacagtacaaagccacttgtggctagtctaacaaaggcgtcagtaaatcagagacgcccatttcatcagatattcgatgcccacatgattgggaacttccacgcggacaccaccgaccaggtctatctcatgttcatcgccttatgctatcacaccttatggccgtatcagcacggcaagacgacttgtgtgccaacccgcttgtggcattagtagctcgaaaggacctcggcatgaaacaaagggtttcggcccctcattggagttgagtatccacagtggatcactaacacaagggtagattacccggattccccaattatccaattaattaaccaacatggggcatagtcaactgaagctacaaaattgtacgggcacaggtcatatgcacgccaaggatgctcaaaaaaaacgtttcacaaacagtgacatcgcataacagatggctccagaactatgcacacacaagtgatgcccggtgaaaacatagcacacagcagctattcagttcctaccaggcgacgaaataagcaatgcgaacccacagattagtgacc

SEQ ID NO: 622528 - DNA, 5578 bp, Homo sapiens
  misc_feature (5558)..(5558): n is a, c, g, or t
  misc_feature (5561)..(5561): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctgctgggccggtcgagctgtgcggtgccctccgggacgcagggggcgctgcagccacgctgggtcaggctccgcagggccctcccaacccggggactcngcnccggtgacgacttcgct

SEQ ID NO: 622529 - DNA, 122 bp, Homo sapiens
tgctcctgccccttctgcctgggcgcggtggcgctgcatgtagtcccagctactcgggaggctgaggtgggaggattgcttgagcccaggagttctgagctgtaagtgatccacccgacctc

SEQ ID NO: 622530 - DNA, 381 bp, Homo sapiens
gggtgcacagcagcccatggggcgcctggctgtcggcgcggctgtgcaagtggctgcagtcccccagtagctgcaggctgggcctggccgtgctgctggggggcgcgttcgtgttctgggtccggctggacagggggtggtcgtagcccgttgtggaggtcgggcgtgtctggcagcgcgggtcctacactggaaggcaacttggtagggttgcccgcattcttgtggttggagggtgtacttctttcgtacgtaaggtttcctgtagttgctgggggggttgggggttccacaatgtttgggggcatcacctttgctttttagccagagttttttgcagcttcctgtctttacccccaaataaagtattgacccaagaga

SEQ ID NO: 622531 - DNA, 5677 bp, Homo sapiens
  misc_feature (5669)..(5669): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctgggccacagaacaatagaaggggaggtgggggcctcccctgggaccgggtcccgatccggattagatccgtggggcaggattagccctgttggtcccacgaagcctgggccactggtgcggtgacggtggtggggcgggcttcggaatccgtcaggagggaagcgcgcccgtggggccggagaggaagtaaacccgcgcgtccacctcnggaccgct

SEQ ID NO: 622532 - DNA, 5549 bp, Homo sapiens
  misc_feature (5524)..(5525): n is a, c, g, or t
  misc_feature (5527)..(5527): n is a, c, g, or t
  misc_feature (5529)..(5530): n is a, c, g, or t
  misc_feature (5533)..(5533): n is a, c, g, or t
  misc_feature (5535)..(5536): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 622533 - DNA, 570 bp, Homo sapiens
catgttgaagcagttcggttggatgagttcactaagccctaacacataaataatttcacttagctttaggagaccctcagactaatgatcgcttcatgaaaggtgtatttagttgttgaatccacacattcctaccccagatctctagccagacatgcttagttccccctctgttgttggcaccaataggatatgtgtccctttcgatccatgatggtctcattctctcggcagacacgctgctcaggaaggggcagaaaggtctccaccagggtcccacttttctgccccagccacattaccaatggtcaggttgaactgcaagcgacccttgtctctagcaaagctggaaaatggacccgtgtaaatgacacatggaacccagagccgaaagcatgtgatttctcaaaaagtgcttctcctgagagccatgcttttttcagttacgagctcagatgagattgcaacctagagcgtatttgtagaaagcacttagtttttttctcctcttcaccaatgcagtgggccagtgtcactaaataaataaagcaaaatgctacatcaggctca

SEQ ID NO: 622534 - DNA, 155 bp, Homo sapiens
gtgatgaccaggctgaggctttgtcctaatttcactctttgagaaaggggatgtcaatggatgagaaagagcagaaattctacactttcctaacacaactcctgtcctcccacctctggagctcctgtgtgtactatctgacctgcctctatctg

SEQ ID NO: 622535 - DNA, 4202 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcaaaaaaacattacaaataaataaaagaaaaaggggggggtaagatactccaggggcatgacgaaacctttaagagcacaaagaggaaaaaagggagggaacagtggagactg

SEQ ID NO: 622536 - DNA, 959 bp, Homo sapiens
catgttgaagcagttcggttggatgagttcactaagccctaacacataaataatttcacttagctttaggagaccctcagactaatgatcgcttcatgaaaggtgtatttagttgttgaatccacacattcctaccccagatctctagccagacatgcttagttccccctctgttgttggcaccaataggatatgtgtccctttcgatccatgatggtctcattctctcggcagacacgctgctcaggaaggggcagaaaggtctccaccagggtcccacttttctgccccagccacattaccaatggtcaggttgaactgcaagcgacccttgtctctagcaaagctggaaaatggacccgtgtaaatgacacatggaacccagagccgaaagcatgtgatttctcaaaaagtgcttctcctgagagccatgcttttttcagttacgagctcagatgagattgcaacctagagcgtatttgtagaaagcacttagtttttttctcctcttcaccaatgcagtgggccagtgtcactaaataaataaagcaaaatgctacatcaggctcatctcttctcttcagatattcttatgcatctcaccgtgttttggttgagagctagaaaccatggaatgaatgggcatccagtgtcgaccttcatcatttggccagagtagaggatggatggagaaggaaatgaacatttcttcaggtcccgccgtgtgctggtcgctctgcatgcatctgtctgattctcagaaccaccacgcaggggagatgaagttattattccccttgtaccaacgaagaaactgggattccgagaacctaaaccacttccttaaaatcacacatatattatgtgggtgaactgaaatttgaaccccaggaggcaggctctaaggcctgtgttcttccccgtagtacataatgattatctagccatttctacgacgc

SEQ ID NO: 622537 - DNA, 113 bp, Homo sapiens
ggagattttgaagtattttacttcttagtttctaattatgaaagtacttacatatattttagtaatctttgcaccatttcagagctgggtaaaccaaggataagaaaggtcag

SEQ ID NO: 622538 - DNA, 3939 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgctccctgtgcctggtaccctatacctcgtcgcgagatccgtagcggggaacctctagata

SEQ ID NO: 622539 - DNA, 862 bp, Homo sapiens
gggctttctcccaccgctttccgagcccgattgcaacctcggcagaatccccgactcccttctttatggcgtcgctcctgtgctgttgggccggaagctggcccgactgcgaacatcggtccatcagcagcttggggcgtggctcatgtgcgatacatggcctcgagcattcatgttctcaaagttggtccaattacgcggacgtggtgatagcgcttgtgacagagcacgttccccttatcacggggagacacacgtcatttgggcggcatatgggccacccacaagacacaattcatacacacccttttatcacggacggcacaatgtgcgagatataacaaaatgtgggtaatacccattcactgttgggaagggggcctgtttgtgaacactgtcccttcccttcgggacaggggcctttcatctgttttacactgggaccaaaaggttcccggggctgcaaattaacacgctgcacaagggagaaactccacccatttgtgagtggccagcataaagggggaccaccgcgggccggcgtgactaaatcccgcccgagcctccacacgggcccaccgacgcttcgatatgctacaaccggaagttgcacgcggcgaaacccggggtggccacccccaaggagagcagcgagctccccaaagcacgatggacccgggcggaccaccctcgtggacggcaaaacatgggagataacaccgcgggggcgacgcaagaccggacacgaggaacactcccctatgtccataccacaaattcgtaagtggaaccaacacgggacaccccccggatggacaaaaaggggacaatgaacgagacatggacggggaccgtgaacacg

SEQ ID NO: 622540 - DNA, 180 bp, Homo sapiens
  misc_feature (1)..(1): n is a, c, g, or t
  misc_feature (9)..(9): n is a, c, g, or t
  misc_feature (12)..(12): n is a, c, g, or t
  misc_feature (25)..(25): n is a, c, g, or t
  misc_feature (27)..(27): n is a, c, g, or t
  misc_feature (29)..(29): n is a, c, g, or t
  misc_feature (37)..(37): n is a, c, g, or t
ntcgtggantgncaccaggcgccgnananactaaagntcctgtgtatgctgagataacaccagtgaaaaagcctggcatggagcccagcactgagaacttccagaaagtgttagccttctcccaactgtgttataccaaccacattttcaaatagtaatcattaaagaggcttctgcatc

SEQ ID NO: 622541 - DNA, 304 bp, Homo sapiens
tatatattttttttaatgaaaggcaactttagattttccctctatccttgctttttttcccttcacctcccacgagaaatcctgctttccgcggtttcctctgttttgggtatgtacaacagtttttttttactactgaaacagagccaaacagcccaatgagcgttcttccgagagatggcatcgtgatgcgctatttattttccatagaaataggaggttagacggattgtctcttttctgaggggagggggtctttttgtccggagcccagttgatgccctcagttttcatatttattggc

SEQ ID NO: 622542 - DNA, 304 bp, Homo sapiens
ttgactgtaccttaatgctgtggtgatgttagactgtacctcttaatgctgtggtgatggacagtacctcttaatgctgtggtgatgttagactgtacctcttaatgctgtggtgatggacagtacctcttaatgctgtggtgatgttagactgtacctcttaatgctgtggtgatattagactgtacctcttaatgctgtggtgatggacagtacctcttaatgctgtggtgatgttagactgtacctcttaatgctgtggtgatggactgtacctcttaatgctgtggcacatagttcagcg

SEQ ID NO: 622543 - DNA, 101 bp, Homo sapiens
ctctatcagtaggttagaatctcaaaaataaaaagtacgtattctggagaaagagatgcaagcacaaatgggtagatttggcattgcctctaaaagcaagg

SEQ ID NO: 622544 - DNA, 408 bp, Homo sapiens
acactcctctgtgagccctattctaccactttgacctacaatccttaatccagaatctctgtttagtgggccaagattaataatagtatatagcctactccaactttgtgttatcttccaccatggtgccatcacgctgaatatccattcccacatatattctccagatttctttctgtataaattgtagtgtagtgtgtgtgtgtgtgtgtgtctaacgagagcatcaactgaaaaatcacacaatcccataactatagaatagagagcttcatttctgattgtggttcgcacgcctgcaaggtggccattatgacaggctgggaagtgtggtctagagacaaggctagaggcaggcccttccagggagggaaagagaggacgggattatgagttgattgggtagac

SEQ ID NO: 622545 - DNA, 867 bp, Homo sapiens
gtgctcgcttcggcagcacatatactaaaattggaacgatacagagaagattagcatggcccctgcgcaaggatgacacgcaaattcgtgaagcgttccatatttttactttacattcaataaatactgtttaacaccaaaaaaaagaaaaaaaaaaaaaaaaagaaaaaaaggaaagaagaaaaagaaagagaaaaagaaagaagaagaagagagagagagaaaagaagagaagaagaaaagaaagagaagagagaggagcgagaagagaagagaggaggggagaggggggggggaggagggggagaggggggggggggggggggggggaggggccccgctctgtgagggacaacgaagagaggaggaggcgaggcaagacaagggaggacagaaactgaggagaatcccgcgagcgaaacgaggacaccggacacacaagacaatagggagcacagagacaggagagggagagacgagcaacaagacaaaaaaaagcaggaaaataggaaccatgaagacaacaggaacaaaaacagaacgaacacgagacgagagagaggagcgacagagagcaacacagaaccaacaaaacaaagaagaagaaaaagaagaaagaacagaacaaaaaaaagaagaaagagacggagcagcaagagataaacgaagaagaggagaggagagaaggccacaagtcgtatgatgggcgaggacgatgggggggaggaagagaagagcgggagagcgaagacggaagaggcgctgagagaatatgcgagcacgacggacaagacagaagatgcaccgcaggggcacaggagaacggagaggagagagaagagaaggggagggggacgggggggaggg

SEQ ID NO: 622546 - DNA, 368 bp, Homo sapiens
agatcgagctcggtaccgacctcgcctctcacttcagcatcaagtgacctctgacctctggttcctggctttagggtgaagcccctctgctcagtggttgtgtccccagtgggatcttaagtcagcacctcttcaggcccatcttttgatggtcacttcctccagggcagcgtgtgtcaggtgagagatgtgtgggcagccgcagggtgcttgtggatttcgatggctggcccagtggaccattcatttcctgactgtctgccctttgcaaggcaattgctgggtacaggctctgtgcctccttgggtgtgtctgtgtttgggccccagaaaattcctgccggtggctatgcactttctctctccact

SEQ ID NO: 622547 - DNA, 897 bp, Homo sapiens
gtgctcgcttcggcagcacatatactaaaattggaacgatacagagaagattagcatggcccctgcgcaaggatgacacgcaaattcgtgaagcgttccatattcaaattgtcttaagtgatggtacatttgccaacgacggaaggtgcagaattacttaatttgaagatattatgatattctgaaataagctatttcgatcctgtagttctatgatgtatagtgattgtaaatgagaagcctaaccgatataaaatgtcctgactttagtctcatactaatcttgtgcagactgtctcggttcaatattccaaatcctaccatcttcagttgtgcgaccttgggcatgtacctaatctcttggtgcctcaatatcctccttttaaaatggggatgatgatgataacaataatacctacctcacaaggttgtggtgagcatcaatgagataagcacaagtaaagtgcatagaacagttccaagcacagagtaattcaataaagtattaactagtaatagtagtggtagataacgtcgtgaatcgttgaataacataataggcttgatttgattatcctctgtgaacgtggtaacgtgttggccctgttataagtgtatgtcaagtaggtagtgcttaagtcagtaccatgtccccatcagggaaccaatgagatttcggtaactaataccttgttatgtgtcagcaactaattgggtctaaactggttggcgcctccaccattttgcccgaataagtttctaaacgggacacatacaaaaacacaaagtggggcgccccaaggtcacacacgggggcgcccgaataaaccaccgcaacaatccgcagtggtgcccaaacgggcaggcaccagaatgagtaaagcaaccacgaaagct

SEQ ID NO: 622548 - DNA, 1400 bp, Homo sapiens
  misc_feature (923)..(924): n is a, c, g, or t
  misc_feature (926)..(926): n is a, c, g, or t
gagagatatgaatggaatgaacttgaacctgtttcttcatttgtgtgacaatttgagtacgaaaggtttcacatacctacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacatttccatggctgaattcaacttgctggaccatttactacctgtcattatgggagaaaagaactcaagtaacttcatgatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcacactgctctttatgggaaacttctgaaactccccacatnntngaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtatagggatgactaatccaactgctgaggtctccctttatgtgtttgatggaacacttggcttgctggactacagctgtgtgtttatgtgcagtgcacacctgcaggggcctgacaaatagctgtagtatgcagaggatacaaaattaccctggcagtgctgcaaataaggaagtttctgttttgaagtccatatgtgtgtgtgcttgagatgccagctggtgtatttatgttgcatgcacagatgtaaaactgccaactaattttacaccaaataaagtctaatctttttataaaa

SEQ ID NO: 622549 - DNA, 382 bp, Homo sapiens
ctcctttgttcccacctggagggcagtggggtgtttcggctccctgcaacctttgcctccctggttttagcattttcctgcctagttttccgggtcctggggatcaaatgtgtgccccccccccgggttaatttttgttttttcagtaaagaagggggttcccccattttggcccgggtggttttaaactttttacctcaagtgacctgcctgttttggcctcccaaatgggtgggatttcgggggcgagaccccgtgcctggccctggggacattttttcatgggctttgtttccttttttaaacaaactgggggttacttttttggtttgttgacttaagaaaaagaaaaaaaagaaagaaaaccaacaagaacaaagga

SEQ ID NO: 622550 - DNA, 319 bp, Homo sapiens
tgcacacgccgaggctccaaaccaaccaggtcgtagtgaggtcattatggacgaagttgttgcagatcgcgatggacgaagttgttgctgcacacgccgagaatccatacaataatggtactcgcgcagaatttatcttggattcaactcatcataaggagacatacactgagatagctggaatgcaacggtttggggctttttatatggattacctgtatacaatggagaacactagtggcaaaggttccacaaatctcccaagacattttcttctgcgaaaatgaagatttgcgtgactgattccaggagtcctgct

SEQ ID NO: 622551 - DNA, 209 bp, Homo sapiens
tccaacaaaaccagcactggtctttattgaggggtcagggtaaaatggcaggagcccagcctaaggacatgaaggtcaaagtttttcaaaaaggaggggctgggtccctgagctaggaggagggccgtgggtgactcgggagctcatgaaactttaggaagtccctgtacttggccagaaaagggttggccaaagtgttcaatttttgc

SEQ ID NO: 622552 - DNA, 379 bp, Homo sapiens
aatcgcttaagggaaaaaaaaatccgcctcggtgatcacatcgactgtatgatacctcagtgcttatgttcaagtcacctctactttatttcataatggccccagcatacaagagtagtgttgctggcaattcacatatgccagagagaagccataaagtgcttcctttaagtgaaaaggtgaaagttctagacttaataaggaaagaaaagagtcatgtgctgaggttgctaagctctgcggtaaggatgaatcttccgtcggtggcattgtgaagaaggaaaagaaatttgtgctacttttgctgtcaaaagtcaaacttcaaaagttatggccacagtgcatgataagtgcttaagcggatcagcggggatcctct

SEQ ID NO: 622553 - DNA, 132 bp, Homo sapiens
acatatcatacatcaaaaagtttgttaatgataacactgagtccaatatttttcttttttgaaatggatcctgtgtgatagagtgagactctatttcaaatatcaatcaaaaaacttgtatacatttttaaa

SEQ ID NO: 622554 - DNA, 270 bp, Homo sapiens
agggaaaacacatgacacaggaggggaacatcacacatcaggtggtggtggctacggggagagacagcattaggagaaatacctaatgtagatgacgggttgatgagtgcagcaaaccaccgttgcacatgtatacctatgtaacaaacctgcatgttctgcacatgtatcccagaacttcaagtataataataataattaaaaaaagaagttatcaatgtatctgcataatttcgaactttgtgtgtgtgtgtgtgttgtgtgtgttgt

SEQ ID NO: 622555 - DNA, 111 bp, Homo sapiens
agaatcctcctgttatacagctcagtcacgccccagctgccagtttttttctccaggcctactacagatgggccaggaacccgagtctgcacagcctcccgatgtatatat

SEQ ID NO: 622556 - DNA, 248 bp, Homo sapiens
atccgctgtgatgtcatccctgtatgtgcagctgtctgacttagtctgttgggcctggagacaggaccaggtaatgcctcagcccggccggttcagctgtcttccaggttctgtcctcacaagggtctgtcttcatccaaggtcgtcacaggagaccaagagctccagcctcaggcagggcaggagctcctactcaattgggaaaaatgctctgaaatgtcagggactcattcagagtcatagagcca

SEQ ID NO: 622557 - DNA, 833 bp, Homo sapiens
  misc_feature (178)..(178): n is a, c, g, or t
gcgggttttgccggcagaatacaggtgtcgtgaaaactaccccatacagagccaacaatgggaaaggaagaagagtcatatcaacattgtcgtcattggacacgtagattcgggccaagggtccaactcgactcactggcccatctgcagtctatacaatgcgcgctggccatcgcancagaagaaccattgagaaaatttgagaaggaggctgctgagatgcggaaagggctccttcaagtatgcctgggtcttggatagaactgaaagctgagcgtgaacgtggtatcaccacttgatactctccttgctggcaaactttgagaccagcaagtactatgtgactatcattgatgccccaggacacagagaactttagtcaaaatacattgacttaccacgggatcattctcaggctgagctgtgctgtcctgattgtggctgctggtgttggtgaatttgaagctggtatctccaagaatggtgcagacccgagagcatgcccttctgggcttacacactgggtgtgacaacagagataagtgtcggcgttagcaaaatggattccactgagccaaccctacagccagaagagatatgacggaacatcgtaaagcgaagtcagcacgttacattacgaacgacttggctatcaaccccgacgacacgaagcgatacgtcgccaaatgtctggttggaactggtgaaacaatgcgtggagcacaaggtgatcagcatgccttgggtccaagggaatggaaaagtcacccaggtagggactggcaaaggccaagaggaagccactgctggttgaggtctgggctggattccta

SEQ ID NO: 622558 - DNA, 236 bp, Homo sapiens
taatagtctcggtactgctgagaggtagatgatgcagggatgccaaatcaaacataaaattatagaaatctatcataggattgtataaggagaccaattttatttagatagggactatttattttttacctggatctctaagctctgggcagagcccacactgaatcctgggtcttcagagagagaattattttaaggttagaccacatgatgcttttacagtgcactttaaaaac

SEQ ID NO: 622559 - DNA, 456 bp, Homo sapiens
  misc_feature (144)..(144): n is a, c, g, or t
  misc_feature (193)..(193): n is a, c, g, or t
  misc_feature (325)..(325): n is a, c, g, or t
  misc_feature (342)..(342): n is a, c, g, or t
  misc_feature (422)..(423): n is a, c, g, or t
ggtggtccctgatggattttgtgcccccttaggagtttatgggtctgtgaggacacagggtggccttacctaccagcagacgttgtacctgggggtgaccttatgtacctgccactgttctcctcatgttgcccaagatgcctngcataaatgggcaggtagctatgcatctacagcttactgcgattgtgantgagccccctggtggttctaccccttgacaatgactatccctggagcaggtgtcataactgtagaagtacaagttactgttcttgcacagacacagccaacttccaagggtttccttgcacaatttcccaancccttggaagctgggancacatccctacctgattaactggatgaggttgattagatcagaacaggtggtgttagcgaaaagcttaacatggagcctnntaagagcacttagctttaagcttggctggcacc

SEQ ID NO: 622560 - DNA, 119 bp, Homo sapiens
atggacacgtcggctgggtgttagtgctccaaggaggtggcaccgccatccgtggggccatcatcctggtcagctctccatcgtcccgtgcgcgagaggctactgggggcggcagaggg

SEQ ID NO: 622561 - DNA, 966 bp, Homo sapiens
agtgaacaagggcacacacagtagtccctgtgtcatgcgccgtgccgcaagtaccaatcgtgtcccaatgtgaccctgaatggtggcccaaacacgtcgaattccccagaagggcgcctcctccctaacattaggggttggaagccctcacatgggcttcccggcaaactttttcggccacccgtgggtaccctcctcctgccccccgaataacaatttgtcgcgcatgaaaatgctcggtaaccggggaggtcatacacacacgagtattaaacaaccgctgtcacgcccataacggggtaccgaacggacgttccaaccactccgtagggaagtgaatacacggctgctcactgggggaagatagtcggtcccccccacgcgtggaggaactaatactaggtcgtcattcatttgtaccaataccaaaaaagggcatggcaccactcccaagagtaagagcctacaatgcacccacatgggcaggagcagcataactcgggaaagcatgaagctgccgcacacaagaggtctccgacccacagattggccgtagcaccaatccttattcttaaagggttacccacacgggatcacccccccgttcatcataacgaccactgagctccccgctttcattgagaacactccacgatgacccgccagggaatactgtgcgcagcgaacccccttgtgggtcaaactttataattttgtcgcccaccaagtgaggacaatccccccagcgaggccctcttttccattcgtccaccactccacagagcgggttccatggcgaaattcccccttgggaagagcatgagttgtcaaaacccctctatgatcgggcgtagcttatattcggattattcgccctggatcaggtttctctggtgccccaccatcttgcgcaccgcgacagaaaactttgaaaaaaattcttttggggtttcatcccacaaaaca

SEQ ID NO: 622562 - DNA, 249 bp, Homo sapiens
aagagagtgcacacgcagaaccttctgcctagaatactctttgcccacatatctagtacagctcactccctacaccatactatcaaatctctgctaccaatgccacctatctccgtagaggttactacctaaccatcctacatacacataggaacccctggtgatacccagaccttacgaagacctcctataatacctagctattatttactctaccataagcactaagtactccatactagataacat

SEQ ID NO: 622563 - DNA, 220 bp, Homo sapiens
ggtagcagtgtggatgcggaacacaggacgggtctgagcagagtagtccttgatcccgaattcattttaaaagggtcattctggctacagtttggttgagaaatgagtgtggagggcaaggatgaaagcgaggaaacccaacaggaagccaatgcaggaatgcaagtaagagatgtcagcttggactagggtggcagaggcattgcaacacggtctctca

SEQ ID NO: 622564 - DNA, 389 bp, Homo sapiens
aagtgaaactgaggctggtagccctggggactacgactgggtcttgaatagacgctgacttggagtgggctttgcttacccagtggaaagtgcaaatgctcagagcgccagagccaaaccagaacagaagacaccgtgtgggtttggatggctgtcatttcttcagaccacagaacacgctgtacagcccataatgtccagctatgggctggacagagagacagcctccgcagagcaatagtttgataaagaaatggaaccgctgccaggtgcagtggctcacgcctgtcatcccagcactttgggaggccaaggcaggtggatcacctgaggtcaggagttcgagatcagcctggccaacatggtgaaaccccgtctctactaaaaat

SEQ ID NO: 622565 - DNA, 3894 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctggttgtagtaggagctgaaatccatgtccccgtacatcgttagaagcttga

SEQ ID NO: 622566 - DNA, 951 bp, Homo sapiens
cgagatctgatggtttataaggcagtttcccctgctcttacacgctctctttgcctgccgccatataagacatggcttttccctttccaccatgatgtaagtttcctgaggcctccccagtcatacagaactgtgaatcaatttaacctctttcctttataaattgctcagtctgaggtagttctttatagcagtatgagaatgaactaacacagtaaattggtactgcggagagtagagtattgctataaagatacccaaaatgtggaagcaactatggaactgggtaacagacagagattggaacagtttggagggctcagaaaaaagacaggaagatgtggggaagtttggaacatcctagagacttgttgaatggtttgaccaaaatgctgatagtgatgtggacaataaagtccaggctgcggtggtctcagatggagatgaggaacttcttgggaactggagtaaaggtcactcttgctacgctttagcagagactggtggcattttgcccctgccctgagatctgtggaactttgaacatgagagagataacctgaaattggaacacatgtttacgaagaagcagagcattaacatttggaaaatttgcagctgacaatatgatagaaaagaaaaacccattttctggggagaaaattcacgctggtgcagaagtggcataagtacgaggagccaagggtagtcaccaagacaatggcggaaactgtctccacgggatgtcagaggctcggcagagcctttagccccagctagcgggaaactggtccaggggcaatctaggccgctgcctggggcccgacggagctcggcaacgggccagaaccactggaggccaaagcaggggcaggaacggagacaacaaagagggacgcgcaggtaagcggtgaagggcacgaaagaagggccaacgagtagagcaaaggg

SEQ ID NO: 622567 - DNA, 158 bp, Homo sapiens
tcttattaaatttattcacaaaaagtgatattgcaaaggttctgggggctgtacatgggcagggagcttggttgagcatctgtgtccatgtggggctgggagaacaagggagccctccaggtgtggaagggctattttgttaattaaaaaaaaaaaga

SEQ ID NO: 622568 - DNA, 471 bp, Homo sapiens
acaaagccaggtatccacgagtgtgcccaggtttctcttgcagctccagactggtcctctgaagcatttctataacaatggaatcttaaatgggggtcatcagaatgtattgcctacgtcatatcacgttagtgggaacagaattcgagaatggcagggttgagaaagagtcagaagaatggggggtacatgacaagctagaattgaaggtcaacagcttggcttctgccgtgccagtcacgaactgggggagacagaagacgatgctgagaaaatgcacgttgatatgggagattgctgttgtaagggatatgaacaagagaaaactccgtatcgaaatacattgacaaatggctgtgtcaatcaatggacgatttggacttcccctcccagaccccgctcagtgggctgggcacgcaggcaatggccagggcttgacagggactacccaaatggcccgtggatcgggta

SEQ ID NO: 622569 - DNA, 368 bp, Homo sapiens
accgtcctcgccagcacttcatatattactttagtatgtccctcagctacatgcctgccgcttcaggggtgcatagaaaccaccataatttgtatcacatcttgcagtgcattcaatatttatgaacatgcttcttcaacagacagtgttatatttttcagatcaacacaaagcacaatgattactcaaaattcagtattatcaaatttacatatttaaagtcatgcaagctgtaacttccctgccaaaattactggctgccaaatttatacctatttctatcagactgtaccattagatctttaaagttagttaaattactgtaccaggtagatctagaagagtgcactaatggggtaccgagctca

SEQ ID NO: 622570 - DNA, 709 bp, Homo sapiens
tgggctgggattgccccaaagggcaacgggttattggggccccccctgggacaaatcagcggtgggacttggccaacgctccagcatcgtccttctatcttaagggcataggagttcgaggagccccttggcagcatagatgagctcatctgccaggcactcagacaagggtctaaatgtcccggaaggcagcctcacaagcgcctgtgcacagaagccaaaatggcctgtgttcacaccggctccaggggtgggaccacattccaagaagccgggtccagtcatcaaaagtccctgaggagcgcccaaatgggctgtggtgggatgtcctcccgggtggagaccattgggttcgactagactgggcgtgtacacccaatgagacctggccaagagagggtcactccgcctgtgttgacgcacgtgtgtcatagctctcagaaaggcatagctggaacagaatgccgcacaagtacatgaagaggcttatcgttagcccgattgattagccgcgcctggagccaatcacttcatggggacgtaaaagcggaagggccgctccacaaatggggcacacgtgagctattgcggaaaacgcgattgggcgggaaaaacccgcccttgaaaacgtgtagagcgcaggaacctggagaaaaacattctctttccactgcaattgaaactccctgcagcgaacaatgtctcttgc

SEQ ID NO: 622571 - DNA, 930 bp, Homo sapiens
gccgtcctcccacccccaccagcagttacagggctgggtgcggagaccaactctgtggccagacgacagaggagcagcaagaacccggggcaacggtcctaaaccgtaatcctcccgacttcggtcgtccctaggagcccgtccctcggcccgccgcctcccctgtgtccccgacccgggctagacgacgtgctcctgctgctcctgagggttcgagggttgccgaggatgatagggtctggcatgctgctttggtcgttctgctaggtgcacgaagccgtgggaggcatgttactggccgacaccttcgcaaggaacaaagtgtgcaggagagaagctcgagggagagaaatagaactcaagagacgtaccaacaatgaaggtgaaggcccatgatattccggttacacaatgaaggacacggggatctcagcccgttcagcagcaaagacgcagtctatcatgatgcgaaggtgctggataaaggtcggcttccgagacacccccgaccgactatcctgatgtctgcgtggcggggtcatacactgtatgagcttcggactgtgaaaacgggcagtagaactttgcgggtggagcctagctgctgctgatcatggactgctgacaagagatgcgtagccatcgagacgctccagggcatgatcgacgcgtgtatcggcaatcttgccctctcggtccatttcggagcctgcggtcgctcccgcaggtgttcttcagactggcgggatgcatagctctcctgagagtgcttgctgtcccgagggggacggcccgcatctgcggtctcacctgcaagtgtgtccgccagggtcgcccactgggtgctgtgaggagccttcccactgttggctcgggcccgcactgacgtcccccgctggtgggtccttgctttgggggcgcggccccgtg

SEQ ID NO: 622572 - DNA, 200 bp, Homo sapiens
ccatcagagttgttgacagaggcagtataatgcagtggtcatggtgccagattaactcgggctcaaatcccagcctggtcacttgagacgctgggcaaattatccttctaaattctagttctctaatttctaaaaggaggagaataatgggacctacccaaagagattaaccaggaaacttctataagaagaaagcagga

SEQ ID NO: 622573 - DNA, 106 bp, Homo sapiens
agcgggaacaatcatcttaacaatcattacaatcacttaacaatcacttaacaatcacttaacaatcacttaacaatcactggtgcccaagggatggttccccgcg

SEQ ID NO: 622574 - DNA, 200 bp, Homo sapiens
  misc_feature (162)..(162): n is a, c, g, or t
gtatgatagctacggctctgggggtctgctgcacactctgcggagccagattgccccagcaccctccaggacaggagatctgggatgcctggatgctggagtacatgtgttcacagagggttactcctcaaacacccccaggttctcacatcatgtccccanactcaagcgctaggaaaacagcgaagatggagaacata

SEQ ID NO: 622575 - DNA, 225 bp, Homo sapiens
  misc_feature (24)..(24): n is a, c, g, or t
  misc_feature (63)..(63): n is a, c, g, or t
  misc_feature (95)..(95): n is a, c, g, or t
  misc_feature (101)..(101): n is a, c, g, or t
  misc_feature (112)..(112): n is a, c, g, or t
  misc_feature (121)..(121): n is a, c, g, or t
  misc_feature (128)..(128): n is a, c, g, or t
  misc_feature (146)..(146): n is a, c, g, or t
  misc_feature (164)..(164): n is a, c, g, or t
  misc_feature (202)..(202): n is a, c, g, or t
  misc_feature (205)..(205): n is a, c, g, or t
cggcctggcattagtcattatttngtttcccggccaaccatccagatagagattccctctttncttcgagcagtgctctcacgagctccgtgccngtccanaatgacctagngtgcatccngctcatngtcagtgtagcccctcgnccctatattcatcccggntactcggaagtgctaaaatcggacgggattcggctttnaantttgctaccatcttccctga

SEQ ID NO: 622576 - DNA, 433 bp, Homo sapiens
  misc_feature (1)..(1): n is a, c, g, or t
  misc_feature (8)..(8): n is a, c, g, or t
  misc_feature (15)..(15): n is a, c, g, or t
  misc_feature (33)..(33): n is a, c, g, or t
  misc_feature (37)..(37): n is a, c, g, or t
  misc_feature (76)..(76): n is a, c, g, or t
  misc_feature (107)..(107): n is a, c, g, or t
nactttcnggcactnctgtgaccctattctaancctncatgaccccccagtgtaccctgcactttatacataccanaatggcctgcaagcaactgaaaaacccacanaagtgaaaatagccttaactgatggcattccaccattgtgatttgtttctgctccaccctaactgatcaacatactttgtaatctcccccacccttaagaaggttctttataatctccccacccttaagaagtttctttgtaattctccccacccttgagaatgtactttgtgagatccaccccctaccaccaaaacattgctcttaactccaccacctatcccaaaacctataagagctaatgataatcccaccaccctttgctgactccttttttggactcagcccgcctgcacccaggtgaaataaacagccatgttgctcac

SEQ ID NO: 622577 - DNA, 93 bp, Homo sapiens
  misc_feature (42)..(42): n is a, c, g, or t
acacccaggcttttagtgaggggcattatctcattagagatnatgtttttcaaagctctttgtaaattgtgtagcattcaaatggaagttgtt

SEQ ID NO: 622578 - DNA, 455 bp, Homo sapiens
  misc_feature (194)..(194): n is a, c, g, or t
  misc_feature (296)..(296): n is a, c, g, or t
gtcatctcacattgccctgtccaacacccccatccttctgtattgtaggaatcttcccagctgtcagggtaaaaacccaggtgcacccccaccactgccttgttttctgtcttgcctcaggtcattttccagtgtcagccctttctccaaaatctgtacccagtttggctgcttggcatcatctctcccctggnccatggcaccattatactttgcagtgtaagcagtctgattttcctttaaagaattatatctggccaggtgcagtgggttacacctataatcccaggactttnggaggccaaggcaagaggattgcttggggccaggagtttgagaccagcctgggcaacatggcaagaccccatctctacaaaaaatttaaaaattagctggaaacagtggctcacacctgtagccccagctacttggcaggctaaagcaggaggatcact

SEQ ID NO: 622579 - DNA, 1355 bp, Homo sapiens
  misc_feature (435)..(435): n is a, c, g, or t
  misc_feature (784)..(784): n is a, c, g, or t
ggagagaactagtctcaagtttttgtggtatatttctctatttttttttgtggcccccccttcccccccaaatctccgggccccccaaaactgctttttttacaaaaattgcacaaaacgcggtgtctttccttttttccagggcgggtggacccatggagtgctcgtggcccagacaccaggggggccaggctgccccctatctcttggacaagccatagcatttgcttgtacggctaggggggtgtcgccccctttgatgcgcacagacggatgcccatctcgtcagggtggggttccttatcgcggggccctttcgcgagggggcctccctccaccacatgttgtgtggcggtcgttgaccccacaaattcagcgttgcggtgcgcccctatcccagatatcgtgtgaccgcacattttgtgcggcgagatntgtgccgggggtatcctcgatctgatgtgtctcattctgggcgttgatacacggggccccacctgtggcatgcaagagctcccttgtgggatgatcgcaccagtgttgtctcgcccccgcggaaatagtctcccgccgacgggatataattcacgctacgaaagaaagcaacaccaaccgagataaacacgagtaacagcttcgtgcgagcggcttacctctcaagaagctcttggtccccgccggtgtgtcacaacacaccagcagcggcgccttctactctcgcggtgtcgataacaccccgatcagtgagtggttgtcactccaccccgacggcatggtggggcgnacaaacagcccctccaatacgaccggctgataagacagtgtgcgatcaactgaagggagcaaatctcctcccccgactgattaatccccagtctggccagacctggttggatgcatgatgcgtgtggggcacaaagaggtgactaagcggaaatgtacagtgagaccccaacatattgtggttttccccccacgccagggtgagacacccatcccgtgatcaccgccgtgtgtggaacacaacatgtgggccgcacacacaccatatgtgtgatggcgggccccccccgctggttcgcagtgagtaccacccccgttgcgagtactgcgatgatgttgtaccacactaagcacgcgaaccggtgcgccaccctagctgatcacaatcgatacaagcgtggtgacacttaacagcgccccccagacgcacaccagaggcttttgtgccgcagacccagcaacaaccgacgtgtactcaggagccatgatgaaactcctccttcatggtgggcctatcacgtggccgcactaccagaattgtgcctcgtacatgcacggcacgacgacatgtt

SEQ ID NO: 622580 - DNA, 234 bp, Homo sapiens
ctactactactaaattaacggccgcgtcgacgtgcctcaacctcccaagaagctgggaccataggtgtgcacgagaatcacttgaacccgggagtggaggttgcagtaagctgagattgcgccactgcactccagactgggagacagagagactccatctcaaaaaacaaacaaacaaaaatccaaaagaatctacagtgatgggaaagtgggtgaggagtcgacgcggccgca

SEQ ID NO: 622581 - DNA, 313 bp, Homo sapiens
acaaagtgggctctgggttggggtaggggaagggagggttcataaagaggaatgaccatgttgactgacaagaccgaaagttactgccaacacataccaagattggtgacataggacacttgtgcagcacatatgccaatgggccatgttcattgtggattgttaagaatcaccagaaaaccattgagcccaaatagctacaaggagggtgtttaatcatggttattgaactcattgcttgataccagcaaacaccggaaaacattttggctcattataatccggtgaacaatgcatgtagttctgttatcac

SEQ ID NO: 622582 - DNA, 4170 bp, Homo sapiens
  misc_feature (169)..(170): n is a, c, g, or t
  misc_feature (192)..(192): n is a, c, g, or t
  misc_feature (3814)..(3814): n is a, c, g, or t
  misc_feature (3851)..(3851): n is a, c, g, or t
  misc_feature (3875)..(3875): n is a, c, g, or t
  misc_feature (3894)..(3894): n is a, c, g, or t
  misc_feature (3918)..(3918): n is a, c, g, or t
  misc_feature (3925)..(3925): n is a, c, g, or t
  misc_feature (3927)..(3927): n is a, c, g, or t
  misc_feature (3933)..(3933): n is a, c, g, or t
  misc_feature (4042)..(4042): n is a, c, g, or t
  misc_feature (4049)..(4049): n is a, c, g, or t
  misc_feature (4065)..(4065): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaatttggctttcacaatttatctttaaatccttgagcaatctgtatacaattaagagatttctgacatttattcttacactaaatggatcaactctaggatttaggcatgttaacttctgttgtgtttgaatctctccagagttgcatgtagatagcatttatttctgtgcccttaaacccatttagaaaataactacaaagtaaaanatgtcgaggaaagtagaaatgtattgtcttcatgaancatttgtgatacaaatttcatcantttaatgattcaccaattntcttgcattaattttgaatttaangcatttnanttcaanagagaggggagcatccattattggatacatgtgggcttttaaaaaactccatcctttataaatagtcaaggttgtgggccacacaaagtatactttttatcagggcaanaatttcnactcctcaagccgtantgttgaacagaattggagtattcttataatttggacagggaagaaagtatataaagcggttttttttgggaacgccgcatttttcggttttaaaaagtttccacg

SEQ ID NO: 622583 - DNA, 4434 bp, Homo sapiens
  misc_feature (169)..(170): n is a, c, g, or t
  misc_feature (192)..(192): n is a, c, g, or t
  misc_feature (3814)..(3814): n is a, c, g, or t
  misc_feature (3851)..(3851): n is a, c, g, or t
  misc_feature (3875)..(3875): n is a, c, g, or t
  misc_feature (3894)..(3894): n is a, c, g, or t
  misc_feature (3918)..(3918): n is a, c, g, or t
  misc_feature (3925)..(3925): n is a, c, g, or t
  misc_feature (3927)..(3927): n is a, c, g, or t
  misc_feature (3933)..(3933): n is a, c, g, or t
  misc_feature (4042)..(4042): n is a, c, g, or t
  misc_feature (4049)..(4049): n is a, c, g, or t
  misc_feature (4065)..(4065): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaatttggctttcacaatttatctttaaatccttgagcaatctgtatacaattaagagatttctgacatttattcttacactaaatggatcaactctaggatttaggcatgttaacttctgttgtgtttgaatctctccagagttgcatgtagatagcatttatttctgtgcccttaaacccatttagaaaataactacaaagtaaaanatgtcgaggaaagtagaaatgtattgtcttcatgaancatttgtgatacaaatttcatcantttaatgattcaccaattntcttgcattaattttgaatttaangcatttnanttcaanagagaggggagcatccattattggatacatgtgggcttttaaaaaactccatcctttataaatagtcaaggttgtgggccacacaaagtatactttttatcagggcaanaatttcnactcctcaagccgtantgttgaacagaattggagtatttggctttataatttcttggaaacaggcgaatgagagcttattatagaatgcatgtatttgctttgatctttggaacatcagaccagtatattgctgggagctatcgtgttcaagaataagtgtatctgcactatcataaaggatcttttttcccgctcatgatgataacgagactggggtagaacaaagtggacgtgtttgaccattcagcgtacgggtcatgcggacacctataaacggctactactgaggatcccttggacgaaggacaaccgggtaaaatccaaggtataagaaagcatggaaagaaaactcattgagccaacaacaccaagaaaacggccaca

SEQ ID NO: 622584 - DNA, 975 bp, Homo sapiens
gctgtcatgtccatggcatactcccagatcagcactgatcggccctgtctcctccatgtctggctcctacatcgcccctggcactgaggagagatgggagaggctctctcttcccctccagacctgccgagcattggccccctcaataagaagggagagggagctgctcagcggagtctccagactaggcaactttgccttgtgcctcccacgcgtggagagcgaggctgcctagtgagtaaatcgatcgttatagaggatccatggatgtatccaccacatgacccgaaggcctgaagccacggtgcgcatttcattcgtctgctgtgtgtcgaatcacaattacttagccaatcgcaagcgtgaaaacgcatgcacaaactgctgtgcctctgacgtctgttagctggtgcctggggggcctgtctccacaagtagccagtacagatcctgatctcgctccgaggcgaccggggtgcattgtccagtccacgaacctcttgggtgggacatcttgagaacgactcgaccttgtgttttgttgggtggggcccttctgagcttgtcttggacgccactccgaaggcctcttgtcgtcttttgcgttcgtcctcgctccctgtgctcctgtaattccgtgcggtaccttctacttcaggttgattcgcctagcatgagggccattccatctaagcgaaaccgattgtcatgtgcccaaccttgtattaacccctttccatgaggagagggtgctttccccaaccgtgtgaaacctcgcgtcaccatcaagcgtcgtcagtaagcggaaccgtgctggagccatcgcttatctccgatgctgatcataaaaggcccactctaatggatactgatcccgtcgcgcaacatgctttggcaaggaccctgtggaacctgtcctccaggcctcttgaccgtccaggtggaacctgggtccatgggactaaattgctaata

SEQ ID NO: 622585 - DNA, 4117 bp, Homo sapiens
  misc_feature (169)..(170): n is a, c, g, or t
  misc_feature (192)..(192): n is a, c, g, or t
  misc_feature (3761)..(3761): n is a, c, g, or t
  misc_feature (3798)..(3798): n is a, c, g, or t
  misc_feature (3822)..(3822): n is a, c, g, or t
  misc_feature (3841)..(3841): n is a, c, g, or t
  misc_feature (3865)..(3865): n is a, c, g, or t
  misc_feature (3872)..(3872): n is a, c, g, or t
  misc_feature (3874)..(3874): n is a, c, g, or t
  misc_feature (3880)..(3880): n is a, c, g, or t
  misc_feature (3989)..(3989): n is a, c, g, or t
  misc_feature (3996)..(3996): n is a, c, g, or t
  misc_feature (4012)..(4012): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgattaaatccttgagcaatctgtatacaattaagagatttctgacatttattcttacactaaatggatcaactctaggatttaggcatgttaacttctgttgtgtttgaatctctccagagttgcatgtagatagcatttatttctgtgcccttaaacccatttagaaaataactacaaagtaaaanatgtcgaggaaagtagaaatgtattgtcttcatgaancatttgtgatacaaatttcatcantttaatgattcaccaattntcttgcattaattttgaatttaangcatttnanttcaanagagaggggagcatccattattggatacatgtgggcttttaaaaaactccatcctttataaatagtcaaggttgtgggccacacaaagtatactttttatcagggcaanaatttcnactcctcaagccgtantgttgaacagaattggagtattcttataatttggacagggaagaaagtatataaagcggttttttttgggaacgccgcatttttcggttttaaaaagtttccacg

SEQ ID NO: 622586 - DNA, 388 bp, Homo sapiens
  misc_feature (9)..(9): n is a, c, g, or t
  misc_feature (35)..(35): n is a, c, g, or t
  misc_feature (41)..(41): n is a, c, g, or t
  misc_feature (49)..(49): n is a, c, g, or t
  misc_feature (65)..(65): n is a, c, g, or t
  misc_feature (68)..(68): n is a, c, g, or t
  misc_feature (170)..(170): n is a, c, g, or t
  misc_feature (195)..(195): n is a, c, g, or t
  misc_feature (235)..(235): n is a, c, g, or t
  misc_feature (373)..(373): n is a, c, g, or t
agtggcatnctcatggctcactgcagcctcaactntctgcnctcaagtnatcctcctgcctgagnctncccaacagctggaatcacaggagcttaccatgttgctcaggctggttttgaattcctaggctcaagcagtctcccacctcggcctcccaaaatactaggatnacaggtgtgagccactgtgcccggncaaaacctgcttcttatatagcaccttgggacttaaggantgaactgtgtctctgaagtattatatttatttgtttacctttgtcagcactcaaggattcaggttagagcatcaacaaagttgaaaaccctgcaaaggattgcagggtgatattgtatgggctgtgtcctttgggaangtttactggggtaac

SEQ ID NO: 622587 - DNA, 3679 bp, Homo sapiens
  misc_feature (169)..(170): n is a, c, g, or t
  misc_feature (192)..(192): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaatttggctttcacaatttatctttatatccttgagccatctgtatacatgaccgggatcctcagaacgcagc

SEQ ID NO: 622588 - DNA, 4208 bp, Homo sapiens
  misc_feature (169)..(170): n is a, c, g, or t
  misc_feature (192)..(192): n is a, c, g, or t
  misc_feature (3852)..(3852): n is a, c, g, or t
  misc_feature (3889)..(3889): n is a, c, g, or t
  misc_feature (3913)..(3913): n is a, c, g, or t
  misc_feature (3932)..(3932): n is a, c, g, or t
  misc_feature (3956)..(3956): n is a, c, g, or t
  misc_feature (3963)..(3963): n is a, c, g, or t
  misc_feature (3965)..(3965): n is a, c, g, or t
  misc_feature (3971)..(3971): n is a, c, g, or t
  misc_feature (4080)..(4080): n is a, c, g, or t
  misc_feature (4087)..(4087): n is a, c, g, or t
  misc_feature (4103)..(4103): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttctcaatagataactgaatagtgcatcttccttgaaccagataaatcatacaatatttaattatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaatttggctttcacaatttatctttaaatccttgagcaatctgtatacaattaagagatttctgacatttattcttacactaaatggatcaactctaggatttaggcatgttaacttctgttgtgtttgaatctctccagagttgcatgtagatagcatttatttctgtgcccttaaacccatttagaaaataactacaaagtaaaanatgtcgaggaaagtagaaatgtattgtcttcatgaancatttgtgatacaaatttcatcantttaatgattcaccaattntcttgcattaattttgaatttaangcatttnanttcaanagagaggggagcatccattattggatacatgtgggcttttaaaaaactccatcctttataaatagtcaaggttgtgggccacacaaagtatactttttatcagggcaanaatttcnactcctcaagccgtantgttgaacagaattggagtattcttataatttggacagggaagaaagtatataaagcggttttttttgggaacgccgcatttttcggttttaaaaagtttccacg

SEQ ID NO: 622589 - DNA, 4116 bp, Homo sapiens
  misc_feature (169)..(170): n is a, c, g, or t
  misc_feature (192)..(192): n is a, c, g, or t
  misc_feature (3760)..(3760): n is a, c, g, or t
  misc_feature (3797)..(3797): n is a, c, g, or t
  misc_feature (3821)..(3821): n is a, c, g, or t
  misc_feature (3840)..(3840): n is a, c, g, or t
  misc_feature (3864)..(3864): n is a, c, g, or t
  misc_feature (3871)..(3871): n is a, c, g, or t
  misc_feature (3873)..(3873): n is a, c, g, or t
  misc_feature (3879)..(3879): n is a, c, g, or t
  misc_feature (3988)..(3988): n is a, c, g, or t
  misc_feature (3995)..(3995): n is a, c, g, or t
  misc_feature (4011)..(4011): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaatttggctttcacaatttatctttaaatccttgagcaatctgtatacaattaagagatttctgacatttattcttacactaaatggatcaactctaggatttaggcatgttaacttctgttgtgtttgaatctctccagagttgcatgtagatagcatttatttctgtgcccttaaacccatttagaaaataactacaaagtaaaanatgtcgaggaaagtagaaatgtattgtcttcatgaancatttgtgatacaaatttcatcantttaatgattcaccaattntcttgcattaattttgaatttaangcatttnanttcaanagagaggggagcatccattattggatacatgtgggcttttaaaaaactccatcctttataaatagtcaaggttgtgggccacacaaagtatactttttatcagggcaanaatttcnactcctcaagccgtantgttgaacagaattggagtattcttataatttggacagggaagaaagtatataaagcggttttttttgggaacgccgcatttttcggttttaaaaagtttccacg

SEQ ID NO: 622590 - DNA, 3096 bp, Homo sapiens
  misc_feature (169)..(170): n is a, c, g, or t
  misc_feature (192)..(192): n is a, c, g, or t
  misc_feature (2740)..(2740): n is a, c, g, or t
  misc_feature (2777)..(2777): n is a, c, g, or t
  misc_feature (2801)..(2801): n is a, c, g, or t
  misc_feature (2820)..(2820): n is a, c, g, or t
  misc_feature (2844)..(2844): n is a, c, g, or t
  misc_feature (2851)..(2851): n is a, c, g, or t
  misc_feature (2853)..(2853): n is a, c, g, or t
  misc_feature (2859)..(2859): n is a, c, g, or t
  misc_feature (2968)..(2968): n is a, c, g, or t
  misc_feature (2975)..(2975): n is a, c, g, or t
  misc_feature (2991)..(2991): n is a, c, g, or t
agcggaggccagcgagcagcacggagggaaccggcagccgcgagcagtcccggagcagaagcagcagacagcagcagcagccctcgccgttcgcggagcgcagccgagccggccatggcgtagtcgatgccgctgaatgggctagaaggaggaggacaaagagcccctnntcgagctcttcgtcaaggctgncagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaatttggctttcacaatttatctttaaatccttgagcaatctgtatacaattaagagatttctgacatttattcttacactaaatggatcaactctaggatttaggcatgttaacttctgttgtgtttgaatctctccagagttgcatgtagatagcatttatttctgtgcccttaaacccatttagaaaataactacaaagtaaaanatgtcgaggaaagtagaaatgtattgtcttcatgaancatttgtgatacaaatttcatcantttaatgattcaccaattntcttgcattaattttgaatttaangcatttnanttcaanagagaggggagcatccattattggatacatgtgggcttttaaaaaactccatcctttataaatagtcaaggttgtgggccacacaaagtatactttttatcagggcaanaatttcnactcctcaagccgtantgttgaacagaattggagtattcttataatttggacagggaagaaagtatataaagcggttttttttgggaacgccgcatttttcggttttaaaaagtttccacg

SEQ ID NO: 622591 - DNA, 97 bp, Homo sapiens
ttattttatttttctttttttaaaaagggacctttttgaaaaaaaagtggtgtgtaaaacatttgatatttaagccaataaagtttttatcataaga

SEQ ID NO: 622592 - DNA, 212 bp, Homo sapiens
gagcggtctaatacttggaattcccgccgtgtcgcaatggttaatgactccgactacagacgatgaggtgcaggtcaatcctggcttgccatgggtaaggatccggctttgccgtgagctgtggtgtgggtagcagatgtggctcaaatcccgcattgttgtggctctggcgtaggcgggcggctacaggtcccattggaccagatcgctct

SEQ ID NO: 622593 - DNA, 615 bp, Homo sapiens
ctgaattgtttgcagtggcttcatgcctaatctcctccttaaatcctggtagattcattctcttggtgtgtgctgaattcatacatagagttgtggactatggaagtacaatgccgacagacagtcatgtgcaagtttaagggtcctattgaatgtgttcagattgcctgcctttaattcttagaccagggcatagtgagccgatatggggcttgggtaatgtgaggtctcgaacctggtgagaaggtaaaaaaaattgataggaagattagaaatgaaaggcaatgtgtgcctatttcaagacattgcttagtcccgcttgcttttaggaaaggataagaaaacttgtcttccgttttgctttttgttgtttatgcgatctgtggtaactaatatttggctgctgacctcctgattgaagaaaagcttaaacacagattgcttcttcctttaatttgcatgtcttttgcttatctctagtaaactttctttcatttttcggggtctgagagcagagatttcttgatgtctttgccatagtttctcttttttttcctacatacccatatccacgttggtcaagttcatattacgtagtgaaacattactatactg

SEQ ID NO: 622594 - DNA, 131 bp, Homo sapiens
  misc_feature (26)..(26): n is a, c, g, or t
  misc_feature (33)..(33): n is a, c, g, or t
  misc_feature (35)..(35): n is a, c, g, or t
  misc_feature (38)..(38): n is a, c, g, or t
  misc_feature (125)..(125): n is a, c, g, or t
tctttttgtttaccatatactgaaangagcagngncangagcagttcttatgggaaaacaaaatggaaacaacgaaaatagcatcaggtttacaaaagttcccaagatagatggtcacacatgtnttcagg

SEQ ID NO: 622595 - DNA, 184 bp, Homo sapiens
atatgacatagacgtacatagcttttatagtgaagataccatcgtgtcggacgtccacttatgactccctaaagcccattggtcgatagcctccgatcggtgggtcaatagtacttgccgcagtactcttaaaactaggcggctatggtataatacgcctcacactcattccccacccctgacc

SEQ ID NO: 622596 - DNA, 594 bp, Homo sapiens
  misc_feature (559)..(559): n is a, c, g, or t
aggctcattgactgttgcggccctgaggctcttccacggtatcccttgccactgctcttgctcgtttctgcagcccttccatggatgattctcctcagatgctatagtcagtttcctcgaggcatcactactaccgcagtgcgtggtatatgttctgagcctcatggtcagtttcttctcttctttgttttcattttccgtcagacggtatttcacgtacctgtttccagtctgtgtcatagcattattctctctgttgaaatgaccaaacctgccgctgggacagacacaggtgtgtttctcctcccagggatcagacacacattcggatccctcagggcacgaatcatcttcacagccatggtggacaggtgggcaccttccctctttgcagagacacaccgctgccctgtggtggcggggagtcacaaaactcagtctggctgtgctgtgtattgacatcacactttcatccacagacaccttttcatcgcagaacttccaggggcagtccagtcccgcgcagagtttctggaatacattcagtatcctaactccnatgatttcctcaatgtcagtcacggaagagttaac

SEQ ID NO: 622597 - DNA, 760 bp, Homo sapiens
cctggagacttcatctgcttgataaaactttggtctcagcaagccagacatttcctttctgtggatcccgggtatttagataaactcaaccgtcaaccagaaaatgtttaaatcatactgaaagccctcctcaccaaccactttgagttgtcctgcttttctgaaccagacaatgtatttcttaaatgtgtttgattggtgtcccgtgtctccctgaaatgagtaaaaccgagctgctcccggaccgcctgggacacatgttctcagggcctcctgaggtctgtgtcacagaacatgatcactcacatttggctgagaataagtctcttctaatattttacagatcgactcttttcgccgacaccttgtatttcgtctggcaaccttactcacccctcaaccatttgttcgacgtgtctagagttatggcactatacgttaaagtacgaagccaaactgtgtcgggaataataacgccaaattcaagatagctggtctcacactggagcaccgacggcgaaaaacaccatcagggcgtctgtcaacggacaaggggtccttatccagaacccaagagagcatccttggatctcttgcaccgacacgacttgaggcgaatccatagagtcagccaaggcaagtacttctatatagaagggtgcacccttacagatcacacatgccttagtgatgcgtggtcagaactctgaacccaagcaaagccatcatatcccctgtgacctgcatggtatacatccag

SEQ ID NO: 622598 - DNA, 295 bp, Homo sapiens
cttaaaatttttccccccccttgggggaccgatggccctttttccccccgaaggggtttaaacggggggggcctgggggggggaaacttcccaaaccccggtttttttttctggccggccccctggggaacccttttaaaccccctagggggtgggggttggggccccaacccctttttccccccctaatgggggcccggggttttttccaaaggggttggcccggttgccccccccttggttggggggtttttggtaaacctggggcccaaaaaaagggccccctgttttttta

SEQ ID NO: 622599 - DNA, 331 bp, Homo sapiens
  misc_feature (4)..(4): n is a, c, g, or t
  misc_feature (119)..(119): n is a, c, g, or t
  misc_feature (125)..(125): n is a, c, g, or t
  misc_feature (129)..(129): n is a, c, g, or t
  misc_feature (147)..(147): n is a, c, g, or t
  misc_feature (173)..(173): n is a, c, g, or t
  misc_feature (188)..(188): n is a, c, g, or t
  misc_feature (225)..(225): n is a, c, g, or t
  misc_feature (237)..(237): n is a, c, g, or t
  misc_feature (256)..(256): n is a, c, g, or t
  misc_feature (270)..(270): n is a, c, g, or t
  misc_feature (322)..(322): n is a, c, g, or t
tggntttacggtacacttgagtaaagcaaaaactagactcacgagccaccgaccctgggcacggccccaagccgctccactctgcccggcagcctccagggcaccccactggggaaccncccgcnagtncaggacagcccccaggancctgcaatatacctgcaggggtgggncgggggctttaaggngttttgtctccggctgcttgccgggtgtcggagcagngaggcaggaagntccgtgcccacgcgccccncgcggcagggctgngggccgagcagggtgacaccaaccggtcgctcccacctcgggttccaggcgncgggggcgc

SEQ ID NO: 622600 - DNA, 327 bp, Homo sapiens
tgtactatatgcctgttttacaatctcctgagcattgtggtatttttttaatctacttttttttttaaagaggtgagggtcatgctatattgctcaggctgccatcaacctcctggactcaagcactctttctgcctcagcctcctcagtagctgggtattatggtatgtgtacatttttacttttagagacagggtctcgtcctgtagtccaggctggactacagtggtataatcatggctcactgcagcctccaacacctgggctcaagcaatcctcccacctcagattcctgagtagctagggacaacaggcgttgtgccacca

SEQ ID NO: 622601 - DNA, 440 bp, Homo sapiens
tggccaggctctttacctggggtgacctagctcgggacaacagggctaagacacactcttccgggtctcccactatgggcggtgggtgggggggaacctcaccggacggccagccacggcccaatactcttggttttctctcccccagatttaactcagccatttctttaggctaccacagtgaataaggagaaagaaaggcaagtcctagtctaggaagagagaacgggatggttaggctccagtcccagttaggggctgtccaatcggcgtgggtacagtagggcaagctgagcctcagaggcccggactataaaagggtggggagaaccatgttatgtacgtcaggaggtggtggctaagctcaacggagcccaggtatctgaccaatctctccaaacctataaatctcagtatccggagactctgtacctctcact

SEQ ID NO: 622602 - DNA, 160 bp, Homo sapiens
taggtatactgactcgtgatctgctgcctcggttcccaaagtgctgggattacaggcgtgagcaccgacccggccttttggtcagtttttagtccgcagacttaattactataccttccaaactaaaccatcactataccttcaagactactggctttgc

SEQ ID NO: 622603 - DNA, 221 bp, Homo sapiens
ttttgtttttggggggggggggcccccccccccccccctttttgccctttaaccttattttcccctggggcgggggcccaacccttccccccctttggaaaaaaggccggagggtttcccccgggccccccccccccccccaaaggtttttttttagggggggggcccctttccccgggcccttaaaaaaaaaaaaaaaaaaagcttgggggccccttcca

SEQ ID NO: 622604 - DNA, 326 bp, Homo sapiens
tgttatctcatactgcaacagatctagtgaataggctaagctgaaggactctagccataacctgattccatgagaagcaaactgtgaacccttttgaaaacatttgcatgcactactcatgagcagacgtagtgactaggaattccctaccgactttcaatgaagctggaagtgtgcctgtcttggcggatttagacactggacagccccttcctatcttgaaaccacatttgatttgacagcgtagctaaaaggaaaaggacgaatagtaactgagttgagttcaatgtgcacacggaacatataaacacagcttcaagataaag

SEQ ID NO: 622605 - DNA, 3711 bp, Homo sapiens
  misc_feature (30)..(30): n is a, c, g, or t
  misc_feature (2514)..(2514): n is a, c, g, or t
  misc_feature (3029)..(3029): n is a, c, g, or t
  misc_feature (3033)..(3033): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622606 - DNA, 119 bp, Homo sapiens
gtgtaacattatgcaaacttctaagcccagacatgactttgttttagaaagtcattaatctatgtcaggattataaacatttttgtgctaattggaccaaacattgacagttggggtag

SEQ ID NO: 622607 - DNA, 198 bp, Homo sapiens
aggcagagaaacttctcctctgtcagtgaacagcgtaggctgtactgagggctgagttgggaaatgtggctggcctcccctctgtggtggcacctcccgagggcagggctggcacgcggagccgaggccgcgtgtcgtggtgacaagctgcttttaccagagaagcatcgaagaaggtgatgggggctttggacgaag

SEQ ID NO: 622608 - DNA, 884 bp, Homo sapiens
gatcgaccaggggggatgggacgcggtgatacgtgtcctgaagactggaggggccttcagggttctgatcgctggctcagtacaggggggcgcacgtccggtggtctccggagcatcccactgccatttgggcaaaccaaccggactcctgcaatgtactccgtccacattatcctgggcgggcaggagggtcccagctttttgagggtgatcgtatggagttctgtgttgtctggagagcaacgcgcgatttgcctcatcgtatgtgaggcgactgaggagctgcgggggagtaactccagaggtctgtggaggccaggtggtgcagtgtgcgtgagcgttgctgtttccgctgatggtgcccacgagctggtggctgggtgttgctccatgcttgggggcagtcaatggcactgagaagaacacagatgagggaccacttgacgcacggtgcaatacggagggaacgttgagggccgacgttctgcgtgcgctgatggcactgccttaccattggaagacgcacggactatttctggtgggcgaatgagtgacggttgagtttgaccttacacaagattgtactgtgtcctggtgggtggctgctatgaggggaggttctacaggcttctttccgctcaggactttgcccagtaccaaccgcatgggttcctcgcctgagttaaccggagtcccagtacctggggtgtcgttgggcggaaagtgcaagctgtgtgagaagatggcccagggtagatgctagaaagttgggaggagactccaactaacgaggaagatgccacggcaaggccaagggtcagggggcacagtagaaggcgaagcccatggtgatccgcgggggcgaaaagggggggcccaggcat

SEQ ID NO: 622609 - DNA, 3734 bp, Homo sapiens
  misc_feature (30)..(30): n is a, c, g, or t
  misc_feature (2514)..(2514): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaagtgctgcctgactgaatcctcagggcaccccggcaggatggacgtggtgtaccccctactttacagatggggaaactgaggcttgagagctaaagcagcccacccagctcccagagatgaggaggccgactctggcaggagtcactgtcggtgcatgggcatttcttcctgttacagcctgcggccccttccaggccgggaggccttctgcgcagggccaccctccctgcatggcccgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcacctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagccgggaaaaaaa

SEQ ID NO: 622610 - DNA, 764 bp, Homo sapiens
  misc_feature (34)..(34): n is a, c, g, or t
  misc_feature (42)..(42): n is a, c, g, or t
  misc_feature (68)..(68): n is a, c, g, or t
  misc_feature (102)..(102): n is a, c, g, or t
  misc_feature (105)..(105): n is a, c, g, or t
  misc_feature (163)..(163): n is a, c, g, or t
  misc_feature (167)..(167): n is a, c, g, or t
  misc_feature (196)..(196): n is a, c, g, or t
  misc_feature (255)..(255): n is a, c, g, or t
  misc_feature (259)..(259): n is a, c, g, or t
  misc_feature (293)..(293): n is a, c, g, or t
  misc_feature (351)..(351): n is a, c, g, or t
  misc_feature (410)..(410): n is a, c, g, or t
  misc_feature (467)..(467): n is a, c, g, or t
  misc_feature (580)..(580): n is a, c, g, or t
  misc_feature (606)..(606): n is a, c, g, or t
  misc_feature (623)..(623): n is a, c, g, or t
  misc_feature (640)..(640): n is a, c, g, or t
  misc_feature (727)..(727): n is a, c, g, or t
tccctatttttgtgtttctcaataattaagcttnttcatctncagcgtctctaatattaaagttaganttggctagagcatatcccaaagacctggttagcngcntttaaccaatgcaattagatcaccaaaaaagggggaaaggagcccataaaattaaacnaccnccccccccaaaaataaaataaaaaaaaanaaaataaaaacacccacacccctgcagccaacctgacaaccacctccattcacagtccnttanacttaaaccaggatgggggaaatgaataaaagcngggaggggccactcccttcaaacgtttcacaacaatccagatgaaacccccagccccnccccacgcctcatgacagtaaatcaggacaagacaaagatttgccaatgtgcatttaancaccaaaggactgaagaagtctgggcctctttatcccgtaatgtctccaagactgtntccattaaatgcaaacaaagaggagagaagtttggcagaacaggagaggtgatgcacacctgacgaccgtatcaatttaaatatcatacacggcatatagcctagtccatgcnctagctgtctctatggcttgggcttngttggtcttccactgcnccgctacatcatttgcnaatggatcatctggattgggagcccttaacaaggcctggatcgatagcagatctgttcggatctgcagtcctggggacacttatctntcaaatatctaaacatatactcccaactagtctacat

SEQ ID NO: 622611 - DNA, 592 bp, Homo sapiens
atcctctagtagcggactactactactactaaattcgcggccgcgtcgacgcagtggcatcataggtcactgtagcctccgcctccagggctcaagggatcctcccacctcagcctctggagtagctgggaccacaatcacacaccaccatgccctgctccttttttttttttttttgagatgggagtctcgatctgttacccaggctggagtgcagtgacacaatctcagctcactgcaacctctgcctcccaggttcaagtgattctcctgcctcagcctcccgagtaactgggactacaggcgcgtgccaccatgcctggcttttgttttgttttgttttgttttgtatttttagtagagacagggtttcaccatgtttgccaggatagtctcgatctcttgaccttgtgatctgcctgcctcagcctcccaaagtgctgggattacaggtgtgagccaccatgcctggtcaccctgctactttttaatactttttagtagagatggggtctcactatgttgcccaggctggtctccaacttatgggctcaacttattctcctatcttgggcttccaaagcgccgggat

SEQ ID NO: 622612 - DNA, 1723 bp, Homo sapiens
  misc_feature (1)..(1): n is a, c, g, or t
  misc_feature (49)..(49): n is a, c, g, or t
  misc_feature (662)..(662): n is a, c, g, or t
  misc_feature (1315)..(1315): n is a, c, g, or t
  misc_feature (1359)..(1359): n is a, c, g, or t
ntctggcttctctcacgtgggagagtttttcgttagtaggaccaggtcnggtggcaacacgacgtcgttgttggagtatgtttgtagacgagtgagattgctccaccaaacacgggggtttttgtgtgttttaccgcccgtcgcagaagagttgttccttcgttgtttgtttgccctcccacgcacgagacgaccccccagtggtgtttcgattgtaaggggcccccactatattttccccctgtggtggtaagtgttggtgtttatagaagcagcaagcacacacaacgcgtccgcccggcgttttgtcctattgtgagataagtaggttcctccctcgccccgacatctgtgtgtagccaggagcgttccctctttatttgggttgtgtgtgtggtgccctcccccctttggaaacatctgcctgttgtgtgggcaccacaggttccatatattgtagaaagaccaaccaacggggggctgtggtggtgaaaatagtgtggtgttgcgctgccgttttaaacaacgtattttgctcccaaccccacaaaagtgggttcagacgtgttttcgccaccatcgcaacactgtgagtcctggggaacccaaggaaggttctgttttctgtgtgggggagaataccgagcggcaaaattgttgtntgtggtatacaccacccaaaagagtgggttatgttttccccgcccccccccttctggtccaaccaacagtgttattaacacccgcctcttggtggttttcctcgctctccctcgtgtgtatcatatcttcccgccttgttttccgggggaggattctccccgcctttgggcgcgcccccaacacgaccccacggggggcgctttatatggtagaaagcacacgagcgtttatcgaacaccggggtgtaacaccacacatcggtagaagagacttcggggagaattattgggggcttccaccagctgatttttcctgctgtagagagaggttttgctctgggctttgtattggggcgccacaacagctgtttcaggtgttttctcggaggacccttcttctgagtagtggtcttgacgcacacacttcgcacacacacaacactctgtttatgagaggtttctgctgcgcggccgctggcgcgttgttttataccctttgagaagtgtttggcttggagagagccacacagggacgcaagcggtatatttctgtttcccaccacactggcgcttattatttgagaaagagacacacacagctgtgccgtcgtgtatatatacatatatcgtcccgccgctgtttataaaggggnagatatatctctgttgatatataaacactgggagagcccacgcncacacgagattactcacacacgtggttgagagaaatgcctttcttgtgttcttcacatgtctgttcaccgccacgcaccgcacacagccccttgtttgggcacacatatatacacaggggctgagatggagaaagaatcttcacggaccaatcacgatgccaagctgtaaaagagagttgtaacacaattttcttgggctggagtttgagaagcttataaactcctcggggagttcaccactcacaataccacgttcacgttttgtcacttgtttctagtaaattagttccctttgttaaagggttactttcatactccttatgtaccagaaatcacatggaaaataaaggttccataatgcca

SEQ ID NO: 622613 - DNA, 1251 bp, Homo sapiens
  misc_feature (30)..(30): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgccttcttcccttcttgcccccggcggccgc

SEQ ID NO: 622614 - DNA, 3527 bp, Homo sapiens
  misc_feature (30)..(30): n is a, c, g, or t
  misc_feature (2330)..(2330): n is a, c, g, or t
  misc_feature (2845)..(2845): n is a, c, g, or t
  misc_feature (2849)..(2849): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcaggggggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622615 - DNA, 439 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctcttccgccagcactccctgcccgcactgcatagtagcagccgccgggatcactctagagtc

SEQ ID NO: 622616 - DNA, 355 bp, Homo sapiens
  misc_feature (239)..(239): n is a, c, g, or t
  misc_feature (256)..(256): n is a, c, g, or t
gcctcctgtgtgactggaattacaggtgcatgccacacgcccaacatggtgaaactccatctctactaaaaatccaaaaattaggcctggcgcagtggctcatgcctgtagtcccaccactttgggaggccgaagctggtgaatcacccgggtcggatgttcgagaccagcctgaccaacatgaagaaaccccgtctctactaaaaatacaaaattagccaggcgtggtggcgctgccntgtagtcccagctactngggaggctgaggcaggagaatcacttgaatccgggaggtggaggttgcggcaacccattgcacttcagcctgggtgacaagagtgaaacttctgtctcc

SEQ ID NO: 622617 - DNA, 3684 bp, Homo sapiens
  misc_feature (30)..(30): n is a, c, g, or t
  misc_feature (2487)..(2487): n is a, c, g, or t
  misc_feature (3002)..(3002): n is a, c, g, or t
  misc_feature (3006)..(3006): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622618 - DNA, 543 bp, Homo sapiens
  misc_feature (290)..(290): n is a, c, g, or t
  misc_feature (292)..(293): n is a, c, g, or t
  misc_feature (296)..(297): n is a, c, g, or t
  misc_feature (302)..(302): n is a, c, g, or t
  misc_feature (304)..(304): n is a, c, g, or t
  misc_feature (311)..(311): n is a, c, g, or t
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgntnnggnnctgangncgctccnggttcattgtttttttcgtggtctctatctccttcagtcctgctctaatcttagttatttcttgtcttctgctagcttttgaatttgtttgctcttgcttctctaggtcttttaattgtgatgttagggtgttgattttagatctttcctgctttctcttgtgggcatttagtgctataaatttccctctacacactgccttaattttgaaatggagtttcgctcatttgcg

SEQ ID NO: 622619 - DNA, 1020 bp, Homo sapiens
tcactataaaaaggcttaaagtgggtgggtgctcgtgatccacgcagtggatgtggtggacagggaaaaacagcaagtgtgcacacaggggaacaggccacaggacaggctggggagttgaaataaagagtttcaaacgtgcttctcccgtgttttccccaggtgtaccgtgaaggatctcataggcacaccatctcttccttcgagaccttcctctctcctcgaaatctcgccctatcacttcctatgggactgtggtgagcaattccgtgggatacgtgcgtggatactgtcggaaacaccgaggttcatttcagtggtgtgcttctttgcggccttcgtggtagaacctcacatatcctgcgagtccatgtgccccttcagccgcgggatgttacccaaggtgcatgagaaaggcctttgtgcaagcgctgaaaacatttgggcccgagtaaaactgtgactctcggagagaaatggccgcattgtaaacacagatcactcactgtggggagtggtgcccgggagcctgtgggatgtggcccaaaatgatagacgggtgttgggggcggagaaacattttatatagaagcgccccccgcgagaagagtgtgggacagttgtcttcacacaagaaccaggccgcgtatatatactaccaaaattagctagggggggagactctcaagctttacaacgacgaacacaaatagaccgtgcagtgatctagagagagtatagtggggaacatttttaaagcgcagtttggagcatcaactcaccagccttccactttaagtgggacacatgtgtcgggcccccgattaaacaactggtgcggggcaaaccccctgttacaaggtatacgtgagcccaattgggcggggcgagatcgcacaggggcacgacacacaacaagtggtgcggtggggcactctcaacacaaaacgtgcgtagggatagcagcccaggggcacacacggtatacagcgccccgggcaacgagtgaagggaaatgcc

SEQ ID NO: 622620 - DNA, 4216 bp, Homo sapiens
  misc_feature (3019)..(3019): n is a, c, g, or t
  misc_feature (3534)..(3534): n is a, c, g, or t
  misc_feature (3538)..(3538): n is a, c, g, or t
cccggcccgcgctccctcgcgctgcgtgtcgcggtgcctgctctcgcccctctctgcgataaacgatttgagaagtgtgatgaagtgatgtgtggactgtgctcgcgcgtagtttctctgttttttggcggggggcggggagctggggtggtgtgtgtgtgatctcgttggttgggtgttggtctgttcgtcgccgcgccgcgccccgtcgtttggtggtggcgccctgctgctgttagtgcatgcttcccccgcgcgtcggcgtcctcgctgctctgcgccgtggttgtgtctctggtcggctggagcatatattatcaaagagtaccccggcgtgtttgtgattttcggccgcctcccctcttgggggctcccccgtgtgtttcccctgtgtggccgaaaaaatgggggtctcatggaacacacttttggtgcaccatgtgcgcctcatttctggtgacgccgtgtgttctcccccccccctataatttcccccccatttttttttcttttttttttttcttttttttttttttttttttttttttaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622621 - DNA, 377 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggctgaaatggggaggggacaacaggagcttcatctgtatcccgagcattctccttcctttgatgaaggataacctctgggtggtgggtttgcaggacatca

SEQ ID NO: 622622 - DNA, 2323 bp, Homo sapiens
  misc_feature (30)..(30): n is a, c, g, or t
  misc_feature (1103)..(1103): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgagatggggacaacgccgccgagccgccagccttggtcaccttcttggccattccctcggcggtcgtcactggcagggcctcctcgagctccacggacatgggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaagtgctgcctgactgaatcctcagggcaccccggcaggatggacgtggtgtaccccctactttacagatggggaaactgaggcttgagagctaaagcagcccacccagctcccagagatgaggaggccgactctggcaggagtcactgtcggtgcatgggcatttcttcctgttacagcctgcggccccttccaggccgggaggccttctgcgcagggccaccctccctgcatggcccgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcacctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagccgggaaaaaaa

SEQ ID NO: 622623 - DNA, 406 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtgcgcctgcttctggctgtactgtatgaaggcactcaagcctggcaaagccaagctgctcaaccaggtagctgtgaacctcccacacatcagccatgcacacactcgagaacaaca

SEQ ID NO: 622624 - DNA, 439 bp, Homo sapiens
catgtgctgaggccagcgactgtttgtagagacaggtttcgccatgttgtccaggctagtcttgaactcctgggctcaagcgatctgcccacctcagcctcccaatgaatcctcctccttcatagcaaatattaagcaagcctgcccttttgtttttttaagagaaggcctggctctgtcaaccagccttgagtgcagtggcatgctctcagcctccacctcctgggctcaagccattctcccgcctcagcctcccgagtagctgggactacaggcacacaccaccacacccagctaatttattttttatagagatggggttttgccacgttgtccaggctggtcttgaactcctgacctcgagtgatccacgccttggcctcccaaagtgctgggatcatgggcatgagccactgcacccagccgctggcctacagca

SEQ ID NO: 622625 - DNA, 3663 bp, Homo sapiens
  misc_feature (30)..(30): n is a, c, g, or t
  misc_feature (2466)..(2466): n is a, c, g, or t
  misc_feature (2981)..(2981): n is a, c, g, or t
  misc_feature (2985)..(2985): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622626 - DNA, 208 bp, Homo sapiens
tagtcatatcccagagtactcgccatgctctcagcagcacatacaccaaaatgtctgaacctgtctggggttcccctccctcggtaactggaggcaaaggggggaacttttaaacccccaaatggccaacaaacaccatcatcagtagggtaaaactaacctgtctcacgacggctctaaaacccagctcacgttccctattagtggg

SEQ ID NO: 622627 - DNA, 4168 bp, Homo sapiens
  misc_feature (2971)..(2971): n is a, c, g, or t
  misc_feature (3486)..(3486): n is a, c, g, or t
  misc_feature (3490)..(3490): n is a, c, g, or t
cccggcccgcgctccctcgcgctgcgtgtcgcggtgcctgctctcgcccctctctgcgataaacgatttgagaagtgtgatgaagtgatgtgtggactgtgctcgcgcgtagtttctctgttttttggcggggggcggggagctggggtggtgtgtgtgtgatctcgttggttgggtgttggtctgttcgtcgccgcgccgcgccccgtcgtttggtggtggcgccctgctgctgttagtgcatgcttcccccgcgcgtcggcgtcctcgctgctctgcgccgtggttgtgtctctggtcggctggagcatatattatcaaagagtaccccggcgtgtttgtgattttcggccgcctcccctcttgggggctcccccgtgtgtttcccctgtgtggccgaaaaaatgggggtctcatggaacacacttttggtgcaccatgtgcgcctcatttctggtgacgccgtgtgttctcccccccccctataatttcccccccatttttttttcttttttttttttcttttttttttttttttttttttttttaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622628 - DNA, 476 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggctagttgttaaacactttaactacatcctccttgaaatacttcctttagcttttttttattggagacggagtctcaatcttgtcgccaagtgtggattgcagttggtgcgatctcagttcatttgccacctccatctcccggtggtcaagctgattctctttgctaaagcctcctgagtacgctgggataacggggcgc

SEQ ID NO: 622629 - DNA, 1022 bp, Homo sapiens
  misc_feature (170)..(170): n is a, c, g, or t
gactagttctagatcgcgagcggacgcaaattaagaaacgcgttcaagctcacacatccatatacctataacaaatccctaatacatagtaactgatactcactcacatccgcaactggtactccatacttactactcataccatagtaagatagataggctaagtgttnaggtaatacagtgaaacactgataaacaattcacttcctgccattccggactaagagctctagcagtcaagatctacatagaacactagacacattgaacacatggtacacaagtactcaataatatactcacaactacaaacacgaaacatagattcattcacttcaacccgtctacatgctcaaacaccagagccactaaggtcattgctgcgataacggtacaagggttaagataacaagttgaaaccattggcgagactacgtgctaaaactcctctgacccgcgccatgctaataacacaataaaccatctaacctactaagcaatcaactccaggtaagtgcagaacggcatcggccgcctgtcgcacaagtgtagctaacatagtgggacagcggggccgccgcgtaacccgttagacacgatggccaaagaggttagtccaataatgctaacctctgttttacctataggagaatacgtgggtactctgtagttgaaactggccgtaccagctgagaggttgcagtctgttccttctttaacttcagaagccaaggtgaaaacttgacccttggcaccgagaacagtaggcttggacatgacacgaacgaagacgagcaagatcgctactggaagctttatttaatatgcaagtgcgaaccagataccataaccaagaagcgctaccaggtcctaacaactacctgcacttgcatttaaccgagtttggggcgagcgcgagctcggagcaggaaacccaagcgtccgagcaatgtaatattgactaagacctatgctaccaggtcaaaggcgcaaatacttataactgcatcttgatccaatta

SEQ ID NO: 622630 - DNA, 446 bp, Homo sapiens
acacttgtatccgacagcggagttgtcttaaataggattcttgggaatgcagagtgtttaatgggcatggtgatgatagcacagcaacgtgaatgtccttaatgccactgaactgcacactgcacgtaaacatggctaagatggtacatctcgacgttacatgtatttcactaattttttttttttttggaaatggagctctcacttgtgtcaactaaactggagttcagtggcacgaccccggctcacagtaacctcgtgcctccgtgggtccaagcaattctccgtgcctcaacctctcaagtagccggaattacgggcaccgtgccaccacaccgtggtaatttttgtatttttggatagagacaggcttccccgtgtgttgcccaggcgtgggtgcctcttttaaccagtggtttttaaaaacccacgtgtatgggagacta

SEQ ID NO: 622631 - DNA, 3644 bp, Homo sapiens
  misc_feature (30)..(30): n is a, c, g, or t
  misc_feature (2447)..(2447): n is a, c, g, or t
  misc_feature (2962)..(2962): n is a, c, g, or t
  misc_feature (2966)..(2966): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 622632 - DNA, 409 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcctctattacactggaagcgtcatgcaagaatccacagcatgcaccctcatgttgccttcacttgacgcttcctcctcatttgatgaggtctctgctttcttggcctcttggttgctctccaggcttcagtg

SEQ ID NO: 622633 - DNA, 363 bp, Homo sapiens
cgtcgacatgatctgttccacctgtctttgggcttgtctccacccccttccaggtatcgcccatcttccccattatcccctgtgtatttatacctgtgttctcagttcgtctgttgccaattcgttttgttgccaattcgcctgtttcttgctcctgcttttttttttgctccttcccggttttgacagttctgcatgaccctgaccctgaccctgaccctgaccctgaccctgacgtttttgtacattaccacacctcactggattattgacccctgcctgccctgatcctgcgtctgccggctgttttggaccttttgcaccctctcttgattattgacccctgaccgtgaccgtcgacgc

SEQ ID NO: 622634 - DNA, 359 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggctccagcagctcctggacgatcttcttctctggctcctgtcccgatcctgagagggtcacagctggcaaatttcctccgcat

SEQ ID NO: 622635 - DNA, 779 bp, Homo sapiens
cacgagatcttaccatcatcacaggtatggtatcttcattaccattgaaaatgtcctgaatgtatattgtctttctggtatgtataaaaagaagccgaaaagttccctttaaatccttggaatttaatcgttcctttattttggaactccaacgacattagatactatgttcttaggttgaatcttaaggacctcagaaacattccagcatttaacagtacgtcagatactccgcagcttatgcataaaagaattctttattaagcatcactattcaaagcaaaatgctagggaaaatggcagctggctactagagaacacgcctatagcttctgcttagacatgtttgatgaaactggtaagtactgtggctttcaatcttgtctctgttcttagtttcatctcagtccatgtaacggaaaatatacacacctaactttcatgtgccttatttgggccaagctactaaatggctagtcattcttacctgcttcagttaccgctgaccagtgatactaaccgttcggtgttgctaagtagtcacaagaaatccgacggagtcactggcttttccctgctgagccttatgtttcccttcctggccccgtccctattgggcacactcgcccaccccccagagggccaacaccgggcgataacaccggccgggctcaacccctattcccgaacgaacgacccggacagacacaaaggagagaacgccacgccccctccagagcccaacacgccaccactacgcaccaagactcacacacagc

SEQ ID NO: 622636 - DNA, 341 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcagctaagcaggtcgggcctggttatattggatgggagcccgcctgggataccggtgctcagca

SEQ ID NO: 622637 - DNA, 175 bp, Homo sapiens
cagcttcatgaaataagatctgcacaaagccttggccctggtgaaatgtctgaaagagaagtctattgactacttaatctacactacagttaaaggaacacccatatgcagagatgagaaagaaccaatacaagaactccagtaactcaagaactccagtaaatggccagagtgt

SEQ ID NO: 622638 - DNA, 258 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctgattgttttttttgagatggagtcttgctgtcgccaggctgaagtgcaatggtgcaatctcggctcactgcaccctccgcttcctgggttcaagtgattctccaggcttcagtg

SEQ ID NO: 622639 - DNA, 438 bp, Homo sapiens
taacttccatgccatggatcttacccatgacaaaatgtgcttcctggtcaaaaaaatggcagacaatgattgaagctcatgtccatgtcaagactaccactgcgcggtgctcatgcctataatcccagcactttgggaggccaaggcaggtggatcacctgaggtcaggagtttgagaacagcctgatcaacatggtgaaaccccatctctactaaaaatacaaacattagccaggtgtggtggtggtcacctgtaagcccagctactcaagaggctgaggcaggagaattgcttgaacctgggaggcagaggttgcagtgagccgaaatcatgctgctgtactccagcctggttgacagagtaagactccatctcaaaaaaaaactaccaatggttacttgctttgtctgttctgcattgattttactaaaaaaaaa

SEQ ID NO: 622640 - DNA, 461 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctcccttttcaaagatcagagccaggtactcttcgttatttctcgcaaagaatccatcaatctcctccagatgcaggcttcagtg

SEQ ID NO: 622641 - DNA, 243 bp, Homo sapiens
tgcgcgccgctgcggcgaaatgtcgtagacgctgctcatgtgtgccatttcggcgcccgtcgcgcgcattcatccataaaaacctgcggatcttgcgcttcatagcggaacggctgccccagctcttccgtcatcatggcagcgatctcgccgtaggatttaacgtcatagcccatgcggttggtttggccgccgtgccgctcggggtgcagcagcgccagcgccgccgcctgcgctacatcg

SEQ ID NO: 622642 - DNA, 693 bp, Homo sapiens
ggacgcgttaggtcgacccacgcgatcgaggacgcgttggggtacaaagcagttctactaaggaggacttgctgcgttaaagaaccaaatgagagtattttgtcagatatgtcaacatacctgaccaacgtgaatatatgtaaggaacaggcctcatatctgagtgatatttgatgatctcaccatcaatcatgtcaggcgcggcgtgacatgttacagccattagtgtaatacccctgattcttcattgcagtctgagttgctcagctttatttggatcatgtcttcattgaacaggatgatgcataataatactgcagatggtcagcaagaggatgaagccagtacaaattgaagctctgcaccagcagcaagaaattacttgcagcaatttgtaagctaattgtatatactgtggtggagatagaattacgtgcaaaatctcttcaaacagtatattgaagtatatacatgacctaatggacaaatcatcaaaaaaacacaatgacgtaagccgaaggccgatagaccaactctccagcgctgccaacagaccctttatctcagccatgcaacacgctttccactgcaaatgatacccgaaaatggtcatacgacgacagatcaactctactcagtgactaaaagacttcccactacgcctcaacgaagcactgcccttcacacaaaacc

SEQ ID NO: 622643 - DNA, 283 bp, Homo sapiens
tacgagacttgtagcctcctcccacacagctctcagtgggagtagagtttgaagtccttgagcagcaggattatagatgcgactgtgagtgacgatcgtagtttgcagtagctaggcagaatagtaatgaggatgtcagcccgtgggcgattatgagacatcactgcgccggtaacgcttcagggggtttggatgagactggctgttactacgagggctatgtggctgattgaagaatatgtcatgagcgattttaggtctgtatgccgttaggccgatctga

SEQ ID NO: 622644 - DNA, 203 bp, Homo sapiens
cagagcccatcccctaagtcactttgtcttgaccccaagtctacaaccagatatcctcggtaacccaccacccaccctcctccgcttcttgttcaagagccaactgagcacccgctctgattccccacagcctagctccctgccaccaatcccttagtcttgcgcaggcttactctcccaataaatgtgctagagctctgcca

SEQ ID NO: 622645 - DNA, 177 bp, Homo sapiens
ggcaatctcgtgggatgcgcctgatagtcccagctactcaggaggctgaggtgggaggatgggttgagcctgagaggtggaggttgcagtgagccgagattgtgcatctaccctccaacctgggtgacgagagccctgtctcaaaaataaattttttttttaagtgtgtaaatatat

SEQ ID NO: 622646 - DNA, 228 bp, Homo sapiens
tctgaagctcatgaaactccagattatcagagcccggtcatatacgttatcgagaaaagtttctgatatcgttgatcgttcatctactgaaggcctgtacgaaacgtgcgctcgaacttcagggatcggacatgattgtccccaaagatctgccccgcgtggtatcaggcaagcgctttatcttgcctgatctacatgccgtgcctgaagcttcgaacactgcataaa

SEQ ID NO: 622647 - DNA, 186 bp, Homo sapiens
ctccagcgatccggccatggctgccgcgctgccttccatcgcataatggttggacagatgccgatcgaactcgcccggcgcgacgaagaagacgtcgaagctgcgcgccagaaggcgtcgtacttccagcaggatgcgcggatcactgccctcgcgcacggcgaaggtcagccgatcgccctccac

SEQ ID NO: 622648 - DNA, 634 bp, Homo sapiens
tcgagtggtccgcacaagctctatctcttgttgcactatgtgagatgtgccttttaccttccaccatgactgtgaggtttccccagccacatggaactgtaagtccaataaacctctttcttttgtaaattgcccagtcttgggtatgtctttatctgtagcatgaaaatgaactaatacagtaaattggtaccagtagagtggggcactgctgaaaagatacccaaaaatgtggaagtgactttggaactgggtaataggcagaagttggaacagttcagagggctcagaagaaggcaggaaaatgtgggaaagtttggaactccctagaaacctgttgaatggttttgaccaaaatgctaataatgatatggacaatgaaacccaggctgaggtgatctcagatggagatgaggaacttgttgggaactggagcaaaggtgacactcttgttttgtgttagcaaagagactggtggcattttgcccctgccctagagatctgtggaactttgaacttgagagagatgatttagagtatctggtggaagaaatttctaggcagcaaagcattcaagaggtgacttaggtgccattaaaagcactcagttttacaagggaaacagcatacaagt

SEQ ID NO: 622649 - DNA, 949 bp, Homo sapiens
  misc_feature (253)..(253): n is a, c, g, or t
  misc_feature (276)..(277): n is a, c, g, or t
  misc_feature (281)..(281): n is a, c, g, or t
  misc_feature (386)..(386): n is a, c, g, or t
  misc_feature (740)..(740): n is a, c, g, or t
  misc_feature (767)..(767): n is a, c, g, or t
  misc_feature (816)..(816): n is a, c, g, or t
  misc_feature (819)..(819): n is a, c, g, or t
  misc_feature (826)..(826): n is a, c, g, or t
  misc_feature (839)..(839): n is a, c, g, or t
  misc_feature (926)..(926): n is a, c, g, or t
ccgggcacagccgcttcgcaagggtggatcctgagctgccgaagccgccgtcctgctctcccgcgtgggcttctctaattccattgctttttttagattctctcgggcctagccgtccttggaacccgatattcgggctggccggttccgcggcctgggcctaggggcttaacagtagccacagaaacggcggcgccggcaacaacaccaccaccagcagccatctcttcccgtacccgagccaccacaggcncccgaaggccgggaccggccttnngagnaaatggcagacgatattgatattgaagccatgcttgaggctccttaccagaaggtgagaaaaaacatgtcggtgaggtttatatatttctttatttagccattanttcacgaaactactgctgaaatgtaactaccttcccgagccctcttgatttatcttatcagagatgcattacgtgtaacttacaaaagtaaatatatgctatggatggtataatattgtgccatatttcaacttcaccttaataaaaaattgccaattaatctctcttggaaaactggcttaccaatttctaacttttattccaataatttaaccttggattccagggtgacctgtcaatcttaaggtagtaatggattgactaatcgctgtaccgtggtcccctaggtaaaatgactcaactaagaattaccacctccagtttggtatagcaaaaggtgaatgtagtggtttnggaaaagcaggggtccaagaataacanagcatgaccagtctgtggcaagttaaatcttctaatagtcttataaganganatgggtnagattttaaaatntatgtatctatgtaaaactggtgatagtaaatcttaaaacagtccagtggcaatctgctgctcagtaaatattactaaaattctggnatccctgaatagaatttaaaaaa

SEQ ID NO: 622650 - DNA, 456 bp, Homo sapiens
  misc_feature (253)..(253): n is a, c, g, or t
  misc_feature (276)..(277): n is a, c, g, or t
  misc_feature (281)..(281): n is a, c, g, or t
  misc_feature (386)..(386): n is a, c, g, or t
  misc_feature (436)..(436): n is a, c, g, or t
ccgggcacagccgcttcgcaagggtggatcctgagctgccgaagccgccgtcctgctctcccgcgtgggcttctctaattccattgctttttttagattctctcgggcctagccgtccttggaacccgatattcgggctggccggttccgcggcctgggcctaggggcttaacagtagccacagaaacggcggcgccggcaacaacaccaccaccagcagccatctcttcccgtacccgagccaccacaggcncccgaaggccgggaccggccttnngagnaaatggcagacgatattgatattgaagccatgcttgaggctccttaccagaaggtgagaaaaaacatgtcggtgaggtttatatatttctttatttagccattanttcacgaaactactgctgaaatgtaactaccttcccgagccgctgtccangtcctgctagatcacctcgc

SEQ ID NO: 622651 - DNA, 393 bp, Homo sapiens
gatcttcttctttgggacggcgggcagccgggttatgaccgaggagcagacctggcaggaggcgcctgtggagttgagagtcttaagtgtcctcgtgctgtctggctgtcggtcgcgccaccttgcggggaggtgcggagttctcgccttccagctccccttgctcctggtctctcttcttggcagcgttctttttgtcccattgctgattcaggtagcgcaggaggatgtttgtcttttctgtcacgatgatctgttcagacgggtactcgcgggtaggcaggtagactgagggccgtcggttcgaggctttgcacacggattccgcgtgaaatcgactaaaattgcttttgttgtagacaggcagtccttttcaaaaaatctgccatcttc

SEQ ID NO: 622652 - DNA, 701 bp, Homo sapiens
gtattagataaggaagtaactattagggcacaacaaaaaaattaaaagagaaccgcatactttggtgacaaaaccaggatgctatggaaatgcccaaaccttttagattgacgcgctggcattttccatttccgttcctggatctacggagtcttctaagagattttgcaatgaggagaagcattgctttcaaactatataactgagccttatttataattagggatattatcaaaatatgtaaccatgaggcccctcatgttctgatcaggcagaatggatgctttcaccagcagacccggccatgtggctgctcggtcctgggtgctcgctgctgtgcgagacattagccctttagttatgagcctgtgggaacttcacgggttcccagtggggagagcagtggcagcgggaggcatctgggggccaaacgtcagcggcagggggtatttcagtattatacaactgctgagaccagacttgcttactggctgaatatcagagcttgttgtaatttctccacttggagaaccaacattaattccatatgacttcaaccgctctgcaactgctttctctttattcggcacagattccttgaccctcatctactccatcacatagcgtgatcaacccagcccatgaccaccgcacttcagcccaacaaaacaaaatctgtcctctttgcctcattgcgcggc

SEQ ID NO: 622653 - DNA, 856 bp, Homo sapiens
aaagtcggtgcttacatgacgacacttgtctacaagcccgacacagtagcatttgtgccaatatctggttggaatggtgacaacatgctggagccaagtgctaacatgcctaggcttcaaatgacgatcggaatgtcacccgtaatgggattggtactcgccatgtggaaacaccagctggttgaggctctggagtggcaattcgtaccagcaactcgttccaactagacaagccctttggggcatgacttcgtccagggatgtctacaaaatgggtggatattgcgtactgtaacctgtcgcccgaggtgaacgactggtgttctcaaacccggtatggatggtcacctttttgctcccagaccaacgtttagcaacgggactgtaaagattctgtcgaaactgcaccatgaagctttagatgtgaagctcttcctgtggggacaaatgtgggcttcaaatgtcaagacttgttgtctcgtcaccggactgtgcgttcgttggcaaagcgtgtgcctggtgacaggatagtactgacgcaccaactggaaagcagtggcttcacttgctcaggtgattatcctgagagcactccagggcaaataaagcgccggatattgcacctggtatgactgcacatcgggtcacatttgcatggcagttctgcgtgagcctgcagggacaacgacttgatcggcgtcctgggtgcaaagctgtaccatgggccttaactcttgaagtctggtggctgctgccgtgttgataatggtctggaaggccatgtgagtgaaagctatcagatactccacttgggggttgtgcgtatttggacgacatgcgcggtcatcaacctgca

SEQ ID NO: 622654 - DNA, 915 bp, Homo sapiens
ttgtcacccatgtacacgtatcctgaacactgtaagcggcttaccaagtgctctcatcgcctgctcagtacatctgggtctcacgtccgtgtgctctctgccccaactccacttccatgatgggcaaaagcaaccgggcccctgagtttctacctgcccatttccgtgccggcatggtcgctccagcaattaagatggaatgatggatgggcattcttgggtagtgtttggagagcgacgcgcaatttgcgcttgactaattgtagagcatagggagagagctgtgcggggcaaagtacatcgcgcatagcgctaatcacggcgcaggtggtcgcagctcgcgtgtcgcaacttctgtctcggatatccgataataattgtcctcccatggcgagtacctgtgatgtttgctcaaacttgggcatgcatagcgatgcacaatgaaaacagtgcccatgacgaatggtcgaacgagaggaacattgattgcgacatatcttgatgcgcttgtcctcggtactcggttaactatgcagacggaacgaactgtaatcattgggttgattgcgaaagccgcacttgcacatttggtgcctaggagtattccaacgatgtttcgctggtggacagccccctgatgggatgcggacttacttcctcaggccaaggttttgtaggactttccctttcatattgtccgaccctaggggttccatttttacactcagatgaaacgcaaacattgggttgggggtttgccatacaagctgggcactataacccaagaatggcgctggtttcccgggtcctaggttatcagtgccgccaaggttcgaagagctcgcttcgtgagacaagatttgtccgcaggtcctgagtgtctcatgaagggcttgccaatagtgcaaggctacc

SEQ ID NO: 622655 - DNA, 911 bp, Homo sapiens
attttccagcagcgctcgatgaggcggagccggatagcgcggcccaggccggacccggggcgctcgcgggccgtgacggggtcgggccggctcccattccggccggatccccttcggcccatcgcgcggatagtgacgggacaatgtccgtgtcaagggctcagggccgagctgaagtcctggcgtccatctgtcgaaagacaccaggagcgattccgctattcgtcggttgaacgctgtgacgagtcttgcactgccatgttcctggttgccggagaaggggccgcccgaacttcggggcggacaggcatacttcaaggcctccaagttggcaagcaattcgagcgggagttgccttattccaattcttttcttacgacagggaataatgggtcgggtggggattccgagaaaagaccccaaatattttgtggacccatacaaggtttcgggaaacagcgttctaggcaagaaatatcttaaggaagacaaaccaatgtgggatctggcgcgccagaccaagaaagaaatggttgattctcacagaacagcacagcaagcgccaagagacagaaagaaacgaacgatggggttctgcaaacgcatttgtgagaccagacctttagcacattccaataaatggaagaattgtcacggggacaggcaacaagaagatccttaatttgaggtggcgcacaccaacgggtcaggagtgtaattgaacagggcacctcgagaacaaacaagcacacaacttgtgggggccaattatttagacaggaaacaaatctacgaggaagccacctcaaagggcagagcacccattgtacaatgcggtgcagtgctcctgaggctaccaagagccaagggctcacgaagtataaatttatgcaaaaacgagcctccagggc

SEQ ID NO: 622656 - DNA, 971 bp, Homo sapiens
tcaccacttatctattgtaacattcgaaaaccacagctgcacgggcaaacacaccacgtatcccagcatcttcatcctgtacactcgcgaatcaatttcatctctgggcatatccaagataaactcaactttcaagaaatcttgtatatcattctaatcatctgtgctcaggatgacacctatgatagatgacttcggttcgaatagctttattctggattttcataactaaacgctaaatccaaagacctgaaacaaggacaacaaagacaaacacacacacacacacagcacacaccccaccaccacaaagcaagcaacaaaatacactaaacgtcaagcgccaacacggaagcgggacaccaggggacctcgaggtcacccaggaactgtgacgacacagggtcacgtgcgcacctgtgcgcgcacaacctgccgcttaccccacactgggagaactgctcagcatattttcttaactgcctggtacaaattccatacaagggatcacttcaaccttggcacacaaacgttcaacacagtacatcacacttcccgtgtctcagtgcgatttcaatatttatcagcacgtcattcacaacattagaacaggttcaatcacactagttgacgaccacgtgatataactacattggcaaaagaaaaccccctcagttgccccaacaacaccacactagcaaaacggccttctgcaatccttttcgtccaccataagagcgttcactgtaaccccacacacaaacggcgaaaagaatactatatatgacatgtgcttagtgtgacacatctactcccagcaatttaaattcaccttaggctgacactacacagtgttatcaaggacaatgggaacacaaagataacgtgcagtacacatcccatctcctcacaaacattcagggacacctatacaccccggaaaccattactgaatccccacacactcctag

SEQ ID NO: 622657 - DNA, 106 bp, Homo sapiens
tgccaaagctgatacccaagcgttatcgaaccctctcacagtggaatgtgagagcacagtctgaatctgcacagagcaatgatgctgagttggagctcggggtgct

SEQ ID NO: 622658 - DNA, 100 bp, Homo sapiens
gcggggggcgactgctgaagtccattcaaatcaggatacatcccgagttacaacacctcgtgaggcctgcaagagggctacgccccagacaattacccca

SEQ ID NO: 622659 - DNA, 267 bp, Homo sapiens
  misc_feature (57)..(57): n is a, c, g, or t
gggtgactctagcaggatctcacgtaatatgtaacactgcttatatgatagaatggnatccttgagaagtgcaatttaatccaaggccataagaaaaaagggaactaagatcacatgggacaatttaaaaaaataagatggtagatttaaacccaggcatagtgacaattacgataaatataagtggtctactcggtggataagttcaaactaaagtggatgggaaaaaatataacatcctaacattcataaaggaaagctgaagtg

SEQ ID NO: 622660 - DNA, 206 bp, Homo sapiens
gggttcagggccagccttaaatgcccgttaaattcctacccccagttttaagccaaaagcttgcctcctccccccctgccagcctttgggttcccaaagggttggggcggtcccatgcccccatgtcccagctccccccccagcgttgggccaaaaaggctttggtgggggggttttaataaaaaaacaaatgaatggttgcccca

SEQ ID NO: 622661 - DNA, 90 bp, Homo sapiens
gctcgaccaaccccctgacaaaacacgatagcactatcctcctgtgccctgtggtactatccctatgaggcataattataacaagctcca

SEQ ID NO: 622662 - DNA, 236 bp, Homo sapiens
cctcccgttgttgttgttgttgttgggggcccttgtggccgccgaaattcttttcctgcctgcaggccccaaggtcccccctttttggccacaggccccccctccttcccatgtcccgcccagccccgcccccaacccaaggtgttgaaagttttccagttgcacaggcccccgccccagggggtggccgttgttacaaaaacaataacccctgttgggcatggggtggccaccca

SEQ ID NO: 622663 - DNA, 975 bp, Homo sapiens
tggtgtgctgtctctgttcgtgtgccgtggtgtttgggttcttaggattgggcggtgtcgtctggctctcgtgacgtcggatgtgtcgtggtggcgagtggggtgtgggcggcttttgtctgtgacggcgtggttacgtcgccctgttgttcggcggctgttttttgttcgtcgacacgtggctgtcgtggcttgttttgcacttgtttgctgcttgagtgtagctgtgtcttcacgcgtgttaggtgttgatctcttatcggcgcgttgtgggggttttgtaccgccactcgcttcgcgccagtttgtgtgccagttgtcgtccgttgagcccaccctaggagggtatgaaagttagccgtgttttgtcgctgaccgcacctgcttcattaagcgctctggtttgttggttcacgtttgttagttgtttgggctgcgattgtgccgcgacgattgtggcggtagttccccgtgttctgtcttgtcccggccgtcgtccgtcctcgctctgtcggtttttctcgcccgccggtgataccagtctttaaatccgtgtggctgacccgcccctcgtctgtgcccgccgcgcggctcccttcttccctctttgggggggccccgccgcccgccgcgtaacgggcttttttgccccaaaggggccacttattgcgaaggaatattctccaccacataccaatagtcgtcttattcgcccaccagttctatcggcccacccaactaacacctccctgtaaccttcttaatttgttacgcccaacgcctcatttatatttcccacctcgccatatcacagctgacgccccccacatttcttaaccaccactgtaaaatataaatagaacccgccttgtgtaacaaccacacaacccccgccctcctgcttcccccaccatttttcccccttcccccctttccttcccttttcccccttttttttaatatttcccaaaaaaa

SEQ ID NO: 622664 - DNA, 174 bp, Homo sapiens
  misc_feature (150)..(150): n is a, c, g, or t
ggtgctcagaggatccggcgcctagcacttccagtaacagtcttttctctgggtgggtagacaaacccaagatcaaccttcccttacttccacaagtagtacaaaaacaatatcccctcactaagtcttagggaagcaggaagtgctagnggcggcggaagtagctaagggcgg

SEQ ID NO: 622665 - DNA, 165 bp, Homo sapiens
catgaattacggggaggggtattaaccgggttggctagtggtataactcagtctggagctcgcctatgacgtctggtagagcaatagtgttaagtgtcattaaccgatcagaaggaagagaacgtaagccgaggcgcgtctattgacttcgtgatagtacacgcg

SEQ ID NO: 622666 - DNA, 549 bp, Homo sapiens
tgctccagctgtctcagttgccctcctcctctgttggccgtctgcctcgaggctatggtccgatcttcctctcactcttttgcagccgcgtggtccatggtgaggactggcggtcccctacagctgggccctggctggtgtccctggctgtatgcgaaagcgtggcaagcttctacctgacgtgtggcggtagcctcgatcgctcccggagttgggtggtgactgccggtgcaccttggttctcgagggcatctgagctaccatggtggttgttgggtgaagtacgatggcttgctgtgatagggaggagccacgagcaggtgagtccctcatttaactctgaggagctgtgtgtgcatccaatgctggaggcggtcgtgtgtggtcgtgtgtggaatgacatcgccctcatcaagctctcacaggagggccgagatgaggagatggggccaggctcgccttgatccctcgcggctggtgagattgttcccaacatatgacaacctgtatacttcacgggtggggcgttctatacaatgggtcatgccg

SEQ ID NO: 622667 - DNA, 329 bp, Homo sapiens
atagaatgactgcctacctgcagatatgctagatatcgcttataaccagattactgacactgaaggcatctctcatcctcgatcttgaaaacctgaatctcacaagggaacagtcatccacatggtagaaaggtctagaaccccgcagaagttgatacagcctgcacacaagtggagcttcgggggaaccagctggaaagcaccctggacaatcaatcttcctaagcttgaagaacctctacctggacccaaaacatgctcgaagaaggtggaaggctaggaggatctgagcaatctcagcaacttgcctctacgagacaaacagatcg

SEQ ID NO: 622668 - DNA, 718 bp, Homo sapiens
cctccgcccgtccgcctccagatttctctcgcctcggtgcgaccaactccccccgacgcgccaccctctggcctactcgcgcactacacgacacgtcgccacaagcaggctgcaccggtcggcatccgcggcttcgccgccccgtggccgaaccacgcctggcatctacaacagctttcccgcgcaatgcccgggctccgcggagcgcacgctgccgcggcgaaatgtcccagcatacccccgccttttctgcggagcggcttaccacggccatatggggggcaggaacaaagccccggcccccgtttcgcatcatggtgtctcgcagagagcccgccccctcggcatccagatcagagtataagcggaggcacggccagtcgctgtcccacgacattccgggagattcttcaggggattaccggaagattctgctgaagatctgtgggggcaatgcccgaacagtgactggtggctcatttttgcccccctgccggccacacccagtgccaggaaaaggccaaaagaatgttggtttttaacaaatccccaaatagccccgagattccccgtcctagaggttaggcctgttttccccccctcctgacccgtatagggggccccagggcctgggggggtttagaactttttcgggaggccttttttaccccctcccccccagcctcttgggggtaaaaaagatgtttcatttttttga

SEQ ID NO: 622669 - DNA, 1103 bp, Homo sapiens
  misc_feature (123)..(123): n is a, c, g, or t
agcggggatcgatacatggacccggctggcgcgggtggctgcgggcgctgtgtgcctgggtggcgatgcgccattgcgccttggacggctggtgaggccgccccgcaggatcgtggctatccnacgcaggagcccgggctgggcttcagcagtggggcggcagggtctgtgcgccgaggctcaactgtaggctagtcaagctctgtagagtgcgggagcccagcagggctagcttggcgagtcgttgcgagccgctgggctctccgtcgagggcgtggggacgcaccatgtgcggcttgttatcccatcaaccaggtcggacggggcttggctagcgctttgacgacgactcactaggtgaacctttccgagcgccaatgcacgtcggcttgcgaagtcctggcggcgacgcctgcgtcccccttgttcgcagtcctggcctctggcggtcttgaacccttgttagccccaacgtacaatcatactggttgtccacgtatcattgctacgcgaaagtgctcgcggcagaccatctcgcgtacggacgtttccccaatttgcctcgtggcccaataacgcgagggatgtggatgcgaggttgagaagcccttgatgcctgcgatgggacctggaggattcatggtatcgtccgttcgcataagcaagcgagacagggggtgcacgcaagttctcgttggattgtggctcctaggaaaggcgcatgtacacagccttcggaccacaccgaaatcttacattagttggagcgtcccttgcttgtcgagtgctatcagggcgatcgcgttcaaaggcatgcttaccttggagtgctcgggaggcccgaggcccgcttgggtacacgaaaggaatccatgtcagtcttatcgataacccgcatgttccaagtggaaatggctgttggtcgatcaccggacgccagggggtccatcaggacgagtggactccgaagggtatcgcgcataattaaggtacattgggctcatttgcgtccaaaccggaagcataggggagggccccaacgccaagatggttataggctgtggggatccgagatggccctaaggaacgggacggaaggattg

SEQ ID NO: 622670 - DNA, 238 bp, Homo sapiens
tcgttctctagcagcgatccccttttttgcggcttcctatacccaaccgctcttcatcatcctccagcggatctgaccacaactagccccacggcccaccagtcatcactctccctgacagcacgatcttgtggcccacgatctgctctctatcagatcctgcactgtctctcccatctgctgtacatgcgccagaaagttctagactattgctttttctttcaacctttgacgcatg

SEQ ID NO: 622671 - DNA, 171 bp, Homo sapiens
  misc_feature (24)..(24): n is a, c, g, or t
  misc_feature (27)..(27): n is a, c, g, or t
  misc_feature (40)..(40): n is a, c, g, or t
  misc_feature (44)..(44): n is a, c, g, or t
  misc_feature (110)..(110): n is a, c, g, or t
  misc_feature (123)..(123): n is a, c, g, or t
  misc_feature (148)..(148): n is a, c, g, or t
  misc_feature (160)..(160): n is a, c, g, or t
tcctgcaccttcctggtggcccangcngagctcacaaganacangagctctaaatagaggccatggcaatgggatccgctagaggaggaaaggctgcccagccaggctgncccacccttggtnctcaccacccccttgggaggagggngggtacactggntctgtgttcct

SEQ ID NO: 622672 - DNA, 227 bp, Homo sapiens
aatgagtgagagatgtgagctacacagaagcaaactcccaaccaaccctaggaaaagccctcttccatcgttacggtgctcagtgaatattaatgtagttctgcttaagatggtagctatacacacgtttgaatgagccacctaagtaaataaaccttgacgatgacaaaccgtgcgaaatattttatcacgctgttatgggaaagtgattttaagcaatagcttcc

SEQ ID NO: 622673 - DNA, 132 bp, Homo sapiens
cagatgaaaaagaaaaaccaggctccaggtaagggctagtctcctcctgtcacagtgtccccagggccacctctccaggcaggagggcgcgatgatctcacttgcgtgcagatagaccttgttagtgtgacc

SEQ ID NO: 622674 - DNA, 310 bp, Homo sapiens
atcagactggcaacatggagaaaccctgtctctattaaaaaatacaaaattagccgcgcatggtggcgcatgcctgtaatcccagctacttgggaggctgaggcaggagaatcacttgaacctgggaggtggaggttgcagtgagccgagattgcaccactgcattccagcctgcatgacagaacaagattccatctcaaaaacacacacacacacacacacacacacgcacacacacacacacaaaatgctgatgcccatgtttcatccccaggagattctgtaataattgctctgggatcacccttat

SEQ ID NO: 622675 - DNA, 778 bp, Homo sapiens
  misc_feature (371)..(371): n is a, c, g, or t
  misc_feature (778)..(778): n is a, c, g, or t
atagattgtcaggaggacgatgatcggagggcgcggaggatgctggctggtggacatgggtcatgagaggtccgcttaggtacagtgaggttccatcgactgctagcctggcattcactgacgcaacttagagagacgagaacggaggcgagacggaagacgataacgtgacacagaatcaccacgatgttgagtgcgagcatggttgatgaacaggagtgaaatgcaagagtgaatctgctagtacggatgctccgagatgatccccacagttacgccctggacgttgcaggagcgccccggagatcacaggagcacgagacagcaacgacgtgcaacccaacgaacacacttgacttagacaacccaangagcatcagccgcccaagcagagaaaccacaatccacacagggccggagtaggcccacgcagtcgcatccagcgcatggcatccctgagataccatggccaccaggagacacgtcagcacaaagggcaccgagtacaggagaccgccaacccacaacacacaagagcagcacttaacccacttgaccctgggcagcaaagaaaacagacccaaccactggaaaacttcaaagccaccatatcgcaagacccacactctcgagacaaacagccagcctacgacataccagaccaaggcacatagaatatgacgaaacgggccgattcggacaaaacagcggaactgagcaacgcccaatcacacacaaccaagcaagagacatcaggcagcacgaacaacaaacatan

SEQ ID NO: 622676 - DNA, 240 bp, Homo sapiens
agagtcaagatagtctggaagattttgtgccagaaaatagaggaaatgttccaaaaaaaagaagaaagaggtcaggcgtggtggctcatgcctgtaatcccagcactttgggaggccaaggagggcggatcacctgaggtcgggggttaaagaccaggctggccaacgtggtgaaaccccgtctctactgaaaatacaaaaattagccgggtgttgtggcgtgtgcctgtagtcccagct

SEQ ID NO: 622677 - DNA, 810 bp, Homo sapiens
gcgccgcctacaatggtgcgcatgaatgtcctggcggatgctctcgagagtatcaatcaactgccgtaaaatgagagagcaagactgcgcaggatgtctcaatttagagcctgttgtctcccttaatgttcgatcgatccgtgtttgcatcagcatgtgatagactgacagacagtgagtttgcattagggtggaaattgtaggaatactcatttggagtgacccatcccgcagctgaggacaaaattgtttgtgaacccttcacaggtcaggcttaaatcgcagtgttggtggtgatcagccccgagattccgaggtagcaacttgcaaaaagaccctgggcaaaaataggctggaaatgaactactgcatttccatacccagccaagatttaggattatacgctttttgtcacgtgactaatcctacagacttgtggatccattggcatcctatttgaagtagagtcgaccggacgcatatacaccacacgtggatggaaaaaatcctctgggaattgcttgtttctcaggtgatgtaatacaggtatatttgctccatgaaattgccctcatgtggacgagtgatggtccaaagtaacaacctacttgaacgacgtcttggtaccgacccttgattgggccatgccaaaaaggtggaaatgaccttggtaacccggacattggtgttacaaattctgctttggttacaaagaatttcgttacttaaggcctttaacctttggtttgtaacgctaaatcctggttagaaggggttctccccttacttgtctaccacacattattctgt

SEQ ID NO: 622678 - DNA, 155 bp, Homo sapiens
tgtaataccacattccagtatgacggcacagacgctctcctttcaaattcacaggcaatacaggcgcccagctgtttttcatagagcgacaagctgccctcagattgacacagggccccgtgtgtaaatatatttcccttcctatgtacccacct

SEQ ID NO: 622679 - DNA, 100 bp, Homo sapiens
gtgggtaacgttggctcacagaaggagttaggaagtattccacttgcttctatcttctgaaggaaatgtagagaattagtataggctgggtgtggtggct

SEQ ID NO: 622680 - DNA, 258 bp, Homo sapiens
  misc_feature (53)..(53): n is a, c, g, or t
  misc_feature (75)..(75): n is a, c, g, or t
  misc_feature (109)..(109): n is a, c, g, or t
  misc_feature (117)..(117): n is a, c, g, or t
  misc_feature (128)..(128): n is a, c, g, or t
  misc_feature (133)..(133): n is a, c, g, or t
  misc_feature (155)..(155): n is a, c, g, or t
  misc_feature (175)..(175): n is a, c, g, or t
  misc_feature (188)..(188): n is a, c, g, or t
  misc_feature (194)..(194): n is a, c, g, or t
  misc_feature (197)..(197): n is a, c, g, or t
  misc_feature (205)..(205): n is a, c, g, or t
  misc_feature (208)..(208): n is a, c, g, or t
  misc_feature (212)..(213): n is a, c, g, or t
tttgctactcacaagctttatgtagtggaggatagaggtattttggtctttanaaccttgtcggggtgagggctnctaacttacacttcagaggcctgtgtcccaaagnccgggctncgtttgccgtnctgtncgaggacctgtgtacacaggcnggtgtgcccctgcccgagcncgagtagcccttntgtagnggngaaatgcngcnggcnnctgtttattaaaattgctgctgtgaaagacagggataaaatatcc

SEQ ID NO: 622681 - DNA, 179 bp, Homo sapiens
  misc_feature (41)..(41): n is a, c, g, or t
  misc_feature (128)..(128): n is a, c, g, or t
  misc_feature (168)..(168): n is a, c, g, or t
ataaataaactaataactaaatgttgtaacacaaaagaggntgaatgcttaaggtgatggatatcctgtttaccctgatgtgattattacaaattgcatgtctgtaccaaaatatctcatgtacccgntaaatatatatacctactatataccgacaaagttaaaaanagaaactggaa

SEQ ID NO: 622682 - DNA, 101 bp, Homo sapiens
taatatttcaggacagccagcttaaccatctttctctgtgcttatgcttcttgggagtggtgtaagacttcttcttccttttcttagtaccaccacgaagt

SEQ ID NO: 622683 - DNA, 273 bp, Homo sapiens
  misc_feature (11)..(11): n is a, c, g, or t
  misc_feature (256)..(256): n is a, c, g, or t
acagcttaagngttaacagctcagtggagggtcagtgtgacagactgtattagtcagggttctctagagggacagaactgatggaatatatgtgagatatatatatatatatgtatatatgggtgtttgttaagtcttaactcacgtgatcacaaagtcccacaataggccgtctgcaggctgaggagcaaggagagccagtctgacttccaaaactgaagaccttggaatccaatgtttgagggctggaagcatnccagcataggggagaga

SEQ ID NO: 622684 - DNA, 187 bp, Homo sapiens
ctctagaggacccctacagtgcctggggcttccaaaggcactcgcatgcctatttgagcctgtagccccagcacaggacaacgttgttgatgcggatgacgtggaaggagtggagcacaccgggatatggaagcatctttgccacagccttttaccatgtacttattggcacacattcgggcagcct

SEQ ID NO: 622685 - DNA, 181 bp, Homo sapiens
acacacacacatatatacacacatacatataaatatttatacacacttaaacatacacaggccggcactgtggcttacacctgtaatcccagaactttggaaggctgaggtgggcagatcagttgaggccaggagtttaagaccaggctggccagcatggcaaaactcttgtctctattaa

SEQ ID NO: 622686 - DNA, 957 bp, Homo sapiens
gcatatcgtgggccctgagaccccttcgctcctacctcagagtgagcggagaccagcaatttggatgttaatgccctccacccgcagcgctgtcgctccggcgcttctcgcatcatcgtgagggtgctagactgaggatgcgatgggcctccccaagataagagatggctatcgccgcgggtcaatggacgaattcctggatctacgaatgacagtctgtcacgggcgatatttgaccgggtgtgttgacaggaggtccagtaacattatcccgggatgctgcgtggacaccgatgaaagcgggatgctcgactcaggtctccgtcggcggacctgtgacttgtgggcgtaggattgtcgatcgttacatgtggctgcaacgacatgtactctcgcaaggatggcaagaatggaccatcctgtgcttcatccccttataccaatcggaaaccacatctagttcggatatccagtaaggtcagcgcgcgtcgagcgatatcaggaatggcgcactcagatcgtattgcgtaaagccctgcctggaaagcattgtatgctcaccggcatggggagatgacctagttgcctataagctcgcctattggctgctaatctcgaatctgaggcctactatcctggatagctttctctcatcgaaacatggatgactgtggggtctcatcctgaaacttacttcaagaaccgaccagggagacgtcggtgcccgtcaaaattggactgtgtacgcagggttgcaactactatgattcggtatgaagacccagcttagtcttgctatgtagcgttccctttcagatgtgcgccatgtacatggggagcatggattctgggagaacgaggcgggtcggaaaggcgaaatgttccagtccgagtgagggagtccttgcaggttcaggggggtccttggtgccttgtgtcccatgtgccggcacattg

SEQ ID NO: 622687 - DNA, 324 bp, Homo sapiens
  misc_feature (21)..(21): n is a, c, g, or t
  misc_feature (158)..(158): n is a, c, g, or t
  misc_feature (175)..(175): n is a, c, g, or t
  misc_feature (195)..(195): n is a, c, g, or t
  misc_feature (316)..(316): n is a, c, g, or t
gcttctctaagtctccaaatnactggaataaaactgactttcgcctggctcagtggctcacgcctgaaatcccagcactttgggaggctgaagcgggcggatcacctgaggtcgggagtttgagaccaacctgaccaacatggagaaaccctgtctcnactaaaaatacaaaatnagccgagcacggcggtgcangcctgtaatctcagcaacacgggaggctgaggcaggagaaacgcttgaacccgggaggcggaggttggggtgagctaagaccgcgccaatgaaccccagcctgggcaacaagagcaaaacncgggcgca

SEQ ID NO: 622688 - DNA, 316 bp, Homo sapiens
aagaatgtaattcatggcagcgactcggtggaaagtgctcacagagaaatcgctctttggttccgtgaggccgagcttctgtgctgggaggacagcgccggacattggctatatgagtagatgttattgcagtcagcattaccaatctggaggttgttggtcttctgtgatcttcacagagctcagcatcagtaacagtgctgtgtgagtgcaggtcaacccaacctagtcggtccagggacaaccactcccaccccttgttgcctttcataataaaactgcagaaaaccctttgtgcgctggtgaagtttcaaga

SEQ ID NO: 622689 - DNA, 112 bp, Homo sapiens
tggttgaccgtggcttagccaggacctacgcagccctgaaagagatcgcacgcagtatgaggcaatggcgtcagcaacatgcatgaagccgaagagtggtaccgctccaagt

SEQ ID NO: 622690 - DNA, 893 bp, Homo sapiens
caaaacaccaaatggcggatgacgcctggtgcagcggggtgggccctgggggtccctggtgtgcccgtgttgattggggaaccgcgtgtggcttccgcgtgaggtttcggcagatggcatcctggggccggggtcgcggccgtggactgggcctgtggtgcctcgagtgccgcggcagctctgcggagtgcaaggccgaggatcaggagtggatgcccgtcaccaagttgggcctgcttggtcaaggacatgaagatcaagtccctggaggagatctatctcttctccctgcccattaaggaatcagagatcattgactttcttcctggggggcctctctcaatggactgaggtattctgaccgattatgaccaagtgcaacagaaggcaagacccagtgccggacacaggagcacacaggtatcaaggacactatgtatgctatcgggggactaccactggccacagtctggtctgggtgttcacactgctccacaggacggtggccacctgccatccagtggtggccatctatccctggccaacaactcttccattcgtccccgtgctgcagaggcctactggcgcggaacacagaatctgcgaaagacccacagaacgtgtacccttgcacaggtggttgacacgggccaggcttgcgcgctcatgttggcctgtgtaacgcctcaatcaccttgaagcccacgggagcacctggcatcagattctctcagacaccctggttgccataacgaaaggcttgcctcaatgcatgggctggatactccgcaacgacatggcacaacctatagccccggcgaattgcaactggcaaacactgggcgaaccttaggccaaggacacactaatgatacacataacaagagacaagg

SEQ ID NO: 622691 - DNA, 162 bp, Homo sapiens
  misc_feature (78)..(78): n is a, c, g, or t
  misc_feature (88)..(88): n is a, c, g, or t
  misc_feature (139)..(139): n is a, c, g, or t
  misc_feature (152)..(152): n is a, c, g, or t
agagagagagagagagagagagagagagagagagagagagagagagagagagagagagagagagagagagagagaganattgcccctnctttaacactctatgtggggaaaaagcagcttatagagattgagaaggttnttctacaccctanctactcccag

SEQ ID NO: 622692 - DNA, 638 bp, Homo sapiens
gaaccctggctctgagctctcctcccatctgtccccatcttcctccccacagctacccacccagtgggccctgaagcagggccaaaccctcttccttgttcccctctccccacttattctcctcttgtggagatcttcacacttctgcaagtgaatgtggatacgcgcgccactccgtgccccctcttggccccatccatgggactcgttgcctcggtgcagtctccactcttgacccccgcacctcctactgtcttgtcttgtgggacagttgcctccccctcatctccggtgactcagcctacacaagggacggggaacattccatccccagtggagtctcttcctatgtggtcttctcatacccctctagcccgacatttggccagtggactcatcgcattctttgcgaaccaaatcccccgccaatccgaagagtccactggacttcaatggatcgtcatccaatttgtgcaggagcgacttcatcgccctcatggctggaaggctgatatctgaaagcacgtcccaggctcatcatgggagcttttcctcaggcacccttcaactttccctcccagtggtagcccttcctgtccagttggggggctggaccctttcttaattcagaaggtctc

SEQ ID NO: 622693 - DNA, 674 bp, Homo sapiens
  misc_feature (536)..(536): n is a, c, g, or t
  misc_feature (542)..(542): n is a, c, g, or t
ctgccgctactactaccctttcatctgtaggaatgctgatgttctgtgtagggagggattgtgactctacctctcatgcagctgaacctggagggtactcctcctacagggatgcagtcaccctgaagtgttccagaaaggctgtctacagatgttcccatgctgaactcctgtggtaaaagccccagctgtgtctgcagtggtgggcaagggggagaagtcccttctctaagacccttcatgagcaccagggctgcctgatcgttgggctagagcgccagactcttctcactgaacccagcactgcacctgtatctctgctgaaacagacttcccacaagtagaaagtgcaggggtgcaaggcctgcagcctgatttcctttgcctcacagggtgctcccttaatgtggtgcatgccttcttccctaggagtagcaatccctgagggccagactactggaaatccctctgctcctcttagtctagccacccagtggggcttccgcaccccagactgttgctggggaatatctgcngacggntcagtggtataacctgtcctctagtctcccagcagcaggtactgcgtcagctctgatgggagtaggagggaagtcacgtagattgtgtgagatttccttggttataaatagccttagtgtgttggctttctc

SEQ ID NO: 622694 - DNA, 153 bp, Homo sapiens
tcttactgacggttcgggggtaactgggcttggagagaaatggaggttgggaaggggcatcacttgcttcctttgggaagctctaaggttgctgcagtcaccttcctcatcttgcaggtgctgaaccaacatcatcagtttctattctaatcg

SEQ ID NO: 622695 - DNA, 921 bp, Homo sapiens
gactccactggctgctctgaaacgccatctttgcgttggtccctcatccgcctccgtggctcgccggagccgtctctgccgagctcctccgtccgaccgccgtggactacctgcgaagcgtaatgatcgcccaggatgtcccttgaactcttcggtgatttttctaatcccctgcatcgggatcgccggctggtgctcgagctactgtttaggagcgcgaactcggtcagcacgccacgctcctgtaacatcgaacatcgattggctcttagtcggatactggaatggatgttgttcggcaagtatgggccttccctgggattgacgtaggcccctgatgagccggaaatggtgaatgaggcagatggtgagcaggaggcttagcagatgacggttccgcgaggtaagagtgaggactggtgggggaggtaataatggaggtgactggcagaaagatgcgtgcgggtgatgacgaggctggggatgaagattgaggagatgtgaagatcgtggtttgaggctgatcgggcagcgtgaatattaggttggtggaataggatctgtgctaatactatgaaagaggtagaccgactgggtgtgagtagaagtgtaaccttgtaacagttatgtgttaaacttcttgtccgccgtggcctatttgcccttcactttctgtgtcacattatctggcggggtcctcctatggtgaggccgctctgcctgtgttgtcattccgccttcttcctcctgtgtctccctctccctgtctggcttgcctttttgacattgcccatcccggccgggttcctggaattttagcgctgtgtatatggtgcgcggggcctggccctaagtcttaccgccgggttggcggcgggcgccccctggacgggggtcgcctccggggcgccatggggccct

SEQ ID NO: 622696 - DNA, 720 bp, Homo sapiens
cttggttatagtttcaggtaaatcacatctcagtggtttgtgatacccacagctcttgaattcatcattactctgaattaagttggtttttggattctcattcactccacaacttaaaaaaagacctgactagttaagtcagtcatgctaaaaaaatttaaatatcaaattttagccaaattattaatttaaaattacatgcttagacaactattattcattggtatttgtccagtggaaatgatacccaattttttttgtgaagatgaagttcattacataaaatcaattttatgtattgaattatgataacagcagtttaaatactacatttgacaaagactaatatggtaaattggaacacatctctgttttaattccctaaatgaaaccttgaagagaattttaataatattttttgaaaaatttacaacaattaaaaaaaatcttttcaatttttgttggaaaaaaacaaagacatttacaagaattatttgtgactgaatatgtcagggattggtgaactatgacctcgtgttaaatctcattattaatagcatagacacatatctaatgaacacaatttgctcattggtacagccggcttgatatgatatatgcgtgatatatatgtatatataacattggatatctgtatatatactacatatggatctatatcaagccttccacaatcactcattattaaattactcatct

SEQ ID NO: 622697 - DNA, 585 bp, Homo sapiens
caccgttccaccagccatgcattccactcgtgactggccaaacgacgagaaaagctacttctagtctctcctgtgatatgagataactttctttctttttttttagataattaacaccattgtatttctcttttcgaatgatggccgatgtcatggttttctacgagagctcgtgtgcttggttagtcccattaacgatccgcttgtgttggtggatgcgtgtgatggtgtgtcatgatcacagtgtcgtgtgtgaaaaccctttggcgactcatcctctcattcccaaacattcagcatccgtgcacactcctcacttccaggttttcaaaagatgggagatttccagtgggggtcctcaggttatcatcccaatggtaacagatcaagcttggttcttcagtttcctcagttcttttgttgcccatgtagcaagggtttaagctttgttagtcttcgatctccgcccttcagttaacaattcatggatcattggcctagcttctactaatttcagtacatccttcccaaatgctgtacataagtcccctattagtccagcagcacaagctactactccatctg

SEQ ID NO: 622698 - DNA, 119 bp, Homo sapiens
ggactacatcactggcgccctgcagatttacacagacatcatctacatctgcataacgtgtgccccaagtaaccaatggaatcacctagagggtgtttaaactctcagaagttctgtag

SEQ ID NO: 622699 - DNA, 116 bp, Homo sapiens
gagggagcgtagagagccttctgtcgggcgtctggaaaggtcaaaccgggggcgaattcaatccacccgaccgacggttagtgcggcgccaggaagcgcctttgtggcgtgcggtc

SEQ ID NO: 622700 - DNA, 117 bp, Homo sapiens
acccccccccccccccctttttttttccaatggggggccccgggggccaaggaaaaaaacccccttctattttcccaattttgggggggggttttaactttttttcccccgggggga

SEQ ID NO: 622701 - DNA, 172 bp, Homo sapiens
aaattttcccaattttttttaattatttttttaaaaaaaggtttaactttttgggggaccattttttaattacccatggggaaatttatatttttccctttgggaaaaaaattattggggaaacatttttttggccttggtacaaaaattttttttgggggaaattttttta

SEQ ID NO: 622702 - DNA, 631 bp, Homo sapiens
aggatacccaggtttcagtaaaaatgggaaaatggcttccttccactcccagcctctaacacctgaggaagtcagcagctgccctgacactctggaattgggggtggggtctgcagggtttaaaaaacaaaataaattatggaggagagagcctgttaataaacatcacagcaaatcactgttacatttctataaaaggccatcgaatagaatcatgcatcatttaagagcatttttgctacccaaacactcttctctccgtaccaccccccgtacacacctcctccccgcaaaattggatgatggattctggaaatgatgagaactttgagcctgtgagggcgccccagcagttccctgaatctgcgtcctcactctgcagatggagccatgtcagccccgccccaggaactcacccgaatggagccgggagtcacatcaactaaaaacaatgtgaatctcaattcagctacgacagactcgctgtcactcagatcccaggacgtccccccagacgctccagagcctgccaatctggcccagaaacagcatgcacccgaggcatccttccagcacccgttcctctccctacacagagcagatcccagcagcaaagccctgcatgtaggcc

SEQ ID NO: 622703 - DNA, 124 bp, Homo sapiens
  misc_feature (36)..(38): n is a, c, g, or t
  misc_feature (95)..(95): n is a, c, g, or t
cgggccaggtctaggggttggccaaaggtccctttnnncttggggaggccccaggagatgggctttgggcttgttaaagagacagcccctttccnctgcacaaatggggcaggtgcaatagtct

SEQ ID NO: 622704 - DNA, 280 bp, Homo sapiens
tgactggagaccttggcaaggagattgagcagaagtacgagtgcggagaagagatcgtgatcacggtgctgtctgccatgactgaggaggcagctgttgcaatcaaggtcatggcaaaataactggctcccagggtgggggtggtgggagcagggatcctctgaacctgatcatgtccccttgcagaggctggcctggctctggcccggtgcttatgtggactcctcctacagaatttatttgacgctatattttggatgtccccacccgcttaacctcg

SEQ ID NO: 622705 - DNA, 292 bp, Homo sapiens
  misc_feature (256)..(256): n is a, c, g, or t
attcggcacagctgggatataaaaagcaatgagtataaaatctgtagtttgatgacattttttcccttaagaaatttatggatgtgttagcagaatatagcatgatctcctgaactctctgtagttaatatttcagtcagtattaggagttgcttcattgaccttgaaaattttcttgttcatggttgggcacagtgactcatgcctgtaatcccagcactttgggaggccgagccaggctgtatcacctgaggtngggaattggagtccagcctgaccaacatggagaaac

SEQ ID NO: 622706 - DNA, 388 bp, Homo sapiens
cccccgtgtacgtggaagtggaggactttatgtttagtgaaataagccagtgaacagagacttacacaccgacagtgtgtcattcatatgtggacacgctatcaaatgctaatctcatggaaatataaagtagaacagaggattcactaaggacaagactctcagtccaatcttgaacattgagatggtcaaagaaaaaactgcagaacacataaaacagatatggcagcgatattttgcagcaaaagatacagtctacgcagttattcctgcagaaaagtatgatttgatctggaaccgggctcagttcctgtccaacagtaagtttctggtgatcaggtaaggggttgcttatcaatgttgccaaagaagtattttccacacgtca

SEQ ID NO: 622707 - DNA, 945 bp, Homo sapiens
cattcgtgatggtgctttcacaatcggctgccgaagaatggcggaggtgcacagtcctgcttgcttgatgttcgaggactatgctccgtggagccgcactggctgagcatgctgtggggtaacagagtacagcttggtcctggtaatggtgggtggaccgatagagcatagtgaataggtgctgtccaaatagttgtctcttggcgcagtgtgtcctagtataatagtcgaatgcttgaagataccctgcgctgtaccttcccgtcgactggcgtgatcgcaacaactctaatcgccttgctcccgatgggcctccttaccaacgttcgctggggcccgcgatgcacagctattctttcgtggcgggaagctgtcgcgaaccgatatagtcgagcccccaagtatttgttccaatttcgacgtggtggagctagttcgtgcgcccggttctcctacaagggggtggtttgacgcgggttttactcaacacgtccatatagagaaagaaagtcacatgccgaacttggttggactccgtgctgaccgctcgagggcgttcgttgacgttcgtggaacgggaaatgacaggataagatagagcccaagtgctagtatgcgccgatagcgttcaacttaggggttgggcgccttggggacattgccgagcttgaatgtgagcaagcgcgagccagggcatgctctccgcatgggtgaagagtaatagctctgtgattccctcttagtccgggagaaggactgtcccagttctcaatcgctggctacgggataaccacggtcgtgaagattagcgtgcgcgcttcgacacttcgaggtctttcccagggggttcctcggaaaccctgcggtgctgctgggctgggggccttgtttactggtaatcctctgcgttgctgccttccgccttgtggctgtcgttggtccccg

SEQ ID NO: 622708 - DNA, 597 bp, Homo sapiens
tgtctcaaaaaacaaaaaaagaaaaaaaaattatttatcacttattattgttgtgtgtctgaatgcaggcacatgtagcagagcatgtggagatcagaagacaacatttaagagttgcttcttgcacttccttcagatgcaagttaatagcagaccgaatctccatctcgccaggaaactactaaagttcctctgggctcaaatagaattttgtaagaacataacggatggagaggagaagacctgtggtggctgtgaagaccctgatgctgtgtatgtgaaatcaacatcttccggtggccatgaatttattgtgaaaagagaacatgcactaacatcagggacaataaaggccatgtggggtggtccaggtcagtttgccaaggatgaaaccaaggaggtcaattttagaagagtccctcacatgtgcatgtgttttacctacaaggtccctatactaacagctccactgagctccactgacattcttgaattcccaactgcactggaactgctgattgccgcaaacttcttagattgttaaataaaattagagagagagagagagagagcgcacctggaaagatggcttagcag

SEQ ID NO: 622709 - DNA, 168 bp, Homo sapiens
  misc_feature (11)..(11): n is a, c, g, or t
  misc_feature (28)..(28): n is a, c, g, or t
  misc_feature (100)..(100): n is a, c, g, or t
gtccgatgctntctcaccggggtcactnggtgcgtgtgtctttggaaacaccatctctcacaatttaggcagaagctgatatcccagaaagactatatangttttttttttttttttttttttttttttttttttttttttttttttttttttttttttttttttttt

SEQ ID NO: 622710 - DNA, 161 bp, Homo sapiens
atttgaatttgtgtgctcctgggcgtactggcgaggactatgtgaagacatatcaagaagatggacatctagaagaccaatgacagagagtcttcagaagaaatcaaccctggccaaaatcctgatacctatcctttcccactcctcacattgtagttata

SEQ ID NO: 622711 - DNA, 285 bp, Homo sapiens
agagtatcccctccccgtccgcccaaatcaaaggattggattacttttttcccccttgtaatgagtttccgagaatgtggtcaattgtatagatggcgtgttatttccaaaacccagctctgccttccttacccattacttggatatttgctacgatccatctccctttgggaggcaaatgttaagagaagaaacttgtatttccagctagagtttactgtcacatcatagatttaacatttaccatctttaaagtacaaattttacatgttctttaaaatgagg

SEQ ID NO: 622712 - DNA, 102 bp, Homo sapiens
cataactattgtgagacacttacgttacatatcatagtgaatggttccccagtgtatataatgttttaagtgtctccaatagtttatgctgtaatagtttat

SEQ ID NO: 622713 - DNA, 390 bp, Homo sapiens
agttgaaaaattcactttaagagtttcataatacattgcaagtattaacagcaaaactggtgaagctgaggaagtaatctcagagcttgaagactggtctccaaaataactaagtcagaaaagatacgatgaaatgataaagaagaatgaacaaaacctctgagaaatatgggattatgtgaaaagaccaaattgatgactcactggtgttatggagagggagagaaagcaagcaacttggaaagcatatttgaagatattatacatgaaaatttccccaatctcactagagaggccaacatttaaattcaggaaatgcaaataacccgtgtaagatactacacaagacgaccatccccaagacaaatagtcctcagatcctccaaggtc

SEQ ID NO: 622714 - DNA, 435 bp, Homo sapiens
caagatggcgagatgttcatgcggacagtgaagctgtacgactattatccaacaccataccccaacagtgatgctgctcgagctgtcaacatcggagcactggcccctgacctcatgtacatcgagctaactatgcatggtggagaggactacatcttctccctgctcacgggctattgcgagccacccaccgacgtgtcactgcgggaaggtctctacttgaacccctactttcctgggcaggccattgacatggcccctaccatctacacagatgtcctagagttggaccatggcaccccatctaccatgtgccagatagacacagatgtgtgcgccttcctgagctgggcatctgagccctagcaccagcattgcacgcatggggctcatgatgttgatgatgatggctctgctggtgcccctgggctaccc

SEQ ID NO: 622715 - DNA, 204 bp, Homo sapiens
ctggtaaactatgctgctacctaaatgctgttactatttattgacatcaaaacgaaacaagctgagtactaaacgttgttatttaacaggaatagacactggtgcagtttccttcctggagaagggtatgcaactcatgatcatggagacctataagatcaaacatcactgtaattgtcatagagtactaaacaaggtactaca

SEQ ID NO: 622716 - DNA, 246 bp, Homo sapiens
aggttcaagaaattctcccgcctcagcctcccgagtagctgggattacaggcacctgccaccgcacccagctaatttttgtatttttagtagagacagggtttcaccatgttggccaggctggtcttgaactcctggcctcaggtgatccacccgcctaagtctcccaaagtgctgggattacaggcatgagccaccacgcctggtcgaggtgcttattttttaagcagtagaaatcctgcttcaa

SEQ ID NO: 622717 - DNA, 128 bp, Homo sapiens
tgtggctccagcacactgactgctttgaccacactcagtgctcaagaacaattagtgtccctacgggcagcaacatcatcagcatacctcttcaaggaggactgccaccagaagatcgatagacctct

SEQ ID NO: 622718 - DNA, 192 bp, Homo sapiens
  misc_feature (93)..(93): n is a, c, g, or t
tgcctcgacaaggcagcagtgactctggcgtaactaatgttggagggacagccacatgagctctgtgtgggcattgggctcctctgactgtcngagaagaggcttgcatcttgggcgcgagaagaggcttgctttgcgttgtgcgcccagccagtgatgctgtcagtagtgccgtgatccctgatggtgatc

SEQ ID NO: 622719 - DNA, 225 bp, Homo sapiens
tagagtatcccgttagagacggatgtgcatggtggaaggtgatttatcggaatgggaggtgatcctaggggattgtttgatcccgtttcgtgcaagaataggagtgtgcagtgctgctagggttgcaataatgaagggtaagatgaagtgaaaggtaaagaatcgtgtgaggttggaattgtctactgagtagcctcctcagattcattgcaacacggtctctca

SEQ ID NO: 622720 - DNA, 568 bp, Homo sapiens
gacatcttccccgacctcttcaaacggggcggcgagcgcctccagtacgtcttcgggtataagctggtggaacttgaacccaagagcaacacttacattcctcaatcaacactcactgaggagcctgtggaggaggatgccgaggatgaggcggtgaccaaggcacgactcctacgtgacgggcctccctgaatagaatcggtcttgaggggcctcaatctgtgtatggacaaggggctaagcatccctattgcaatggcaaagttggaaagcccatgcggacttatctcctggcagggaccggcttataagggggagtgctgactccgcgaccgaaggaagcagtttaagtgtcccggaagatccataagaagagtcgattactggagggactttcggtggcgacaagtcgttccacctgggcaagtcacccggcgcgggattaacccccgaaataccgtgagcactcccggtctgaactgaacggaaatttcgcaaggtcggggggcccccgggcggaaaccacaaagcctggggaaaaacgcaagcccaagggcatcggcacacg

SEQ ID NO: 622721 - DNA, 792 bp, Homo sapiens
ccctcggctccaaggctggatacagggggacccccgcccgcccctatggattctatgccgcggtaaataatatttatgaagagaatttctgtaacggttggttgaagatctctttgatgaagcatgaagagtgcacagataataattgaaagattagtttctcatgggatttatttgccctgatattccagtatttggagaatgtctttaaggagacccctttcctgtgtagaaaatccctttttacatacttgttatatccccgggagattagtttataccttccccctcaggccgtcatcagctgctttagagaatgggatcccccctgccccttcccttttttggttcctggggctccattcacagtctggtccagtctccctggctggggattctgtcctgggaacagatactccagttgtagtctcatagtgtctgcactcaccccagactctatatacttgcttgctcagagcatagattagggccagctccttaaaatagccattcagccagaagactggaaaacttccattgcttcatttgtattgccaatagaaaatggtagataattatatattatacgcccttgtgtaagttccatttaataacttgaagccgtctttgtttccaaagagtatgcccctactgagaaaggatatgtgaacggtaccatttattgttggggagagtggattgtttacatcaagtctggacttttgtctagttgggtagaccagttttacacccgccagcccccctttattaagaagtttacacaccagacca

SEQ ID NO: 622722 - DNA, 303 bp, Homo sapiens
cccgggaatcgcacggagtggaatggaatggaatggaatggaatcaacccgattgcaatggaatggagtggaatggaatggaacggaatggaaacaacccgaatggaatggaaggtaatggagtgtaagggaattgaatagattcaatccgaatgtaatggaatggaatggaacggaatggaatggaatggaacggaatagaatggaatccacccgagtgcaggggaattgaatggaatggaatgcaatggaatggaatcatacggaatggaatggaatggaatggaatggaatggaacggaa

SEQ ID NO: 622723 - DNA, 192 bp, Homo sapiens
  misc_feature (79)..(80): n is a, c, g, or t
  misc_feature (100)..(100): n is a, c, g, or t
  misc_feature (103)..(103): n is a, c, g, or t
  misc_feature (108)..(108): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (141)..(141): n is a, c, g, or t
tatcacacggatgatctgcacaatggccaggatgagcgcgccaaaggccagggagcctgtgtggtacctgagcgcccgnncaaaggcagagaagagcggnaangcctnctggcngtnttncttgcgcagggcccagtagtnggaggttttttttcccgccagcgtgacctggcccagcgccagcacgaagtt

SEQ ID NO: 622724 - DNA, 293 bp, Homo sapiens
gggacgggaggccatcatcgtcactctggggacggctcatccatccgttcactctggggacggctcatccatccgttcactctggggacggctcttgcatctgtcctgcctacctcccacccatcaaggcaaaatctagcccagatgcggtgactcacacctgtcatcccagcactttgggaggccgaggtgggcagatcacctgaggtcaggagtcccagcctggccaacatggagaaaccccgtctctaccaaaaatacaaaaattagccgggcgtggtggtgaacccctg

SEQ ID NO: 622725 - DNA, 466 bp, Homo sapiens
  misc_feature (12)..(12): n is a, c, g, or t
  misc_feature (18)..(18): n is a, c, g, or t
  misc_feature (66)..(66): n is a, c, g, or t
  misc_feature (69)..(70): n is a, c, g, or t
  misc_feature (72)..(73): n is a, c, g, or t
  misc_feature (75)..(77): n is a, c, g, or t
  misc_feature (79)..(83): n is a, c, g, or t
  misc_feature (85)..(85): n is a, c, g, or t
  misc_feature (92)..(92): n is a, c, g, or t
  misc_feature (95)..(96): n is a, c, g, or t
  misc_feature (100)..(100): n is a, c, g, or t
  misc_feature (102)..(102): n is a, c, g, or t
  misc_feature (110)..(110): n is a, c, g, or t
  misc_feature (113)..(113): n is a, c, g, or t
  misc_feature (120)..(120): n is a, c, g, or t
  misc_feature (122)..(122): n is a, c, g, or t
  misc_feature (124)..(125): n is a, c, g, or t
  misc_feature (133)..(135): n is a, c, g, or t
  misc_feature (177)..(177): n is a, c, g, or t
  misc_feature (186)..(186): n is a, c, g, or t
  misc_feature (211)..(211): n is a, c, g, or t
  misc_feature (433)..(433): n is a, c, g, or t
ctcagacctgcngcggancgcggcgcccgctccaatcggctcggggctgtgccccgggacccggcnacnngnncnnncnnnnncncttcccnccnncctncncccctccncantcccagntntnnatccatcnnntaccctcaacccatctccccctccaccccacccaccccatcncccacctcncctcccccaccctcaccacccaccnccactcaacacacccctccctccactccaaacatctcccccctcctcaccctcctcctcccctccctccctccctccccctccatcccccctctcccacccccaccccccccctccccaccctccccccaacacccaccccctcctctcctccccactccaaccacccccctctccaaccacttctttctcattcaccaatatcctcctcaacaccctcttntcattcccaacctccactcccatcttcaccccc

SEQ ID NO: 622726 - DNA, 287 bp, Homo sapiens
gcacatggctgtcaaacatgcatcagaaagcaaacctgacggccacacaatcaaaaaaggtgagggaggagatagagctggccgccatgaagctctcaacacacataggaggcaagtgatggctggcttcaaaaccctgggtcaaactcgctccaaaggcacagttcaccagcataggattttctccctgccccaaactcaaatgctcaggaggcagccaaccctgcacaaatgaccactaatatctcagcaaagatacaggcacctcactgccatgtgctcattag

SEQ ID NO: 622727 - DNA, 668 bp, Homo sapiens
  misc_feature (319)..(319): n is a, c, g, or t
ggttgggatggtggggtgggtttaggtaatgtgctagtttatgattgcagataaatcatgccagagaacttaaagtcttagaatgaaaccgtaaagaaatatcaacttccaagttgcaagtaactcccaagtgatttagtttttttccccccagttgtgaatgcggaagctcggggaagttacactactgagccactgcttgtacccattgcattactctttgggcaaggaaagtgtcataattggatactgtatctgttttccttcaaagtatagagctttgtgggaaggacaagtattgaacctggggtttgtctgncctatctgggtcttgacattaccctacaattatgggacatgccaaacgttgtgtcgtgactactggtagtgtgttggttctcttttgcaattttttcacaggtgatttacctaataatttaaaattatatagaacatgcagagcaagggacagtgggttaatgatcctgaagggattcttctgatggtagctttgtatcatcacgtaagatctatttcagtcgtgtgtaagcaagtttttaaagtgtaggcgaaatacttttccatgtgtttacttgcaaacccagatgtacggtatgcttcaaaaacttcttgtaattgtttattttaaccttatctgtcggtaactg

SEQ ID NO: 622728 - DNA, 201 bp, Homo sapiens
caaacatgaggttaagacaacttggtgttgcaaaaaattttggagtattgtcagacaattttaaaggcaaaagaattgttcttgtaaatgattcaattgtcagaggcaataccatctcacctataataaaagtgctcaaagaatctggtgcaaaagaggtacacattcgagtagcttcaccaccaattaaatatccatgct

SEQ ID NO: 622729 - DNA, 712 bp, Homo sapiens
ttttttgccgcagacctcatttaggcgagaactgcgagaatcagtcgatgacggccaccaagatgtaccgattgctcaaggacatgaggatcacattactgatggataacaatctcttctccctgcccatgaatgaatcaacgtgcattgctaacatgctactaacctctataaatcatgcacgattgatgatcatgccagtgcataagtcgagccgcagctaccagcagaccaggaccaagtcatccacgtgctatcagatacaacaacgttacacgtgacactacatacacatgggcagcacgatacaggacgtcgacatttctctacacaatgatcttggccaagtgctacattgatcatgctcgcatagatatactacagcctacatgatgtatcgcctgccactagcccatgcatgattgcgagccactacagttattacgctgctacgtatcagccatccatacattgtaacaggaatagttcaccgaatctgcctacgctgctatcaaacagccccatactaaatgtgcttcacctacccttcaatatactgtcattattgcaaccttagcatggcctaccttgtaatcttccaccccactgcaacaccacccttagatcttcccatcaatctcgacttcatcatctcccactactacctatccactcgcactcccttcacttcctctcgtcctttccttcctcg

SEQ ID NO: 622730 - DNA, 339 bp, Homo sapiens
  misc_feature (8)..(8): n is a, c, g, or t
aggatctntattaacgccccaaactcatcattaagctgtgaccctgggtctcgaccccggcctgtgcaactgggtcctggacattgacgggccacccccaagtggtgaaggtaggaaacaacatctccatcctgctgatcctcaacactggagccccacaagggtgcgttctcagccctctcctgtactccgtgttcacccatgactgcatggccatgcacacttccaattcaatcatcaagtttgcagacgatactacagtggtaggcttgattaccaacaacgacgacacagtctacagggaggaggtgagggccctcggagtttggggcgttaaga

SEQ ID NO: 622731 - DNA, 763 bp, Homo sapiens
ggggcggactcggagaagagcacggtggtggaaggcggtgaagtgcgcttcaatggcaagggtaaaataagatccgtaaacccaggacgatttattccagtttgcagttgcaggctttgaacccggacggttccagctaaactcagtacctagctctgccggcagatggtcggagcatcgcggcctctttagggactcagcacagactcacggtcaacgatctggttccaaaacaacgcgtatccaagttcaagaagctgatcgaacgcaggttgggcctgctactggagggtagtgcgttggccaacagcgtcgggccactgtctgctaggcatcctccacaccgatgccgctccggcctggaaccctaactcttcatccgggaagaggctacatgcgaggaaatcgctgggctccctatatccccagctacacatcgtggtacccttctagcgcaccaagtaagctatgctagctaccccaaattatgtgaggttgcccgcccgtctccttcgagtctccccggacccaggtccctcccgccatccaggtccatccatcccgtccggaaaagacggacccagagggaagaaggaacagtggaggcgggacgccctccatctcctcggagccccgcgaggtccggcccagcaacttcccggcatccgcgctctagcctgcacctggcctcgggccgagcagtcgtcagcagagaatggcctcggagggaagccactgccaccaatacagccgcagcagcaaa

SEQ ID NO: 622732 - DNA, 714 bp, Homo sapiens
  misc_feature (10)..(10): n is a, c, g, or t
  misc_feature (17)..(17): n is a, c, g, or t
  misc_feature (73)..(73): n is a, c, g, or t
  misc_feature (127)..(127): n is a, c, g, or t
  misc_feature (147)..(147): n is a, c, g, or t
  misc_feature (168)..(168): n is a, c, g, or t
  misc_feature (172)..(172): n is a, c, g, or t
  misc_feature (227)..(227): n is a, c, g, or t
  misc_feature (232)..(232): n is a, c, g, or t
  misc_feature (302)..(302): n is a, c, g, or t
  misc_feature (367)..(367): n is a, c, g, or t
  misc_feature (412)..(412): n is a, c, g, or t
  misc_feature (442)..(442): n is a, c, g, or t
  misc_feature (475)..(475): n is a, c, g, or t
  misc_feature (609)..(609): n is a, c, g, or t
  misc_feature (636)..(636): n is a, c, g, or t
  misc_feature (648)..(648): n is a, c, g, or t
  misc_feature (678)..(678): n is a, c, g, or t
gatggcggangcgggtncagcttttcgctgattacatttagcccgtttggtaaacttgttcagatttaatatnctttggctgctgtagctggaggagccccgttcgttggaattaaagctgcaaatngtgttgtattagcaacttanaaaaaacagaaattcattttntatnatgagcgaagtgtacacaaagtagaaccaattaccaagcatataggtttggtgtncagtngcatgggccccgattacagagttctttttcacagagctcgaaaactagctcaacaatactattttgtttnccaagaacccatttctacagctcagctggtacagagagtagcttctgttatgcaagaatatactnagttaggtggtgttcgttcatttggagtttctttacttatttttngttggaattagggacgaccatatttatttnagttagatccatcttgagcttactttgcctggnaagctacagcaatgggaaataactatgttaattggaagacttttcttgataaaagatataatgaagatctggaacttgaagatgctatttatacagccatcttaaccctaaaggaaagctttgaagggcaaatnacagaggataacatagaagttggaatntgcaatgaagcnggatttaggaggcttactccaactgaagtnaaggattacttggctgccatagcataacaatgaagt

SEQ ID NO: 622733 - DNA, 144 bp, Homo sapiens
  misc_feature (70)..(70): n is a, c, g, or t
caagacgagaggacgaggtaggagggctcacagatacccgaacttcaaggatttactactaatctacagntaatgagagacatgctgtggtcatcggatcaagtggaacatggatacaagagcccagcaaataccactcaactg

SEQ ID NO: 622734 - DNA, 144 bp, Homo sapiens
tgtgttaatgacccgctcagaactgctgagatcaatgggaattacaatgcgaaaagccgagatggacggaccttctaagatgtgccagcttcctggggtctcactgcatgcagagcgctgaggcccagagcacaatcatgcagc

SEQ ID NO: 622735 - DNA, 902 bp, Homo sapiens
agtggagacacgtcacgggttcttttcctgaggttagcacaggctggcggagctggaatgggctgcagaaggggctactggcagtcactctagtccccccgcgttgccttgcccagccgcctcagtctgtgcatttctctgggctatagaagacaaaagagagcagatgctaggctgccaagtgatctggagaggacagtcttgtgggaggagtgtgtggaggggtgtttatgctgttgcttgaagcctctagcaacggtgggaagtgccttttaggggctaggtgtccacagagatgctgagaaatgctcgagactggtctccatgaggctggcgtgcttcgacacaagcactcacttacatttgctatggagccaggatcactgtgacctgcccattcgttccccatgcgatccagggctagaggtggagaaggggcgcgatctgtacttccctgagaggtacagggatatgtgggacggaggacaagactgatgggcgcagtgcaagagggcagagagcaaagggcatgaacagttgccactgtgacatcgcatgcatgctagagggaaacagtaactacacgctacgtacaacgttaccatatccaagcgcgtagggggaacgctcgggcaaagtggttcgcgccggtgggccctcttacgaaataggcaacgaccagcggtcgttggagccaaaggagaattaccaagccaaagcagcgaggagtacttttgtgtacacgggcgacggcgctctggggtaggaacacacagtcttaccacacaggcacaaagctagcttcccctccctgtggaacaccccccttgcctttacagcgggaacaataagcaattccgctcactctaccatttttgcacacatcggagcgggcacacgaa

SEQ ID NO: 622736 - DNA, 712 bp, Homo sapiens
agaccctgtcccactcactctttcccctgtccgtctcctgccggcaggctccaaccatgggaggccgcgtctattctcgcattctgtgtctaggctgactctgccgggagctgaaacccaggactccagggactgtgacccggtggtgccctcagaactcctcgtgtgtcaattgccaccgcgctgtcgctgcgaatccatgggttcagctctttttctgagatcatcagccaccccgacggagacttgtgacggacgtcaacggagtgtgcaactaccgtgcgaaagtgtcatgcgggaaaattctcggactggcgtggaacacagaggggagctacgactgcgtgtgcagcccgggatgatgacgcctgtattctggtgggcaaagaatcattcgaaggaatggagatgcagaggaacaacctgttgccaagatgtgcgaccgtagtgcgagtctactcgggcagcagtcatgtggtgacatgcgtccgatccagttcgtgcttcatacaccgtgcggttgcatacgaggctgccgctgcggcgctccaggctggaagcccagacacggaatcccgaataagccataaggtacgctgtctgtgaatgatatgactgttctccagctggacccgccccctggagtccacaggcagacgctttcccgattcttcgacaaaagtccaggacctggggcagagactccaatgaa

SEQ ID NO: 622737 - DNA, 212 bp, Homo sapiens
cttttttaatgtaacttaacattttcttgaacagaaacttttacaccactgtctattatttacctattgagacaaatatactaacacaagtaatatgggcttcacaatttatacacaaacctattagagtgcattatataattaaattttgattgccttcttttattattatcactactactgtctgctcacaatttctgtgcccatttcaa

SEQ ID NO: 622738 - DNA, 312 bp, Homo sapiens
tgtagacaactagggtcagtttgcaggtgtaagccatttaccaagatagttgtaggtaaagaagggcagatttattggagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 622739 - DNA, 112 bp, Homo sapiens
ggtatcatcatagccaagaaggtcgccttcttatagtcagaacctcctctagcttggtaatctttacgaaattctcatgcttcctgcttcgtgccccccagtgtcttgtgtg

SEQ ID NO: 622740 - DNA, 482 bp, Homo sapiens
atacgctcagcagtgtatagcaacagacagagaaccatgagcacatagagacaacaaagggaagcaacggagggagaaggcagggaaagtaggatgtaagagccgagaagcatagaagactgtgaaggacaaggccagcccacagggagagcgtatcacaacaggtatgaaacagagaggcaactgtgcgtaatcagtcagaataaggggtatgacgtggcttatgaagaccaacagatgactcagaagcaccacaggtatacgcgaagtaggagccaccaaacaaggcatagacatgataataaaaagggcagtgatgaagagagtgagcataggaggtgaggaccaaggctgggatattgagacagcctcaatgggtatccatatgtctctctagctcactgtgtatatctctctctctactctctctctctctctctctctctctctctctctctctctctctctctctctctctctct

SEQ ID NO: 622741 - DNA, 465 bp, Homo sapiens
  misc_feature (47)..(48): n is a, c, g, or t
  misc_feature (241)..(241): n is a, c, g, or t
gccctcaaaatgaactgttatgctctgcatacgtctcctgagaatcnnctttgagaccatgtgccgagccagacaaaccttgtggacctggaccttggttgggaacgggtaagacaagctctgtgaccaaggcagccccatggcttttgactcggtgaacgacagcagcatggcaaccccaagttcttcatgcttttaacacatgctacttcagtttggcacatcctgtcgaccctgttgnggaaaaaccaacatcaaagtaatcttgacacgcaacgacatctgtggtccaagttttggcggttcactttgtgccttggttgcataaccgtgccctttcttgggaagcaatcctcagcacattaagtcgaccagagagaacccgcgccacaactctggcgaagccgagtaagcacgaccgtgcctttgcgttgggtaaggcacaatttgaaaaccccccctgtt

SEQ ID NO: 622742 - DNA, 832 bp, Homo sapiens
cgagccctcactccccaaactctcgccaggtggcggcgtcggcggcggcgggcgatcggcggggcaagtccacggcgtccgtgcaccgggcaggcacacgggagctgccggagcagctgccgaccgataggccgaccgtctggtcaagctgttcttaggatgaggtcctccaggactaacgggagcgtgcagaaggcggggagagttagccatgcccagggagaagggccgagctgggttcttgtcgcaggaggagttcttctgagcactctttcagtcagatttgggtgcaagctgaagcaaatgtttgatacgaagaagcaaaatagcacctccagagccaaaagaaggcatggatcttgtgaactgcactcgaatctgtaccgttttgatgatgaaaccaattgctactgctgtgtctcagatggtggagtggaaatcaagcaagcacctgcaagttctttatcgaaacctgatgaaccctcccttcctcttgcaaagataccagggccagaatcaagcaaagagaacagtggcgtcatgtggacgtcatcgcctgaccggcttgaagatcatcgcagaccattgcagtactcaaacagttctggctctccctgtgtttcagaatcaggatctgacatttatatcaagagagaggtcatacagaagttgagacagcacctcaggagacgtgatgagatgatcatggagatgcaagcacagatagcagatcttaagaactctctcagcatcgaggagacgcaggccgccaaattgcagtcccagcttggatggtgccaatcgagatctgttcgaatccgagagggagatc

SEQ ID NO: 622743 - DNA, 497 bp, Homo sapiens
  misc_feature (1)..(1): n is a, c, g, or t
  misc_feature (73)..(73): n is a, c, g, or t
naggatccccgggcagtacgcgatgtgatcttgcccaaggcctcaacacgctcttgttttcatcgtctggagnctgtcctgcctgctcgacaggccgcgtggatgcgtttcgagcgccgttcctccttcgtggtctggtctgtgatcgtgctgggcctgccctatgttgctgggtctgcccaccttgatgttcctgccccccagacatcaccgagttcatctgctccaaggccatctgtgcagcttcggggacctcatactccacgaaggcaaagcccttgtgcttcatggtgacggagtcccaggacatgtcgatgctcttgatggggccaaagggggcaaaggcctggcggatggtgtcctcccccagctcatagtagatagagcccacgtagacgcggcatatgatggccagcgcccgctgccgctgagccgccatcgattgcaaaggtgagagaggatctccaaagcccattgtcactgctgccatctgcagg

SEQ ID NO: 622744 - DNA, 364 bp, Homo sapiens
tgcgtctttcaactgcggttgaagatccgtgaggtgccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagaaccgcatt

SEQ ID NO: 622745 - DNA, 1249 bp, Homo sapiens
  misc_feature (356)..(356): n is a, c, g, or t
  misc_feature (474)..(474): n is a, c, g, or t
  misc_feature (527)..(527): n is a, c, g, or t
  misc_feature (767)..(767): n is a, c, g, or t
gagaagtattacattgaattgtatataacatctagacagcagtgcgaactagcttattattgatgctcctatggatatttccacgcgttttaatgccctgagatcagacaagaatactaccccgtatgtgtatctacaagactcgatatgcacacctatgcatggcaactccacatggctgaaacactggtgactccttccctccgagcacatccctgatcccttgtgtctgtgctgtgtgactaacaggaagagtaacgtatgccagtatgagtcgtacattcttaccctcatagtatcctcttgcattgacttcatctatcgccccttttccctaggtcgcaattgcttcccancatgtgtgctgcttgttcatctcaatcattttatctttcctacatagggaatgacacattatcactatatatcagctttctttgatattcgatcaagagtcatgtccaatggtcgtanctaataaagacatcagacgctctccatattaataaatcaaaacctagtttcanttctaaacaaaacacattgattaaataaagacatggtacacaccatggcgcggcgcgcgcgcgctccctgaaagcgcacactctccctctaaagaggggcgcgcctccaaataatttatctaagaagcgtaacccctggaactttcctttatggtctcatacaagagatggggcctcgcgaaaatagcgcgaggcggtcccgatcattttatttaccgaatcgttagagcgcccttgtgnagtccgggccggagtatataaacaaccagctgatccttcgaacgtggtgcagaaaacacttcgttcccacataacttggagggcatcccttttgtggttgcaatggagacacctcttctaactattgaccggggtgagggatattgttagacacacaaatatttggggaccaaattcgcttaaccctctttcaccaggaaagccaattttcataaaaagtccccactcaagagggggttgaagactctaatacaacatcctttcccccgaaagggaggctgaccaaaacgggggtgcttcaaggaaaaatctgacgtccttgggaaaactgatcattgcgctccgagcagttgcccgttttgacaagcaaagtttccttgggacgtaacactgagagaaaatttgaacggtgaacctcatcattgcgccacaccaacactttaagttcaagcccgcggagagagctacacggatgtatcaaa

SEQ ID NO: 622746 - DNA, 295 bp, Homo sapiens
aacgagatctcctgcctcagcatcccaagtagacttaggaatacaggcacccaccagaacacctgactaataaaaagtatatcttagtaaaaacaggattacactatatcggccaggatgttctctaactcctgacctcgtgatccaaccacctagacctcccaatactatttgcttacaagctcctgcttcctggtttaccttccctgagcactgctgcctccctcccagcatttgccagggactgtcattgccttcgtttattttttctagtttagagtcagcgactagatac

SEQ ID NO: 622747 - DNA, 446 bp, Homo sapiens
aagagtaaattgtcaggtgtagaaagaggcacaagttaatgttgttaaaaaaaaattaaacatctgctaaccaagtgctgctttaatgaaacccccttaagaccgaaaaaggggccttgaaacacccattgagaaccagccacccggagctcagtttctgctacagagcacctcctcttcaacgaatcactggataccattggagagcaagtcactgttgttgaagcagcagagctggaggtgctgtcaagagtctcagcagactcattggccagatgcaccgaactcaatgaggcacttagagatgagaaacgatctgtactgggattcccagcagaagagacattggtttttgtcatcctgaagttgccactccaccaccagttttatagagggatattcgcttttcactggtagtttattcaggtagctataggtcttgtctt

SEQ ID NO: 622748 - DNA, 641 bp, Homo sapiens
  misc_feature (96)..(96): n is a, c, g, or t
  misc_feature (104)..(104): n is a, c, g, or t
gccgtccgggatcggcgcgcgggcgctctaggaccccgcgtccgccgctctcctcccctcccgagccgcgaacttttccggaggcgggggctcggntgcgctgngtccgggtcgcgggcctgattgcgccgtttcccgcgcagagctcgcggcgcccgacgggccccggagcagcggcccccggccggccggcctcagcctggagctccagctacccacatgcaaccttacctgggttccgcccggtccctgagtccccactaaaatggctgatggaggaagccccttcttaggtcggagggactttgtctacccttcctcaaccgagacctagtgcctctaacggagggggcagcccagccaggaggggacagagacagaaaggtaacggagggggacccaggttgtgcggcgagaaccctgagagttaggtacccacaatggactgcccaatacatgaggacttcgtgcaccaacaccgtccccaaccttgcagcagaagcccaactcatgtcaaattttacccgtggacatcaaaagaaaaagtgcccgccaggcatcaaaggtatgaccattccagagatacaagtcacccccaaagaagactgaattctgaaacaagggtaaactggcctcaatcc

SEQ ID NO: 622749 - DNA, 329 bp, Homo sapiens
ctaatctcatgcttaacagtctcaccggaccggccaccatgctgtccaccagctttcacaggcctaaaaccagcacgacctttcttgagagcccccagatcgagaataattcctgggtgcgagacataccggcggtacctgcagcattcctggtaataaatggccttggtgggagggtgcccccaagaccctggtggcgaagaaacttggttaacccctcaccggtccaatttggatctttttggggaggaattccatattgggggttcccgattcttccaaggttgatggcattaagaatattaaccggaccaatggcattaccctta

SEQ ID NO: 622750 - DNA, 388 bp, Homo sapiens
ctctagcaggatcccccatctttcagcagtttatccattcttttgatttcatcaagttggatgtaattctttgtacacatctgtgaaggggacactgtaacaacccattgaggcctactgtgaaaaactgatatccccagattaaaactaagaataagctattctgtgaaactgcattgtgatgtgtggattcatctcacagagttaaaccttggttttgattcagcaggttggaaacactcttcttgtagtatctgtgagtggacatttgggagcttattgaggcctatggttaaaaaccaaatattcacagatgataactggaaaaaagctatctgtgatactgctttctgatgtgtggattaatatcacggagttatatctttct

SEQ ID NO: 622751 - DNA, 410 bp, Homo sapiens
agaatgttgaacccgggaggtggagctgcggtgagctgagatcctgccatgcactccagcctgggcaacatgagcgaaactccgtctcaaaaaaaaaaaagaaaaggcggacagaggccagaggggaccatcatctacagccaattccacgggtcagatggctggagttttcatccaaactctgatacttattaccgggccagaattggtaaacttcccctactcaatcaagtcccccaaatatatggtggcttacgtaagggatagtgcctaaccggaaaatcggggatccatcctatatcccttctccatccacacactacatctaatcagacaccaggtctaacggggtatggggatcaaaatcaagtcctatggatcttatcttttaaaaaataactattcttccg

SEQ ID NO: 622752 - DNA, 872 bp, Homo sapiens
  misc_feature (581)..(581): n is a, c, g, or t
ataacctaccaaaaggaaactagaggcttcttggtgaagagcattttgtgaagtgggttctgcaaggagcctataaagccaagggtggtgtccatttctgggaatggttaaacacaaaaggctgatagctggtatcacatagttggagtcagtgcataattccaagtggcttttttttttttgggcacggggactgatcaggaagatatattcctgcataactcaatctgaaccagggatggtagttaagtttccctccttgccttcccttctggtgtgaccgaccccttgggccaaaaaaaaaacaaaaagcaaaaaacaaaaacctacccggttcgggtttttttcctccctttagtttccacccccaaccccaattcccgtggtgtccttcttagagatgaagaaataatagggaaacatctttcatagccacattaattaagagaacacggatatacattattttttccttttaaaagatgacttataagaacccctgaaatttatatagaggtgagacattagaattaaaaagatcttcagccaggccttcctgagaggagtaatcctgctaaaangggtcttagtggtctgaaaagccagttctggaacctcttcacaacagttctcaacactggcttctcccggttcatttatgcgtgcgagaagtcagtggtaactgctgcagggcttaatacattagtggtaacggtctttaaaaaacaaacaactgtagccctgtgtgtgcccactgttggctctcaacagtatatcctaataagcctcacctattttaacccatgacgttctaattctaactctcattcccctccttccttcccctacctttttaccttttttccttaaaa

SEQ ID NO: 622753 - DNA, 384 bp, Homo sapiens
ttttttttttgaatacaagatattttaaatgcaactaaaactgttttgcaaaatgcttacaacttaaaacacataattcttctatgaagacactgtgtactaaaaataagaaaaaaattgacttgctggatttgttaaaatgttgatgagcagattataaaaatttaatttttagaaaatatcttgtctttaaaaagaaacagcagctgctgctgttaaacataatatgaaacatttttaaaaatcacatttaaaaatgtacaactcttataaccttaaagaaagactctccaaaaccaagatgctacagtaaaatttactaactggcaaagatgatgttagtaattccaaagatactaggtttttggacttaagtacaatttc

SEQ ID NO: 622754 - DNA, 232 bp, Homo sapiens
attctgaattaagcacagagttgaagtttatacccgtttcacatgcttttcaggaatgtcgcaattactaagaagcagataatggtgtttttagaacctcattgagtatatcacccaatactttaatgtataacataaatattatacaatatccttgtatagcagtctgcttcacattgatttctcaaattaatattatattagagactatatatgcatacgtatgcacgcg

SEQ ID NO: 622755 - DNA, 593 bp, Homo sapiens
aacatgaattaggatatcctagtgagttacctacatgacaaaactcccccataatataagaaaataaataagatggtaccataagtaatttccaaaaaaccaacatattgccgatctcacggatattaaccaaccactcgctttccctgtggctttgacacacagacttagtagtctagggtcctctaaccacaactgcctgctcgcctcctccgtgtagtttccaaagccaatgctgctgctaccttcatcaccaaattagactctgtccttcctgaaatcctttttcctagcttcatcaccaaaacaatagcgctctttccttcttcctagcttccttcatcaaatccgactaggtcctgaactcttttcctaatctcaccacaaacttgtgttactcagttgctccacagtcctagcttcatcaaacattggttccttgaatcttatctgctagctgcttcctagattcacttgaatccacttttatatagcacctaggtcagctatcaattaatagtagtcctcaggatttaaaaattatttaactcaagtccattcacacccttagtttgtatactctatcttaatac

SEQ ID NO: 622756 - DNA, 218 bp, Homo sapiens
  misc_feature (18)..(18): n is a, c, g, or t
gcctccatgctacaactntgcctctatgagtctattaacagatgaatggatatagaaaatacggcgtacatatgcaatggaatattattcaggcataaaaaaagaaggaaaccctgccgtttgcagcaagatggatgaacctgcaggacattgtgctaagtgaaataagccaaacactgaagcttctctagattgatgtccctcccaccgtgcatccc

SEQ ID NO: 622757 - DNA, 89 bp, Homo sapiens
  misc_feature (25)..(25): n is a, c, g, or t
  misc_feature (66)..(66): n is a, c, g, or t
ctttttttttccggacctggccgancaggaggcgccattatgggagtggacatccgccataacaangaccgaaaggttcggcgcaagga

SEQ ID NO: 622758 - DNA, 365 bp, Homo sapiens
gcattcgagcagttgtgcacatctgtctagcctgcaggaggcgctgaggtcgtgcgcgtctctggggaggaaggctgtgcccattgcctggtgctgtactggcacaaattgtgtagggtgtccttggcctatgctagctcaggccctcagtcgccggtcacctggtgggcctgcccgtcggagggctggttggctgactggatgagcatgggctgggcgaggtcgtggaccgcagggatggtgacttgctggatctgggtagagctgctagtccatctgtgaagtgggtgaactgctgctgtacttgtaggacctctgtctgtgtaatctgttgagcattggtggcaagtgtctggatctgtacc

SEQ ID NO: 622759 - DNA, 826 bp, Homo sapiens
  misc_feature (826)..(826): n is a, c, g, or t
gaggtgctgctcctgaaattggtctctgagccatgttttcccatagacactcaggtccctccagctactgaggtgtgcaccatggcggtgaagtaagagtgccactatctgacagggatccttttggccagggggaatgacatgcctagtgtgctcaaggatggacaccagctgcattgcgctggacatatcgtcgtttgactaaagttcctgtgccgaacattcctgtggtggtagatgccgccaaagactccattcggtgcggacctccacagggagggtgcacttattaatgaaccgtcattctgggccattgaactctctggcattctcgcctgtgtcacagagatggcttttacaactcaccttatggggtccacatgaagacctttctgttgcgacgctaaggaacgaacacagtatcgctgttgcagactaaggttgcactcactgcgggcgcagggaatcctcccaaagttgctaatggggggtgcttatcaaaggcacattgtggagtcaatgcagtatcagacacacggtgcgaggtgatcacaggggcacccaggtacttgggcctagaactgcacctcgctttacactccgttggtatcgtacacattgcaaacacatagtgtctactctgcgtgactgggcaacgctgtttttcccccctaaagggggcgatggattgtctaccattagcccgttagagtctctggccacagtgattgaccccaacagttttggcctaacgaatgtttgccgtatggacccggtgcatacaagggggctactccataagttattcggatggagaaattcactn

SEQ ID NO: 622760 - DNA, 747 bp, Homo sapiens
  misc_feature (324)..(324): n is a, c, g, or t
atttgggccgaggagagaaccgggcgccgagcgctagcagtcactgagccacctaactggctctggagtctacggccgcacctgtggtctgcgacagtcctctggttggagacaccttactaaacctagaggactatacgtcctgtaggactctctgcgaatatattggttgtgcgcccagacatgaagtcccctggggaaacaatagaagacatcattcgcgaaggaatcgtatagagtctcctgtgagggccctgtggctccaattattggagtaacacgatcataacgtataatcttctacacgacacacggatatcatgnggagcagcagtgtttacgtgtcagaggcggataactgctcagtcgctagtgagggcgtccgcgccagtgtgacgccggtacaggtgctgtgtggtacaccatacgctttgctgagagttctctgtacctgggagtctgcacgggaacagacatacgagagtgtgtgggggggtacaagcacgtgcgcgcatgtgttaccccagacagtgagttaacacgagacgcgtacgctctcgcagcatgtacccaggagctggttgtcgagacaagtcatctgtggtaatgacctgagagtcatcagtcattatgagtcttcggatggtggggagcagaactagggcacaactggatattttcgatcacagccgctaggtgccatatagtgtgggtaggactggctcactttggacggattacaccggt

SEQ ID NO: 622761 - DNA, 171 bp, Homo sapiens
aatctcaaacaatacacgataattctttgaaaaaagtggaatgtagactcactctgattacttagcactccttacaacctgggtcaggtaatcccaccttgtgtattccactttctttctacacaatataagaactgtatcagtcttgacctggaagaaaatgcaggaaaa

SEQ ID NO: 622762 - DNA, 1280 bp, Homo sapiens
  misc_feature (615)..(615): n is a, c, g, or t
agcggatatagagtccgggactggtcggcggcgtgagccgggggacggcgacagtgggtcggcgtggccgcaggagggggtcatgggtaaagactactaccagactgttgggcctggccctgctggcgcgtcggacgaggagatcaatgcgggcctacctgactgccaggcgctgcgctacaacccggacaagaacaatggagcccggctgccgaggcagaagtccaaggggagatcggctgaatggcctaacgaaggttgctcagcggaccccggcgacaaagcggcggagaatctatcggagcggactaagcgagggcaggcaagggccttaaaaggggtggaagtggagccccaagtatgggcgggaaacgcagggccagagagggttcgcccaaaatgggatagcactatcttatcagacataaccgactagtttcccaagtggggcataaccccccttacaattggccaaagtggtttatgggcgatgaaaggtccactacacggagatggggccaagaaaatactcgcctttttagaacaggccgattatcactatgggggcgccaagctagtgtaaaacgggaggcgaagtgaaaaggtgctagtttngcaaatcgacttgtggcagtggaaccacccaaattttcctcgttgggacgtatgatccccacgcttaaggtgggggtccattttgggagtatgggacatattcacagcccgagagagcgggtgtgaaaaccgtttagtggggcgaccccgggcatcacaccaggcatatcagttgggcagccacataaagtaaagacccgtcgggtccgccagtgcatatagcgaacagggcctaagtgagacttccccagccacagtaggtgatagaacgcggaaagcgagaacaccgttggtacagggagggtttgaagtcgaccgctttgggaaaaggggacggatagtccgtaacgcaggactgtggtcatttgataaacctagaggggtaacagggaattgaaagaaatcattcgagccacccagacgaaagggccgggtgcttaaggaaaccccgcctgtagacggggaacaacacgaagggcagattcccgacagagacaggacaggcaacaggacgaagctaaattgggcaacccagacggggatagagcagtgcacaggacaaggggcgaggtggacgacacagcacggaggaaagacgaataaacatgccaagagtgtacccccacaagagggcgacagtgggcagccacagaaggcacctccga

SEQ ID NO: 622763 - DNA, 393 bp, Homo sapiens
  misc_feature (28)..(28): n is a, c, g, or t
  misc_feature (231)..(231): n is a, c, g, or t
  misc_feature (289)..(289): n is a, c, g, or t
  misc_feature (360)..(360): n is a, c, g, or t
ttttttagatgaagtcttgcactgttgnccaggctggagtgcagtggcacaatcttggctcactgcaagctccagctcctgggttcacgccattctcctgcctcagcctcccgagtagctgggactacaggcgcccgccaccacgcccggctaattttttgtatttttagtagagacagggtttcaccatgttagccaggatggtctcgatctcctgacctcgtgatccgnccaccttggcctcccaaaatgctgggattacaggcgtgagccacccaccgtacccggnccatacttggggaatttttactacagctgactgaaattttttaatttgaatcctattttatatatgagggntactaatttcttcctttacaggcaattaaattt

SEQ ID NO: 622764 - DNA, 428 bp, Homo sapiens
catacgatgggtcacatcacaggactctgcagataaactccaggaccacgcctggaactgggcagattcgctgggtggctagacccagaagagagacaacaatcactgaaagttgggctcataggaagccacatccataggaaaaggggcagagtactatatgaagagcacaccccatgggacaaaagaatctgaacagccttcagccctagagcttccctctgacagagcctacccaaatgacacaaccctggtaatatgacaaaacaagacgcttcaacacccccacaaaaaacatactagttcactggcaatggatccaacacaagaagaaatacctgatttacctgaacaagaattcaggaggttagttcttcatcagggaaggcacagagaacggtgaagcccaatgtcaggaaatccaacaa

SEQ ID NO: 622765 - DNA, 574 bp, Homo sapiens
tggaaaacttgaacttttaatatggccagccccttgtaagggtgaaggtgtgttttttacacaaatttataaataatgaaaaatatgcttttagaaaaagaagcagcagcccccttggggggccggctcgaggactcttgggttggagtggcaggtgagcgccctgggcccaggtctgtcagagcccccctaggtcatctgccaggaaggccagcaggtagcggctgacatgtctgtcgatgatgacaggcgaaaaaccgaggacgcgccgggctcccgtggcaggcccttggggctcgtggcggaatagcagttacaggacgcagggccagtcccacagcaaggcccaggcacagccaggaagcctcagtgggctcccctgtttactcagctcgccgctctggttgcccgagtctagctctgtgcaatctgagtcctgcaaacgcgtggcggcttggcgcaggcggctgtgcaggggctgggcatggatatacggggctcggtagaacctccgtggagccccgcctcaccgccccgcttgcaaggtggcccaggaggtccagagcccaacacg

SEQ ID NO: 622766 - DNA, 777 bp, Homo sapiens
gcaggaaggaaggacgcgtgcagaggagcggagaggggtggtcgtggatgagaggagacagtgccggaggactgagggttatgggcttgcagtgcgctgcaggagacgcccatggcggagtcttgtctcgcagacagctctgagcggggagggcctgagcagggaagcattggcgtcctgagctgacttctagtgagcctggtggttcgtgctgctatgtgaggagctcgatggcgagccaacagtcactttgacttcccggcgtgaagttccaagaagaaccaactgtatttggactggggtccaggggagatgctggtatgtgaaacctcacttcaacaaaagaagaaaaatcgagagcatgggtgccaagattgtccctttatctatatcatccgtaaggatgtagatgttgacgtctcagaatcttgagaaaactcttctgatgaagtcccgagtggaatcttccttgggacctccagcagcaattgccgcagacgcagttcgcactgtgcacaaatcctagaagacatctcgattgcgcctcggacgtggagtccacaacttaccggatcagtgcatcagagcaatgtatggagggaaagtgtaccaggttgcaacttggctgcataaaagatccagcccaatgtgacggcacgtccaagagacgagagtatcccatgttggtcagcacggggagctccatctggagacctgtgatgagataccttaacattgaagtggccccaagttggcctcgtctactccattccttaa

SEQ ID NO: 622767 - DNA, 235 bp, Homo sapiens
gcgggatcccgcgatgagatactgggatcaggagacttgtaggggatctcggactgtcgtttacttcttatgctaacgaggacggatccctcgaatgggccacttgtactttggaggcgtctgatgccacctttttagtgctgcgcgctgcgatggcagtgctgcaggacacgcagtgggacgaaggactttgtagacagactggcgccactgccggggagcccaaaaatttcat

SEQ ID NO: 622768 - DNA, 152 bp, Homo sapiens
gcaaactgtatatatcatgcaatggaatattattcatcagaagagatgaagtgatacatgctataacatgaatgaaccttgacaacatgtagagtgagagcagccagtcacacaggaccatatattctatgattccattatagggcgtgccc

SEQ ID NO: 622769 - DNA, 1216 bp, Homo sapiens
  misc_feature (301)..(301): n is a, c, g, or t
  misc_feature (1040)..(1040): n is a, c, g, or t
tccttgattcagacagtcagccgcagtcgttctttggcggtagccagccgaggccatagtcgctcagagacctatggggaaggtgaacgcgatcagggagattccaacgggattgtggtacgtattgtgcgtcgtccatggatccacccagggactgtcttctctcacagctctagagtaaacagtggaatattgttcggccagtcaagtgaccccttcatttgagcgctgcaatcgtatcatggctatatactgattccgaatgatgtattccactccgatgggcgaaacttccagtggncttaccggtgcaagggcgtgaagaacgtggagaggccttgctcgatcaagtgggaaaatcccattcacgcatcattccagggagcgaggatcccgtccagagagatgctagatggtgggcgaatgtctgtgacgtctgaaggtacgatcgcgggcagttcgcagcgtggccgtcgtgtgcaccaccgatgtgagaacggctgaggcgctcattatggcacgggggcgggagcctagacaggggtcaatccatgcttctgaggcacccatctcgactggatggccacacgctatgtatctgtccatcggggtgtgaacccggtggacgcaacgttattgactagacaagcgctccaaaggatcatccatgtaaatagcgctcgctgggatccagtcgaaacgtcgcctatgagacgaacgcgccttggggctcgacaagggtccaatacgctatcggaggcaagcctatccgggttagtcgttggaaaaggggatcgcccaatggaacgcaacgaagattcaccaattgtcgccactccagctttggcccaatgcgcaagggaaagggaaactaggtggtggatggagcccccctacctgtggggaaaaacctttgggttgtggcccgtttgaaattggggtcccggcagcggagggcctttacttccctagggaaaaaccaatttcgattcccccaattgggccgttcataaatcaataggggcgggctatggccgaanagagcggtctgtgtggtgcgcgcaaagtggtgccaagtgaccacctgtgtgcaccctctggggggacccgcgggaagagcgcgtccaccatttgggcgatatttgggccctttttccggtgatgtgtttcccccaccatgtgtgggcacaagcgtgttgtatccaggagtgggggg

SEQ ID NO: 622770 - DNA, 443 bp, Homo sapiens
  misc_feature (68)..(68): n is a, c, g, or t
  misc_feature (93)..(93): n is a, c, g, or t
  misc_feature (373)..(373): n is a, c, g, or t
  misc_feature (418)..(418): n is a, c, g, or t
  misc_feature (429)..(429): n is a, c, g, or t
cgccctcaacgtcctgctcgatgagctgcttgccgtcgtcggtcagatacaggtcgccgttgcggaanggcctagtactttgtggcgcagaancaaatcgcccccaacacattcagcgccggggccaacagtttttgctcgttcgtcatgacgtttctctccgtgtagatcgggcccgtccgaagcagcccgtggcgcgccgcagggccccattttgcactaacacgttatggcaagctagcctttctttgccgctttcgcttgaaagtcaagtagtcggcgccctcgaacggatcccaaaacaacttgaccatgtccccgtgggtgtccggcaaaagacggggtcaattgaccgtcaaggggcgcagggggntgatgtttttggtcccttgaaaccccgtttctttggggtaacccntttgataaacnttttaggtttgggc

SEQ ID NO: 622771 - DNA, 506 bp, Homo sapiens
  misc_feature (1)..(1): n is a, c, g, or t
  misc_feature (78)..(78): n is a, c, g, or t
  misc_feature (495)..(495): n is a, c, g, or t
ntccggcggcagagctccaccgctgaggccgacgagggcagatttttattttatacaaatttattttaaataatactntgtatgggagagaaaaatcacatggaaaaccataattagctttctgcgaaacatatgaggagttctattaaaatatgtgaagacaaatatttattatatttaataagacataaaaatacaaacatttgggagaaattacaaggggtgaagggggggacatgattaaaagttttcctaagttaactgggactagtaatttattgggttatatttatagataggacatttacaaatcaactacataagacacataaaagtgttatatcaaagcagatgctatctatattcttgcagataaaaccaaataaacagaaatatagcgagaacgcaatttttgaggcattatggataggggggggcagctctgaaataagggccttgatcgtattcatcattggattcctggactgagcacancacctgggaaa

SEQ ID NO: 622772 - DNA, 126 bp, Homo sapiens
actgactttaagcaaaactttgccattgcttcatatgtgttcatgccctgtcagggcataaaaagcaatttatgtcctgccaatcccggaagtgtattccagatccaatagaaatgttctttgaga

SEQ ID NO: 622773 - DNA, 235 bp, Homo sapiens
  misc_feature (10)..(10): n is a, c, g, or t
acaccacgcnaccggagaaggaccacgcccctgccaggttagcatatgacctgacctccctgagactcaccttccttacctgtaaaatgggaagcacagtggtgtcggcctggacggggtaggggagacccaagtacttaagtacttgtaagttgcttaagtacttaagttacacaagtacttaagtacttgtaagttactctggtgagtgccttctccggtggcgtggtggtac

SEQ ID NO: 622774 - DNA, 125 bp, Homo sapiens
gtgtagtacttagaggatcctcaggggaaggacgtgtgcagcggaatggactgtggccgagggaactatggcaactggagagaactgaggcaatggagaggactgtggcagcggaaggactgggg

SEQ ID NO: 622775 - DNA, 209 bp, Homo sapiens
tgcccagtgtgaagcatatagacctcgaccctgcaactcacttcgcttacctgataaatgggagcactgtgtgtgtacagcgcctggacggggtaggggagacccaagtacttaagtacttgtaagttgcttaagtacttaagttacacaagtacttaagtacttgtaagttactctggtgagtgccttctccggtggcgtggtggtac

SEQ ID NO: 622776 - DNA, 422 bp, Homo sapiens
agaggctgcagtgagccgagatcgtgccactgcactccagcctgggtgacagagtgagaccccgtctcaaaagaaaagaaaagaaaaaacaacaacaaccaacaataaggtttggtccctgtgagagtcagtgactgccgtggaggggctgatgggccatgtgttctgagaactttcagcctggatagattgagcattcccttatctgaaatgattgcgacccgatgtgtttcagattttggggtctttcagagcttggaatatttgcatatacataatgagagttcctggaaacggaatccaagtccaaacacaaaattcatttatggttcatatacaccgtacacatatagcctggaggtatttcatacaggatttctaaaattttgtgcacaaagtttgtgtacactgaactgttagaa

SEQ ID NO: 622777 - DNA, 437 bp, Homo sapiens
tgcatcatgctgcataatgttaaaactatgaaattagcattggatataatacatattaactgagccacagatttgatatcagatttctccagtattttccattaaattacccttttctcttctaggatccaatccaggatccaatccaggatcccacattgaatttagtggtcatgttccttagtctcctcccatctctagacagtaactataagtctttgcttgtctttcatgaccttgacaacttatgaagactaggtcacacaggtatcttgtaaaatgtttttcagtttgggttttctgatgttatatctctagaaaatagactgaggtagtggaatatggggaaaagaatcacaaagagtgatgtgttcttgtctcatctaccaagcaggaggagaatggactaggatactaccagtgtacctggaacaacc

SEQ ID NO: 622778 - DNA, 107 bp, Homo sapiens
ctagaggatccgtgggaggcaggacactgatctcaactagttcaacggctgcagtgagcactgttcacgccactgcactccagcctagatagggagaccttgtcttc

SEQ ID NO: 622779 - DNA, 270 bp, Homo sapiens
ctcccccagaagtgggcagctgtggtggtgccttctggagaagagcagagatacacgtgcctatgtgcagcacgaggggcgtgcaagatgcccctcaccctgagatgggggcattcttcccagcccaccatccccatcggtgggctatcgttgctggccgtggcgtgtccgtggcctgtcctaagctagtcctaagtgagctagtagtagggctagtagtagatagtagtagagaggaaggagctcttggtaggacaaagggagtggagc

SEQ ID NO: 622780 - DNA, 223 bp, Homo sapiens
ggtattccaagtgtgctgtatatctcaaccaagccaacagcaatattacaaatatactgtaaacaaataacaaaacagaaaaaactggggcccagcagggtgggtgggctcacacctggtaatcctagcacttggggattacagggcgtagagccaccggcacccgggcctggaacacttttattttttggcacgcaaccacaggggctcataggggcgtaca

SEQ ID NO: 622781 - DNA, 324 bp, Homo sapiens
  misc_feature (295)..(295): n is a, c, g, or t
tcacctctccctgccaatactttttttaatttgcattgttactcatttggggccaaaagtcagtgaaattgtaagcttcaataaaaggatgaaactctggaaaaaaaaaaaaaaaaaaaaaaggtttgcgccgcggcggacggcggcctctgcaccaggcggtagccctcggcgagcatcagggtgtcggccatggcgcaggccggctgctgtggggacagcgcgcggtggtcagcgccggctccccggcccggccagcggctcctctgcggcgggagacccggggcaccgtgcnggtccctgcagctcggccgggcggagcaa

SEQ ID NO: 622782 - DNA, 663 bp, Homo sapiens
ggagacaagggcgcactttggtgcccaggctaaaagggaggggggggatcttgcctaaaagaaacctttgcctcctaggttaaagggatcctccttaccttagcttccggaacagttgaaactacaggcatgagccaccatgcctgcccggttaaatttttaaaattttttgcaaagagggggttttgccatgttgcccaggcttgtctccaacttctgagcttaagcgatccgcccaccttattcctccaaaggggtgggattacatgggggagccaccccccccagccctaacaattaatttggatatttgtatcccccttattttgattaagaagcattatccttggggttatggggaacaaaaaatttaaaagacctgttttaagccaaaaccccttgccgaaaattggaaaagaccttggttatgggtttggagaaaaaaaacttttttggggattcaaagtgggggaggcggcccaattgattgggggagctaaatatgttgaaaaaatctttttggtttgaaaggggggggtttatgaaatgacctcgttttggcaattttttatttattggacaaaaaagaaggccaattccccaaaccctgtttaaattaatagacctttggaaaaccttttccttcttgggtttggtaaaaca

SEQ ID NO: 622783 - DNA, 146 bp, Homo sapiens
gcggccgcctactactactactactgctcgaattcaagcttctaacgatgtacggggacatgggtgagcgtgtaaaagcttggccctgtgccctacaatggggccagctgggccgacagcagaataaaggcaataagatgaaaaaa

SEQ ID NO: 622784 - DNA, 168 bp, Homo sapiens
cattgagccccttgatgactccccgagatagtcagaaaaactttgtggatccagtcaccaaacaagaaggtcagttacgtggcagctgaaggaacggtgcagaatcgaaacaataactggtctgctcttgctttcagtacagaagagaagcatgtccttccaaggaat

SEQ ID NO: 622785 - DNA, 281 bp, Homo sapiens
cgtccgctgctatcctttctaatcgctatggcaatcctagggcttaccgaacgaaataattctatggctatatatatctacgctaaggccccgacacgttgtatgcccctacggtctactacaacccttcgtctgacgccctcagatactcttcaccaaacgagccccgtacaagccgtcatattttctatcaccactactacatcatcggcctcgaccttagctactcaccatcgctcttttcctactatttaaccccactcccggtacccaagggggat

SEQ ID NO: 622786 - DNA, 376 bp, Homo sapiens
  misc_feature (142)..(142): n is a, c, g, or t
  misc_feature (318)..(318): n is a, c, g, or t
tgttggcaaagatgtggcgcttgggaacccttttataactgttagtggcaatgtaaattagtagagctattatggaggatagtatgggaggtttctcaaaaaaccaaaagtatatttaccatatgattcagccatcctaccnctgggtacatatgcagaactgaagtcagtatgtcaaagagatatctgcacttacatgttctttgcagcactattcatagtagccaagatatggaatcaacctaagtgtccatcagtaggtgactggataaagtaaatgtgtatatatatacacagtggaatactattcaaaggaantcttatttgtgacagcatgggtcaacctggagacttaatgctagtggaagagctaggc

SEQ ID NO: 622787 - DNA, 300 bp, Homo sapiens
cattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcgcctctcggtggcttcatattcatctttttaaagcagcgggggagtataattaactttcaaagggcaagtcagaagttgtttataaattacaaaataaaggcatattatgaactcttaa

SEQ ID NO: 622788 - DNA, 571 bp, Homo sapiens
aaataaaaagggcgcgcggtaacaacaagacgcaccaaaaaaatggcgggggccccccgaggcgaaaaatggggggagaacccccacgtggcccccaaatcgtccacgcaggaatctgcggcggcccccccctgccccaggggtcagtggccccgcccccttcccccggcgaggaccatgactcgccgatcttggcgagacaaaccaggcggcctaatcaatcccccgcgggtatggcaaacccgccctccctgtttaccccccgaagtttcctccgcgtgttctctccaatctcgctgcccacgatatttggagaactgctgctctccgcaccccatttcataacgggtcccttactgccgacccctcgtgaagtatgttggagaggcacccgccccccccctaattgctgagacattacacacagaagccttcatgtagttagaggcatcaatgtttgccacagcactcgcgtcatcaaaaatggtatgtagaaaccagtaaagttgtctccatggatagttaacccaccctaatccaaaggggaaacccccacttttcgccccaacaa

SEQ ID NO: 622789 - DNA, 924 bp, Homo sapiens
  misc_feature (80)..(80): n is a, c, g, or t
  misc_feature (107)..(107): n is a, c, g, or t
  misc_feature (121)..(121): n is a, c, g, or t
  misc_feature (180)..(180): n is a, c, g, or t
  misc_feature (184)..(185): n is a, c, g, or t
  misc_feature (308)..(308): n is a, c, g, or t
  misc_feature (390)..(391): n is a, c, g, or t
  misc_feature (395)..(397): n is a, c, g, or t
  misc_feature (419)..(419): n is a, c, g, or t
  misc_feature (424)..(425): n is a, c, g, or t
  misc_feature (434)..(434): n is a, c, g, or t
  misc_feature (436)..(436): n is a, c, g, or t
  misc_feature (454)..(454): n is a, c, g, or t
  misc_feature (459)..(459): n is a, c, g, or t
  misc_feature (483)..(483): n is a, c, g, or t
  misc_feature (487)..(487): n is a, c, g, or t
  misc_feature (496)..(496): n is a, c, g, or t
  misc_feature (498)..(499): n is a, c, g, or t
  misc_feature (511)..(511): n is a, c, g, or t
  misc_feature (522)..(522): n is a, c, g, or t
  misc_feature (561)..(561): n is a, c, g, or t
  misc_feature (565)..(565): n is a, c, g, or t
  misc_feature (618)..(618): n is a, c, g, or t
  misc_feature (633)..(633): n is a, c, g, or t
  misc_feature (655)..(655): n is a, c, g, or t
  misc_feature (703)..(703): n is a, c, g, or t
  misc_feature (913)..(913): n is a, c, g, or t
gccccgcccggctggaggctgctccggaccgggacgcagagtctgcggacccggcgccgaggcggcacccgagacgcggngcgcacgctccggcctgcgcagccggnccggccatggcggncccccgcccgtctcccgcgatctccgtttcggtctcggctccggctttttacgccccgngaannagttcggccctgtggtggccccaaagcccaaagtgaatcccttccggcccggggacagcgagcctcccccggcacccggggcccagcgcgcacagatgggccgggtgggcgagattcccccgncgccccggaagactttcccctgcctccacctccccttgctggggatggcgacgatgcagagggtgctctgggaggtgccttnncgcnnntccctcccccgatcgaggaatnatttnnccctgcgcntntggaggaggagatctttnctttnccgccgcctcctccggagagtagngtangggccttangnncccatattgctnccaccacagcncagggagaaggtgagcagtattgatttggagattgattntttnttctcactgctggatgatatgaccaagaatgatcctttcaaagcccgggtgtnatctggatatgtgcncccaccagtggccactccattnagttccaagttcagtactaagcctgcagctgggggcacagcacttctntctccttggaagtccccttccagctcccagcctctgccccaggttccggctccggctcagagccagacacagttccatgttcagccccagccccagcccaagcctcaggtccaactccatgtccagtcacagacccagcctgtgtctttggctaacacccagccccgagggcccccagcctcatctccggctccagccctaagttttctncagtgactcct

SEQ ID NO: 622790 - DNA, 340 bp, Homo sapiens
  misc_feature (32)..(32): n is a, c, g, or t
  misc_feature (56)..(56): n is a, c, g, or t
  misc_feature (67)..(67): n is a, c, g, or t
  misc_feature (162)..(162): n is a, c, g, or t
  misc_feature (330)..(330): n is a, c, g, or t
aaggaaaagccttttcctttttaagggtaaanaaaaataaagattaggggcctggnccgcgggttcntcacgccctgtaagtcccccagcactttgggaggcccgaggcgggtggatcatgaggtcaggagatcaagacccatccctggctaacacggtganaccccgtctctactaaaaatacaaaaaattagccggttgtggtggcgggcgcctgtggtcccagctgctcgggaggctgaggcgggggaatggcgtgaacccgggaggcggagcttgcggtgagctgagatcgcatcaccgcgctctaccctgggcgacagaagtganctccgtctca

SEQ ID NO: 622791 - DNA, 184 bp, Homo sapiens
gccccagtctactgtgctacaagggacccagcagcaggtaggggctttgggtaatatagtcactcatcattaactgagtaagagcaccttttcatattcacagcagcaggagcattcctgaggcccaaggagccctctaaggtcactctttcattccaaagcaccctgtgccaaccctatttat

SEQ ID NO: 622792 - DNA, 394 bp, Homo sapiens
agaggatccctggtctcctgtcgccactaaaaatacacatcagatggagcagtgctggaggtgcagtgagcttcgatcatgccaatgctctccaccttggacaacagagcgagattctgtctcaaacaaataaaaacacgacaaaattctagaagatcccctcggacaaacccttctagccattggcttaggcacacagttcctgaccaagaacccaaaaacaaatgcaacaaaaccaaagatacatatataagacttacattaaactacaaagcttctacacagcaggcagcctgcttgtcgcatacgtgtaaggacccgaaagatgctgaactatgcctgggcagggagacaccagagaaaactctggtggcggtccagtccgagcctgacg

SEQ ID NO: 622793 - DNA, 206 bp, Homo sapiens
cacctgttcacagatgtccgacctgtctgcagctgcgcctcctgtactcgaggacaggccgttggcaccctcgaaccacggatgtttccagggtgaaaagtctgcatgagacaatacttatccacaaactatcatcttcacggagcatgttgatccccagctcgtgcaatgttcctatttcaagatccacggcgaattccctgcct

SEQ ID NO: 622794 - DNA, 298 bp, Homo sapiens
atgtatgattttcagtaaccagatcatattcaacggcatcggtagcaacagttagaccttgggcaactactcgtcgaccagtttgacgtcgagcaataccctgtacggcaacaacctgacgcagaacgtgacctttacggactacaaccgcgatggtcacatggacttgctgggtgaggactcggtgtatgccgacggcagcagggctggacattcaatggcacgacgtcgcaccgttccaggtcgggttggtggacaggtcgacgcggccgcgaatttagtagtagtaggcggccgc

SEQ ID NO: 622795 - DNA, 704 bp, Homo sapiens
  misc_feature (266)..(266): n is a, c, g, or t
  misc_feature (508)..(508): n is a, c, g, or t
  misc_feature (552)..(553): n is a, c, g, or t
  misc_feature (560)..(560): n is a, c, g, or t
  misc_feature (591)..(591): n is a, c, g, or t
  misc_feature (607)..(607): n is a, c, g, or t
tgtggtggctcatgcctgtaatcccagccctttgggaggctgaggtgggtggatcacctgaggtcaggagttcaagaccagcctgaccaacgtggagaaaccccatctctactaaaaatataaaattagccgggcatggtggagcgcgcctgtaatcccagctactcaggaggctgaggcaggagaatcgcttgaacctgggaggcggaggttgcggtgagccgagatcgcgccattgcactccagcctgggcaataagagtgaanctctgtctcacaaacaaacaaatgtattgttgcactttgtgccgcctggcactaccggctaacctagcttccaaatcccagtgtgagctgcctggccaccattccctcccagcgagtgctgtgggtgtcacagcatcaggtgtatgcaaacccagacaggactacctgaggagttgcttttgtgctctctcccctcttccttcttcctcttgcaagcctataccggatgacagagatggcanagcctcttcgcaggccctacattagctacaggaacagtttccannttcattngcttgggaacatctggattcttcctttgtgnttcccagagctcttgnatgttcacgttggccttgtgacctggcttcccaaggtcttgccatttgcgcaggctccttctaatcctgtaatctggtggcctttcctggttctggc

SEQ ID NO: 622796 - DNA, 366 bp, Homo sapiens
agttcggtcaatgcatatgttggcagccagctgcacatcgcaccaaatatgaacttcaaatagaagaaagcctcatttggaagaaagctcatgcacagactgtaaatatttcagagcagattgtgtctctgtagattaagtaagttgtgaaagtctgaacctctgccaaaattttaagaccttgacctttacatctctgagtttctatctgtcatttttcctttctatctgtcattttacctttcatacttataaaatggaattcataatcttctcagcctaccaagtgttagtgttctagggattcagataaaatatgtatgaaattactttgaattacctaaaacatgacatttattcattcaa

SEQ ID NO: 622797 - DNA, 617 bp, Homo sapiens
ggagatcaagaccatcctggccaacacggtgaaaccccgtctccactgaaaacacaaaaaaactagacgggcgtggtggcaggcgcctgcagtcgcagccactcgggaggctgaggcaggagaatggcgtgaacccgggaggcggaacttgcagtgagccgagatagcgccacggactccagcctgggggagagagtgagactccttcaaaaaaataaaataaaaaaataaacaaaaaacacccacatttggctccttaagcaagtaacaaactcgggtatttcaacatttcttccactatgaggatggtcatgcttggtacaccacattaacgtcaatagccccacggcattccagcctaggccaaccaggaggcggaggacgtccaatcttgcagacaacaaccaacgacaaaacaaccaaaacacaccacaacccaggcagcggcgtcaccacacgcggcaccctcagaagaagtagttcccaagcaccacccacgaaagggagaccgggggccaccacagagcagaccagcgacacagagggcgacaaccaggcggctccagagagaaccggggacaacacaacaccgccagggcacccccaccacaacacag

SEQ ID NO: 622798 - DNA, 324 bp, Homo sapiens
aagcagttaatacagaactcagatatggcaggaatgttggaattatcggatcaggaatttaaaacaaccactgttaatattctgagggtgctagtggaaaaattaggcaacatgcaacaatggttggttaatgtaggcaaagagatggaaattctgagaaagaattaaagagtgctagagatcaaaaacactaacaaaaatgaagaatgcatttgattagctcattagtatactggacacatcttgagcaaagtatctttgagcttaagtacatgtctgtacatatatgtgtgtgtctgtatgtgagtctgtattaactgcttg

SEQ ID NO: 622799 - DNA, 463 bp, Homo sapiens
  misc_feature (15)..(15): n is a, c, g, or t
  misc_feature (153)..(153): n is a, c, g, or t
  misc_feature (157)..(157): n is a, c, g, or t
  misc_feature (162)..(162): n is a, c, g, or t
  misc_feature (169)..(169): n is a, c, g, or t
  misc_feature (174)..(174): n is a, c, g, or t
  misc_feature (177)..(177): n is a, c, g, or t
  misc_feature (180)..(181): n is a, c, g, or t
  misc_feature (186)..(186): n is a, c, g, or t
  misc_feature (198)..(198): n is a, c, g, or t
  misc_feature (201)..(202): n is a, c, g, or t
  misc_feature (217)..(217): n is a, c, g, or t
  misc_feature (220)..(220): n is a, c, g, or t
  misc_feature (226)..(226): n is a, c, g, or t
caacacgcatctcanccctctgctggtgatgggaacagaatgatggccctcagcaggaccaccccaacaaggaggcagcagcaacaaggtccaccacctcctcagggaaagcacaaggaccacccaacaggaggccatccccctcctcctcangaanggcanaaggacnacccnaanagnnaggcnatccccgtcctnctnnaggaaggccacaagnacnaccccnaacagtgaggccatcagcaaggtcctcccccacctactcctggaaagccccaggtaccacctccccaagggggccgccacaaggacctccacaggggcagtctcctcaagtaatctaggattcaatgacaggaaagtgaaataagaagatgacagtgtttcacatgccttggaacataatgtgatcatgctctaacttcaatataccaataaaataaatcagatttgcggtgatagg

SEQ ID NO: 622800 - DNA, 274 bp, Homo sapiens
gacacttggtttatagaagaacttccagcttcaggtaatggaggagtaattcctttctgaccaggcctcccgtaactcattctcaattctggaaaaatactgaaaataaaagcactggagagcaaccaataacaggcagaaactggagggggagttgacactggaaaaaaatagcactgagtgttctgtctttatagcttgttgcctgaacacaggccccagttaacttcatgtgaaacaactaaagcttgacaaaaaataaataactgtaatt

SEQ ID NO: 622801 - DNA, 387 bp, Homo sapiens
  misc_feature (308)..(308): n is a, c, g, or t
  misc_feature (342)..(342): n is a, c, g, or t
  misc_feature (354)..(354): n is a, c, g, or t
tcacactgaaaagacaatatcttaaagatttatctgaaaaagcatggtagaagacttccactgtgaccaagatggagtaacgggaactatatttacccttcttcctgaaacaaacaaaaaagcaggtaaaatgtgtgatactgcaatgctcaaaaccttgggacatcaggcaatgactcctgagagatggggaaacaaatgaggatgcccctctgaggaagtgcccctgccttgatcttttcaaggccatggcccaggggagagggaaccgcaggaggagccttgacagattccctggggtttggggnaggacagagctggaggagtctttggaagacccgnaaacagccattnttttcacaagggcagattacccgttttgggtgt

SEQ ID NO: 622802 - DNA, 464 bp, Homo sapiens
acacaactagacttcataggacttcggttgttttggctttgttccgttactgatccggcccggtatgtcagtttatctcagtgttcacgtgtttttcgttgctctgtacagtcaagatttctatacctttatatttgccaatgaagtttacgaaaaaattcagtattttaagaaaagttttgaaaaacaaagttaaaattctgcactgcaggtataactggtttacttacaggggtgattctcatgaaaactgtcaaagagggtcatatttcactccaaaatttttttacaaatgttttaggagcatcacaggcattattttaatgataatttaacacccttcagtaattttcacaattgtaacatttgtacagatccattgtaaatatgttgattttatttcatgccatatcttttgaattaatgccgtttttgataataaaatagggttgggctgataaaca

SEQ ID NO: 622803 - DNA, 327 bp, Homo sapiens
cctcttaaaataatctcctcggggtgaatcatcataatgcttcatgctctgttaatgtaaggaggaacagaatcccttgggtgttagtccattttcatgctgctgataaagacacacccgagactgagcaattcacaaaacaaagaggtttaatgggacttacagttccacatggctggagaagcctcgcaatcatgatggaaggcaaggaggagcaagtcacatcttacatggatggtggcaggcaaaaaaaaatgagagaacttgtgcaggggaaccccactttttgaagccatcagctctcgtgagacttattcactatcatga

SEQ ID NO: 622804 - DNA, 593 bp, Homo sapiens
cgacgaaattggccacaatcaggggcgaacctgatccgcttccgtaccgagagtttgcctggtccattcgcgcccatgcgcgcccacaagcacccagtctcaagtttgcaagtttgcgttggagataccagagagtcctgtcaaccccgaggaggcacgtctgtattcggtagacctgacgcgaaccgactgcactctcctactgccgattcggcgacacacgtggaaccaaggaccaaggcgtaccccatcccgggtaggctttcagtgcgctctacctatgtgcaccatagcgcacgtccacggtggattagagtctcacaagtgccggaagtccaggggatgcgccaatcctctgggcatgccccagtcagaacctctgggatctcacttgaagctagcactggccgtctgctcctgctctcaaggggctgcttttcaacgcaagagccttgtgagcctaggtcatcgagccattgcacagcacactgagtgttttttattccttagccagtgtacctcctacctcagagtctatgtgagaggaagagaatgtgtgtcctgtgtcacccccaaggcagattagtcgtatt

SEQ ID NO: 622805 - DNA, 140 bp, Homo sapiens
ggccggcctcgcgacgtgtatcctctaggacaaacaccaaacctacacagcaaatattgagggaggcagtaaacattttaagacaaatcatgaccaggggataaaaattggcattacccaattatatgtccaggaatcgt

SEQ ID NO: 622806 - DNA, 891 bp, Homo sapiens
  misc_feature (384)..(384): n is a, c, g, or t
  misc_feature (446)..(446): n is a, c, g, or t
gattttcccccccagcgggactctcggagccgggcctctaacggagttttcaggagtttccggcccctgtgcggcgcccatgtgcccccagggaacgcgggttcctccccagggtttccctcgcccccccggtcctattgtccggcggttcccccgctggttgtcccacccgctccccacatgcacattttcttgcgcgtctagcaagaagtgtggtccccccttcttggttgaaaagccggggcagcgccccatccttttgcgggacgtgtgtcgtccagcacgccccactgcgtattatgaggctcctcccgcgcacacgccacacgacatggtggaagacctcgtccgcagaatcaccaccctgggggccccagtactggnttctctgtaatacaggagcaccccacgccttccgggcgggtggctcaacaacaaccccgagnggcaacaaaaagcgctcctgtgtgagcatcgcacagagcaactcccactggtcttcggccccagtaccgtcgctcaaaaggggcgcaccaccagaatagttattcccccctatgatggccgcccgccccccgcctgtcaaatcccagcaggggtggaacacccgctgttccgacacctgttgtcgtccaactggccccataaagagatgtttcattcatacacaggacctgttgtatcagcaaccaagcactccggtcaaccctgccgcggattaacaaatgaacccaacttttgtgggacaccactcgtggatatttcattcgcagggcccgtcttatagtacgagttgttgtaagcaaccccatttctggtatcgggcaaccccagccgtgcccccaattgtccccccaacttgcggcccccttcaaaattcagcgacataac

SEQ ID NO: 622807 - DNA, 174 bp, Homo sapiens
atggcgctggagaagccgacgagggcaccggtgacgataagcaccgggatgtgcaaactaaatccggagaaggcagctgcccaaccggagtagctgttcagcatcgaaatgacgactggcatatccgcgccaccgatagcggcgacgaggtggaagccgaggaacagcgaggcc

SEQ ID NO: 622808 - DNA, 684 bp, Homo sapiens
gggactggaaagaagttcttcgtcggcgcctagcgacgcccaaacctgtccaaacaaaaaaaaatgtgaccacgatttaaaagatgagcacatggtttatttacaaaatattattccgaatcgaaggaggtagaaaaaacacaagttgattctataagaccattcccggtttaataataggctgcctgttgaagatgaggtcttactacagaatttaggagaggaatcaagagctgtctttctacaaagaaaaggcagagaatgtagataactgaagatttacagaacttatggtttgtgtggacaaagcaccagaaaccactatgatggagaggaagcgatgatcaattacgaaaatcttttggaaggtgggtgaaaaggtctggagcaaatgtgcaggcaatttttccacagcaaaagtcttgtgctaaaatctttcatacagatttcatatggacagattttccatcatggcaagttctttaatttatggtccatttggagcacaaacggcttgggctttcaattcaaaacaaggaaactagggactccaggttaactatggatggccgctggggccaggggtacctttcggggaatccctggctttagaaaaactactttttgggacttatccttagttgcccacaataaatgggctggaaaaaatctttcaaacccttg

SEQ ID NO: 622809 - DNA, 341 bp, Homo sapiens
gagctcggtaccgatctgggtcaacggtgctgcctgggacggccaggcctggcatacccccggtccttctacactctatacccacacgaagaccctgtggtggctataggggcatgcagggcattgcaatcactgtttggggaaatatctacatgttatggagcctgctcccatgaaggagaagccgtggaacattgccagagagaatactgaggatcagaggcatctaccaactccacagtcagggcttgaagagtaaggggctggtggtccttgaagccacagtcttggggcgagtcccatggagctaggaaggggaagaaggaatccagggtgcaggc

SEQ ID NO: 622810 - DNA, 803 bp, Homo sapiens
  misc_feature (55)..(55): n is a, c, g, or t
  misc_feature (61)..(61): n is a, c, g, or t
  misc_feature (112)..(112): n is a, c, g, or t
  misc_feature (506)..(506): n is a, c, g, or t
  misc_feature (523)..(523): n is a, c, g, or t
  misc_feature (528)..(528): n is a, c, g, or t
  misc_feature (533)..(533): n is a, c, g, or t
  misc_feature (549)..(549): n is a, c, g, or t
  misc_feature (579)..(579): n is a, c, g, or t
  misc_feature (586)..(586): n is a, c, g, or t
  misc_feature (589)..(589): n is a, c, g, or t
tgcttctgagatgaaagtgagaaaatgtatatattctgacactatgttgggaganaagacnttttcacatgtagggttttttccgccttacaacatcgtcgggtgcaacatngttccgaatggagatttaatatatatatgggagatacccacatgtgttacccccaccgaaccaaaatttttaaaatagcccgggaaattttgttcccatctcgcgctctgaaatatattaatcccctccgctattaatatgttggcaccacacccttttggggggaagaaattaggaggaagaaagaagaaagtttgttttttctcgccaccaacatgatatatttggcccccaacattcatccaaccaggaaggaaaggtgattaaaatttattaagaaaaaatgatattgaacaccgttcttgcggcttctttttaaaaaattttttcttctttaataagaggagcaacatcatatgaggttattaacacacacatcgaagatatattatanaaatataatattatatntcgtngaganatatatcactctcgtnttggagaagagaattgcactttataaaggnctatatnttnttaaaattgtggttttataatttgtgaaaggacacactttatacttatattaagaaaattggttatatataatggcttaactgtttctaaattctggtggtaaaggtatttttaagaatttgcaggtactacagattttccaaactgaatgagagaaaattgtataaccatcctgctgttcctttagtgcaataccataaaactctgaaattta

SEQ ID NO: 622811 - DNA, 958 bp, Homo sapiens
tttaaaaaaaaaaaaaagtgcagtgatgtagggctggggttagttaaccgtactggagttatccatctagcatctggggcttgctgggaagggtagtattaactatttaacatggtaatgggtggtacttcactcttacctagcacggcggtcttctcattggcttggggggagggagggtctctctggctgggcactggtctaactggcttacctggctgacttggcagttggctggtggctatgacatttattggtaggtgctattaagggtaggcttaaagtgctggggggggattggagttcaaacaatcaaaaacattggtgattttttccaatattggttttaaacaatagtggtcctaaattaaccttaaaaaaaaatataatggaccagttaagaatggctttggatctggtccaaaaaactggaatagaccccagtttcggggaaggtggtgtgtggacgcagggccatggactctggccccttacctaatcccaaatctctctaatggataagactttgggctcgcctctgaccagagccccaggaccagagaggggaagatgccgaatggtccaatgacctggtgggggacggtggaggagtttagcaagatttggaggtggggctgccgagacgagacaagaggggggcgcatgctggtgcccattgttgtgaccagtgtgtgaccaaactcgggtgtcgtgtcccctctaaaactggggtgcacaaacggggggaaaaagggggcccatgtgtgaagggtgggaaagccccgtgaatatggcgggatgtggtccccctggtgtggccccttggtttctggtggcaacttttcgctcgttttggggggcaaacttgttggcccacgggtgtgtcttaatccgggggggggagggatagcgcccccacggggggagtgttcttgggcggtgtgcacaaggcctttaa

SEQ ID NO: 622812 - DNA, 387 bp, Homo sapiens
cacacagaggggtgtatggaaaagcgccatcaaaagatatgctcagctctgtgagctcaaactcaatcatagcaaagaattttctgagcaatgcttctgtcttgttttcagatgaagttctttcctttactacgatcaggcctcaaagaggtccacatctccacttgcagattctgcagaaggagtgtttcaaacctgcaactgtcagagaaaggttcaacactgtgagttgaatggaagcatcacgaagaaggttctgagaatgcttctgtttacgtaggtgacttttctcccgtatccagcgacatcctcagaacggtccaaatctccacttgcagattctacacaaatagtgttaggaaactgctccaaccaaaggactgttcg

SEQ ID NO: 622813 - DNA, 275 bp, Homo sapiens
tcttacacaaaaacaaccttttgtttcattgatgttttggattttcatttcagttttatttatgtctgcactgatctttattatttattttcttctaattttggatttggttagctcttgcttttctagttctttaaaatgcattgttagattattcatgtgaagttcttcctctttttgatgtaggcacttatagctataaactttcctttgagtactgcttttactgtatcccataggtttcgctatatcgtatttccattatcatttgtttc

SEQ ID NO: 622814 - DNA, 173 bp, Homo sapiens
actgtgacgaggctctctgctggagcgtcagtggggagtggccctagtgaacggggcccgcttgatggttcccatggatatcgtctggggagtccacgctcctggaattctgaggctgaccgaatagtcagactcctaatcctccagtggcctcctggtaccgaactgcagtc

SEQ ID NO: 622815 - DNA, 117 bp, Homo sapiens
ggaaaaaaaaaaaaaagggaaaggaagggaacccttgggggttaaaggctcggcttggggttaagaaggtcgggctttaaccgaaaaggaaaacctcggcatatatctttacccata

SEQ ID NO: 622816 - DNA, 107 bp, Homo sapiens
gcccacaatagtgaggatcagctgaaatttgtccttacagtcgagtccactgtagccaaatgcacacttgtggcagtcccattagcatcttcctggtaccgggcagc

SEQ ID NO: 622817 - DNA, 216 bp, Homo sapiens
tctctcacagccggtggcttacttccccttttccagagtctgcaagagagccctggactggctgatgcccacgatcagcagcaataggcagccactttctccttcctattcctccccgactcccggggctggggacagcaggtgtgtacttgtaagatccatccatgtcagctatggctggggagctgatttcactgggatgcaggtctgcatatg

SEQ ID NO: 622818 - DNA, 399 bp, Homo sapiens
gaagtacaaaataggtgggcatgtaatcccagctgctgtggaggctgaggcaggagaatcacctgaacccaggaggtggaggttgcagtgagccaagaacaagccactaccctccagcttcggtgacagagcaagactctgtctcaataaataaatgaatctatctatctatctatctatctatctatctatctatctatctatctatctgtgtatctatctgtgtatccatctatatctaatgtatctatatctaatgtatctatctatatctaatgtatctatctatatctaatgtatctatctatatctaatgtatctacctacctaatgtatctatccatgtaatgtatcttggcagaagacatgaaactcctgggtcagagacaaagggaaaca

SEQ ID NO: 622819 - DNA, 171 bp, Homo sapiens
cttagaggatcccccccgagcacggcccccgcttggtagtggatacgagttagctcctccacaaccttgatgaggtcgtctgcagtggctctcgcttcatacctgctgccatcgtcatactgtaggtttgccaccacctcctgcatctggcggcggctggtggctgggggg

SEQ ID NO: 622820 - DNA, 972 bp, Homo sapiens
gcagcggggtgggagagcggtcggcggggtttcttcggttgcatgcctgagaggagcggagtctgccaggtggtgtccatcatgttctcttacaacatgttcgacaccctattcccaggtcttccaaaaccgtttactccacacagtagcgctgcttctctgtgtccatgctagcaggccctaatgacaggtcttgatgtggagacaggagggaagataattatgccacctcggcctggacaactcagccgacttaacatgctgttcaaactgaccaataagaattcggaccgatgacggcattgtggcgtgctggcgtttgtggtgatgagaggcatctgctactcccacactggatgatgcaagaattactcttggagagaaggcggctgatccaggtggagagacgtaaacattcaagtggccacatactccaaatttcaactacagagcctggactaacagagcaattcaacaaagccccaaaggcgaataagaaaacgcacaccacgaacatcgcaagcatgaccaccgaggaaggcagagacaacaaaacactaatgaaaagacactagacaaatgccgagtggactggcgaaccacaaaccgacaacgaacaaggaaccaaagaaagaagaaaacgacaacgtaggaaaatggagcaccgacaaggcgacaaagaacaggaaggaaccgacacaggaaggagatcaccacaacgagagaacaaacacagagacagtagaacatagggcacaccgcaaaccgagaccacgaacagaaccacaagaacaaccaggacaagaagcacccacagacccagccacacacacgcagacacacaccacagacacaacaccaacccgccacaacggagcacacaacaacagcaaaacaacggacacaacagcaaaaaagaaagagccaaaacaccacaccaagcaacaccccaacgtcgccacaccacaagcc

SEQ ID NO: 622821 - DNA, 204 bp, Homo sapiens
cagatcctccaagggcaacttatatatgcaagtagcaagcagccaggccctgcaatgagcataactacatggaaccatagtatttgtcaatatgcaaactggagacctaaagggtcatgcacaggaacagaaggtggctgtatacagacggcccagacacgaagatggagtaatgggcacgtccaatcaacaattggacaacaa

SEQ ID NO: 622822 - DNA, 276 bp, Homo sapiens
  misc_feature (214)..(214): n is a, c, g, or t
cgtgtcatccccttcggaattcgtacttatcctccggtgaacactgcaaactgatggttcgtcttcaacgttgagactcaaatgaagttttgttacaagttctgaaatgtggatggctgcactctggtcctcttgtcgctcacgggaagcagcggcagtctcttcctgttccaggacagctttagcgaactcctccccttctttcttctttagncccctccgtcaaggcagagccctctttccctttaatgcctgtgaatgcgggctgtgctgcag

SEQ ID NO: 622823 - DNA, 602 bp, Homo sapiens
acacgttattccaaagttaggtattgcgtcgcccctcatctgagtaacaataaagttcggttctcctccagctaatgctcagaaaacgtgactacttctctctcaatattaagacacaattcctggtcttgctgggacttgtcagggacatcaatacgtggatagactgggtctcatacaactccagaaggcatgtcgtatgagacagcagcgaactggtctgtctcctcgacatcatgcaaacctcatgacacgcatagcagggggtggaaggctgatcagctgtatggcgaacgccggtcaccagagctgcatctggaccaccttagtcttctctgataaccagcgatgtactacaccagcggatttcatcagggcagcaatatacgcctctatggagtcacagtgtctgcagagagttcaccacacaggcaatcactacagtgtatgtacctggtcaaagcatacgcatttcgcatgcacaatctcaagtagcatttcccggtactgctgggcacatcttagatatgaatccattggtacaagaactaaccgatcatggctaccgtccaattgagggaatgagtggacctgcatccagg

SEQ ID NO: 622824 - DNA, 151 bp, Homo sapiens
cggaggtgccacatagcccaagagcctcttgaatttagtattagtgtcaaacagaggcctggacagcaggttgcaactggtgtgcgacttttaggtcgtaattctaactccaagaggctcttgagttatgtggcaactctgaaggataatt

SEQ ID NO: 622825 - DNA, 408 bp, Homo sapiens
gttcccttgggcttgtgtttcacagagctcaacaagtacagtttgtttcttaatttgtctctccttctcagaaagtgtgcatatatgtgctatgaaaggtatatgtttcagcattaacctctttggaaacgtatgtttcatcgacttccagagttgaaaagcatgttcgcctgtctcaccaagtattctgtacagcatttggtgactctgtcacttactggcgttttctcatgcacacacacatacctggttcaggaccacgaatagatagtcttctgcacagggcattctttttgcttcagtatgtttaccacatttgctgcccacttttcataggtttcttgagacctccacaagagttggagttcacacttgcgctcgtgccgtattcggcacgagctcgtgccg

SEQ ID NO: 622826 - DNA, 827 bp, Homo sapiens
tggctggtaccggtctggagtgtttgggatcgcccgcttttctctcgtggtgatctggccgagtggccctgggttagcagctgctgcatttccccggctggtctgcggtcactgtgttgcagtgctcaggcgcccgccgccctttgaccttcgtgccccgtcgagctctaaccctacatgcgcaggaagatcggccgccgcggccaggctctgatgctggtgtctggtagaagaaggttactcacagttctgctgtcatggctcatgaagttggccactttcaacgcctccagatgacagtgagactatgtgcagttccggagcaccccacctggtgggtgcctcacttgggcctggagacagggaagtggtggacggggttatcaatctcaatgcctttgacgctccacactcccgaagacgatgacgcagttcctagacgcagggagaggccaccctctcagttggcaagaaggaggtagatcggcgaagctggagcctggcctgtggctcattggaaagaaaggccaggcacatcaagatccactacacatcttaaagatactgctgccgagtgaatggcggaagtggtccagagcggataacacacgaacgcagatggtacttcaacgacagacggcacctgactagcctgggtctcccagttggttaccttttacccaggggatgtcatcctagctgggacccctcccaggtgtcggatgtagtacagggaaacctcctgtctttctcaggaagggggatgaagtccagtgtgagattgaagaactaggtgtcatcatcaacaaggtggtgtgatggactcg

SEQ ID NO: 622827 - DNA, 876 bp, Homo sapiens
tatggtggttcatgcctggaatcctagcacttgggaggctgaggtaggaggactgcttgaggccgggagttggagaccagcctgagcaacatagtgagaccctgtctcaataataataataataaataataaataatagtaataatgaaggtaaatgggataaggaaagaaggataaattatctttaaaggtttgaatttaacgaacgcatcaaaggaaaaaccagagttgaaataaaagggaaaatagggtgaagataaaatctaccaggtatgcccaatgaaagagcgataaagaataggtaataagtcagacatgagggaaaggatggataagagaaataaagaagaggaaaaagaaagtaaagactgtaagaaagggcaagagacggcaaaataaaatggatgaaaccatagagctaaatgaagacacgccagggaagacaaaaacacacaatgaaatggcgaccagaaaggatatcaaagcaatggactacagggggaatgcatcagatgacaacaggagggaacaacaagtatgacagagagaccggtagagagagagcagcaacaaccaacgaagcagaacctaagaaaagcagtgatcacacaagagatagagagacaaagacggaaaggagacgcgacgctgaccaaactgtagtagcagagtaacctagaaacaacaagcaacaaacaaaaagaaacaaacaaggaagaccgcgggccagcgataaacacgcaaggtagcctggcaacggaagggtacaaaaagagaaaaacaggatagacaagaaaggaggcacaacagacgaagagagaaaaaaaagaagagagacccaggaaaacgagacaagaaaacaaaaaagggcaaaag

SEQ ID NO: 622828 - DNA, 157 bp, Homo sapiens
cccccgggggggcctttttttttaaagggggggatggggggggccattttcaaatgggtttgggggggggggaaagggccggggcattttctttccccccccccccccccctttttgggttttttttaaaaaaaggggggggggtttttttttttta

SEQ ID NO: 622829 - DNA, 182 bp, Homo sapiens
gtagtcacacaataacgtagccatcttctttgcatattcatctcttcatatctatagaatataatcatcttacagctgcatgataccttcagcctgatactcattatcatgtctcaataaacgtgtctattgcctgatcaaagagaactgtgcacatcattgattttgcttttttatcttta

SEQ ID NO: 622830 - DNA, 643 bp, Homo sapiens
  misc_feature (1)..(1): n is a, c, g, or t
ngtcaacttccctgtcccccgttgccgcaatagtggggaaggctctccccggttcttctggcgaaagggctcccagccctttctttgtttgaaaccggccttcccccttgggcccccaccttttgttcaccccattctgctgcccaggccttttgaaccttcgacccaccctagcgccttggattcgactctgttacgttcgggttcggtctttcaacctttttctttccccaccaaaaggtccccaagagatcccagggccgtggtgaatagcgccaacagcttgggcaaacctcatccccaaattacaccctctattagtgaaagggaagatcgaggaagcaataaggtcctgattttattaaaacccaaattccttggtcccacctttacaaatttttgttcgttctgtgccccctacaaagtggccaaggtatttcatttcctttgaaccaggggacctttccgtccttccagtgggtgccccaggtcccaaagccagtttttgcctctatccaattcctcccttattaagccgtgttcctgctcatcatgagaatccccgtaatatttcaacccctcctcccttccgggtgatgattggccccccaataaaaccgtctttggggtctttctcccacct

SEQ ID NO: 622831 - DNA, 101 bp, Homo sapiens
ggatttgctggtgcagtacaactaggcttaatagggagctgaattcgagctcgaattcgagcctcgaattctagcttctaacgttagaagcttgaattcga

SEQ ID NO: 622832 - DNA, 200 bp, Homo sapiens
cgaggtctcaagaccgtacattaataggaattacgttgtagatggcctcagctactgctaactgtctacaatttcacttgggaatcatataagcagccacatcagcaacactatcttgagtctactgttaatggagcatcaggaattcgggcttcgcaattatgagatacatattaccaaagacatgatgcgaacatcct

SEQ ID NO: 622833 - DNA, 191 bp, Homo sapiens
caggccagctgtcacgtggcaggcagccatatctctccacagttcctccacgttcctggggttcattttaaataataaatgtaaagtatgaaatgagtgctgaagttgcctgtatacaaggtcctcatcacctctcgcctgggagggagacgtttctttctttgtagagcgagctccaagtgtgagggcgg

SEQ ID NO: 622834 - DNA, 579 bp, Homo sapiens
ctcatgtggaaaccacaagcaacatgagaccagaagtcttatttatcttgtccaatggctaagttcccagcacttagaatggagcttggcacacagtaggtgcacaacaaatatctgttgaatagaacgctggaaggaaggacccatgcaccagaggtggtccctgctccagtgggcgaacgatcagagatgcactaaaaaatataataccacacatttttattgacaggtttactgactgtatactggatgttcaaagatgggagaggccgggcgcggtggctcatgcctgtcatcccagcacttcgcgagggcgaggcacggcggatcacttgaacccaggactcgaaaccagcctgggcaacatagtgggacccccatctctacacaaacactttttaaacaattagccaggtatggtggctcaccctgtagtcccagccacttgggaggctgaagcaggaggatcatttcagcccaagggtcaaggctgcagctgagctatgtatgtatgtaccactgcactcgaccctgggcaacagaactgagacccctgtctcaaacccacacacgacacac

SEQ ID NO: 622835 - DNA, 181 bp, Homo sapiens
tcgtagcggatgattactggagatcttttgcttacaactctttgatcatatgtacttgaagcagatggaatgaacggaagaacttcttcctccaggcaaataatcattcgacgaaggcaaagtacggactccactttctgcagaatactccttttgtacagagacaacttgagaggctgag

SEQ ID NO: 622836 - DNA, 135 bp, Homo sapiens
ctagcaggcagtgctcgcagacgttgacccgatgatcgaagacagaacaggttggtcaccttactcttggggcacttacaaagccccatgatcgatccccagtctctgtgtttactgatcggacgctgcctcgtg

SEQ ID NO: 622837 - DNA, 683 bp, Homo sapiens
cgacgcgggcgggtgagtcgtgcgtgggcgcgagccgggccggtgacgcctgcggacccgatggaccccgggtgcccatgcccagcgcccacggtaagaggctggtcggcgcgtggatgggggcggcgcagagcctcccgggccacaggtctggcatcaatggatgttctcgcagaagcaaatggcacctttgccttaaaccttttgaaaacactgggtaaagacaactcgaagaatgtgttgattctcacccatgagcatgtcctgtgaccctggtccatggtctacatgggggcaaagggaaagcaccggtgcacagatgggccagatactttctttcaataagacagtggcggtgtgtggagacatccaccagggcttccagtctcttctcaccgaagtgaacaagactggcacgcagtacttgctaaggatggccaagaggctcttacggggaaaagtctctgtgatttcctctcatctatcagagattcctgccagaaaatgctaccaagcagcagatggaggagacttgagctttcatcagctgccgataggagaagtccgagaacaacactataaacgacctgggatagctcgaacaagacagaaggtagagaattgcggagttggctatctccggggctcagtgggatccattgaccaaggctggtactggtgaa

SEQ ID NO: 622838 - DNA, 519 bp, Homo sapiens
accgttccagccaagcaaacccataagcaaatcgaagttgaggttatgccttttctgtcgcccaggctggagtgccgatagtgcaatcttggctcattgcaacctccattgcctgggtacaagtgattcttaagcttcagccacaagtagctaggattacaggcacacgccatcacacccggctaattttggtatctgaagtagggacagggttacgccatgttggccgggctggtctcaaactcccgatctcaggtgatccagctgccttggactcccaaaatgctgggataacaggcatgagccatcatgtcccagcttggctaagtaatagataactatctcacctgtctttcccccatctactaagtggagaaagtaagatacctgctttgttaagattatgggtagtttgagtaaaatagtatatggaaaccactatgtgtgggacatagtaagttgatactcatagttgtagagtaattactgatcagtgggactgttaggcgtaggctggaa

SEQ ID NO: 622839 - DNA, 340 bp, Homo sapiens
  misc_feature (137)..(137): n is a, c, g, or t
aaacaatacaatacaattaaagcttcaggtatatttggtcacctggtgggccatttaaacattttataaagggatttcattcagttgttattttcaatgcatgttttctgttgtataaaagctttactatgcaaggnggctgagattattatgctacagtatatttccagcaggtaaaaaagctttttatggtttaaatcttctgagaacataggagaaaaactgtccttgccacccacactacaacaaaatgtcaggactttgggctttaggttaacggggttttgataagggtccctccacatttttgggactgtgcagccattgggaccccttgagg

SEQ ID NO: 622840 - DNA, 256 bp, Homo sapiens
agcagcgaccgcgctcactggctttttgtttctgcttgggccttttctgttcagtccatgcttgaactactccacccccttaaatccaacgtaaaaaccagtcttttctgtgcttgttctctgtgcgttaatgctttttcttatgcttgcttattgaaatactgtattttcattgtcccctggccaaaacatctgagtcgtgaaaccattttagatactctactttcttactgtgttacgtggcattttatgcttg

SEQ ID NO: 622841 - DNA, 248 bp, Homo sapiens
gaatggaatcttgatacaattccaaagctattcttatcaagtgaaaaagatggtgaaacgaaagtaacagaaatggttgatatgccaggtgaagaacaaacaatgcaattccttgaaaagaatgttatgtttaaatttgaagtaccagctattcttccagaaaaggaatcagaagatgttgaagatgtcccagaagctgattcagattcagacaaagaaagaattatatgatttttttaattcttaaa

SEQ ID NO: 622842 - DNA, 413 bp, Homo sapiens
catccagaaacgggcgcgggcctttaaaaaaaaaaaaaaaaaaaaaaaaagaagagtatttctgttacttaaaaacacgaagttagggtgggtgctgtggctcacacctttatctcagcactttgggaggccaaggcaggcagatcacttgagctcaggagttcgagaccagcctgggcaacataacaagacccctgtctctacaaaatacaaaaattagccagatggggcagtgagtgcctgtaatcccagctacttgggaggaaggggcaggagaattgcttgaacccgggaggcggaggttgcaatgagctgagatcctgtcactgcacttcagcctgggcaacagagggagatgccgtttacaaaaaaaaaaaagacaaacaaacaaacaaaaaacaccttatctggag

SEQ ID NO: 622843 - DNA, 949 bp, Homo sapiens
gagaggggctaggctccgggattcgtaggatgcggggcgctgagtctggctgggcaggcctgtgagcctagcggtcctgacccagcacgacccctatatcagcagcttcgcatacctcctgggccatcgtcgctctgtacgcctttctgtcccaaggtgtcaacctgggggagacgactgattgtaggagcggcaccgttagtatcggtgtatcagtacacggtctagtctccctcccccgttgacgcaatggttgttaaccgctttgtgaggtcagagataaaactattgcatcgaccgtcctaggtcgaacccgagggacatctggattaggaatccaggagtctcgatggaacctgttgcttctgtttcgagatgctgggtgttgagagtacacacgagggtcgaggacgtcgctgaaggactcgtggatcggagtgagccgcgaccaagtgtcggatgactaatatggatcgtggcgttgcaatggacgccgaatggcacctgtgaccgcgttagcgagagactccaatggtagatgtggtcagcagagaggagacacggccgactccccagccccagcggttcgggactaaccagatgtcccatgtcccggcgcagatggcttggagctgcccgaagggcccgtcgagcttccttggagaattgtgagcagagggcgagctgcgtatgccgcggtagtcagattggggggctcatctttctcttgccctgggtgccggcaagccatcaggtcttccatccgggaggcccggcactcctgaagagtgcgtccgggcgggtcagcgggccgttcggggcaggctccgccggaccagtttgggcccttgcacggacggcgctggcctgttccaaggggaggcccggggcccgggagggggcccactctcgtggggggggcgcccaccggggcgcgggccccgggccc

SEQ ID NO: 622844 - DNA, 698 bp, Homo sapiens
  misc_feature (494)..(494): n is a, c, g, or t
gctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctacttgtgggaaagtgggtatgaagcattaccacttaaagaggaaccagagcttctgcccaaattgtcaaccttgaccaaattgtggacttgtggtcaggtgaacagacacgggtgaatgctgctaaaaacaagactggggctgctcccatcattgatgtggtgcgatcgggctactataaagttctgggaaagggaaagctcccaaagcagcctgtcatcgtgaagggccaaattcttcagcagaagagctgaggagaagattaagagtgtgggggggcctgtgtcctggtggcttgaagccacatggagggagtantcattaaatgctaactactttagctagagatcaggagtgtagggggagagtggaagcatttcagtgggatggtgcccaggaagaaagttgttgaaacagattgattgggatcgggatactaggatggaagaggaagctgggctgaaaggtgacgcttagaagaacagggagaagacagtgcttagtgtacacctcaatgatagg

SEQ ID NO: 622845 - DNA, 410 bp, Homo sapiens
  misc_feature (350)..(350): n is a, c, g, or t
acagctcctttaatggcaggttcactgaatatgtaaaagatgggctggaacacacgtgtgtgaaattttacattgagcgctctgagccatgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622846 - DNA, 259 bp, Homo sapiens
  misc_feature (199)..(199): n is a, c, g, or t
gctttttcgtctgggctgccaacatgccatccagactgaggaagacccggaaacttaggggccacgtgagccatgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622847 - DNA, 285 bp, Homo sapiens
  misc_feature (225)..(225): n is a, c, g, or t
atggcagtggcatgaacatggctcagctgggcctggaaaaagcccctgggaggcaagagcagggcctgcagaggctgttctcaagtcaaagctgagccatgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622848 - DNA, 901 bp, Homo sapiens
gacttccggtctggctcctaacaacgggggaggctggtaaccaggtgggggggatggcggagcgggcgctagagcccgaggcggaggcggaggctgaggcggacgcgggcggggaggcagcagccgaggagggcgcagggtccgaaaggcgcggggccggccggagctcacggagttcggaacccggggccggcgtaggtcctgagtccctggaaagatggtacgacgtgcggcgcgtgttccctgggcgagggcgcaccggggccctgggtgggtcctgtggggccgctgcgggttttggggggagccaaggctcggcggctttacctcaactctcgttcttgagaggcgggcgggccagcgcgggtaaggcggagccgtccatggaaaaggcctttggcgagaagttcagtgtcgcccgaataaaaggccataaacgccgggtaggaaaaatgggggttggaaaggcacttgttgaaaacttggtcgtggaaagaaccgttgggcggcatccttggctcacggagggggcacagcatatgcaccctgtttggctccggataggaagcggggccacctagggacgagagtataggacgtcccgaacttttgttgcgcccttggttgcccaaacgggggccggtgttgggcggttggcgtagtgctggggccaaccgagcgttaacgttccccggggcccgtggtattgctcgctcgcgaggaagggccccctacaagggatgtctagagcccttgattgggttgcgcaccgttggggtcaataggcgcttggggtgggctgggggagtctagcactacattcggaggctcttgggtctggccctcttggacttggccgggagtctccctgaggggccaggcggtcccagggttggcgcag

SEQ ID NO: 622849 - DNA, 397 bp, Homo sapiens
  misc_feature (101)..(101): n is a, c, g, or t
  misc_feature (105)..(106): n is a, c, g, or t
  misc_feature (337)..(337): n is a, c, g, or t
ctcctttaatggcaggaaagaagtgagcaagttagccgggcatggtggtgggcgcctttaatggcagctactcgggaggctaagatgggaggatctcttgnaccnnggaggtagaggttgcagtgagccatgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622850 - DNA, 373 bp, Homo sapiens
  misc_feature (77)..(77): n is a, c, g, or t
  misc_feature (81)..(82): n is a, c, g, or t
  misc_feature (313)..(313): n is a, c, g, or t
ccagctcggcccagctctttaatggcaggtgcctgtactccagctatcttggaggctgaggcaggagaattgcttgnaccnnggaggtagaggttgcagtgagccatgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622851 - DNA, 303 bp, Homo sapiens
tacgttttatgctgggaaactcatccacatagtactggagaatgcataaaaacaagactcatcaatcagctaccaactggagaggtgcaccagtttctttctttatattttttatttttgggaaacggagttaagctctatcgcccagtgggagggcgggggcacaatctcagctcagggcaacctccacctcccaggttcaagcaattctggtgtctcagcctcccagggagctcggataacgggtgcccgccaccacaccgggctaatttttttggaatttttataagagccattcagccg

SEQ ID NO: 622852 - DNA, 522 bp, Homo sapiens
  misc_feature (462)..(462): n is a, c, g, or t
gcttttaatggcaggcatggtggcactgcacctgtatcccagctactcagaaggctgatgtcaaaggactgcttaagcccagaagttcgaggctgcagtgagccatgatgccactgccattaaaggagctgttgagccatgttcatgccactgccattaaaggagctgttcatgccactgccattaaaggagctgttcatgccactgccattaaagaacagctcctttaatggcaggagaatggcgtgaacccaggaggcagagctttcagtgagccagagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622853 - DNA, 532 bp, Homo sapiens
tgttaaacattaagacacaaaaacacatgttagtctaggcctgtggagggttaggatcgtcattatcactggctttcccctccccatgccgtcccactgaaaggtcttcgtggacaataaaccactaacatattcatttgttatcattttcaagtattatgtatttcatgtattgtatgtgcaatacttttatacaactggctgtgcaggtttgtttacaccagcatcactacaaacgtgagtaatgcttccactgtgacattactaggtgatagaaatttttcagctttgtgttattaatgttatgggactactgttgtatatgtggtctcttattgaccaaaacgtcattatgtggcacatgactgtacctgttcccctcactttcccattcttagagtcacataccttaaaaagaatgtctcatcttggggaaaacaccattgcgatgacagaggggtctgttatatctaggcttagaactaagaatgaaagttattacaggattgtataggaaattcctgggagaaaa

SEQ ID NO: 622854 - DNA, 311 bp, Homo sapiens
tagaggatccccaagaaaagacactctgggaaaagaaagacattgcaatccacattaaattgcaatgcaacatcatttatgatgacattaaaaactaacatctaggttgaggcaggagaatcacttaaaccaggaggtgccaggttccagtaagccaagatcgtgcccctacactccagtggcagagctgtttttgagacagggtctcgcatctgtcacccaggcttgaagttgcagtggcgttgatctcagcttaaccgtcagccttcggactttcccaaggggcttaaggttgaatccttcccaacgtt

SEQ ID NO: 622855 - DNA, 459 bp, Homo sapiens
  misc_feature (101)..(101): n is a, c, g, or t
  misc_feature (105)..(106): n is a, c, g, or t
  misc_feature (399)..(399): n is a, c, g, or t
ctcctttaatggcaggaaagaagtgagcaagttagccgggcatggtggtgggcgcctttaatggcagctactcgggaggctaagatgggaggatctcttgnaccnnggaggtagaggttgcagtgagccatgttcatgccactgccattaaagaacagctcctttaatggcaggagaatggcgtgaacccaggaggcagagctttcagtgagccagagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622856 - DNA, 452 bp, Homo sapiens
  misc_feature (392)..(392): n is a, c, g, or t
atcgagctggtaccgctctttaatggcaggagctgtgattagaatccaagaagcctggggtatgagccatgttcatgccactgccattaaaggagctgttcatgccactgccattaaaggagctgttcatgccactgccattaaagaacagctcctttaatggcaggagaatggcgtgaacccaggaggcagagctttcagtgagccagagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622857 - DNA, 347 bp, Homo sapiens
tgtgcgtgtgcgttggtggcagccagtacggatggtctggcaacatggcagagaatcatgaaagcacaagcgtgccaaacgggcaaggtacatctctacaaattactatgcgagtcagaagtaaaacatttgaaattaatcccagacacccgcggatcagagacatgcttcgacgaattaaggacgatgaagatgatgaaaacagtttgggatctggcagaggtttggtatgcaacagcaacgcttcggtcagggtatgttttaccagacactaaagcttatggagatagaatagaaagaatgcttcgcctcagaaggaaaatggacccagatggggtaccgagctc

SEQ ID NO: 622858 - DNA, 306 bp, Homo sapiens
  misc_feature (9)..(9): n is a, c, g, or t
  misc_feature (246)..(246): n is a, c, g, or t
accagctcntttaatggcaggtaaatggcttcaacccgtaagacagagatcgcagtgagccagagctgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 622859 - DNA, 110 bp, Homo sapiens
  misc_feature (74)..(74): n is a, c, g, or t
tctcatttaacttttttaatggggtctcaaaattctgtgacaaattttgggctcaagtttgttttccatttaanaaagttacgtgatttttaaaaactttacttaccttt

SEQ ID NO: 622860 - DNA, 455 bp, Homo sapiens
ctaggtgtaaaataatatatcagacagcagtgtttccgacaggaaatagaaaaatccatcctaaaattcaagggaccccaaatagctaaaactatcttgaaaaagaacaaagctggaggaatcacacttcctgatttcaaaacttactataggccacgcgtggtggctcacgcccgtaatcccagaactctgggagaccgaggtgggtggatcttttgaggccaggatgtcaagaccagcctgggcaacagagggatactccatctcaaaaaaaattttttgctttagggccaatcgtggtgacacacgcttgtaattccggcactttgagaggccgaggcaggtggataatttgaggtcgggggttcgagagcagactggccatgatggtgaaatcccatctctactaaaaatacaaaaaaagccgggtatggtggcatacgcctgtaatccca

SEQ ID NO: 622861 - DNA, 116 bp, Homo sapiens
tgaacggcagattttacggatgatgtacatcacctaggtaatatgaacacaacaggatccttagaggcttatagagactaagtattaatagttggtgtgaagtataaagcgttgag

SEQ ID NO: 622862 - DNA, 290 bp, Homo sapiens
ttataacactaagacaatcatttcacttgagcttcaggagttacagaccagcccgggaaacatggggaacttccatctctataaaaatgcaaaatatcagcagggcatggtggcatggcgctgtagttccagctactggaaagtctgaggttggaggattgcttgagcctgggaggtcaaggttgcagtgagttattatcactccagtgcactccaacttgggcgacagaaaaaaagaaagaccaaggtcttttttcttttttgagattgtctcaataaataaataaatg

SEQ ID NO: 622863 - DNA, 428 bp, Homo sapiens
aaacgtccccagctctggctctggccccacaacacacctgtcctgccggctgtcggtgcctgcccagtggagcgcgttggacctcccctcccacacctggagagctgagctggcaaagtcacgagtctgcaaaggagatggggagggcaaggcaactatgaggtcaagatgggagagcaaacaagacattgcttaggcgacactggagtacttaggtcttaagtctctgaggtcctactcagtgctggaactctgggctagactctgggtaaacatggaaaaaatccagggggtgggtttatctccagaagcttagagttcagctgtgggggtagcagtgctcctttattcattcctctcatgaatcaagcccttttgtgtgctaagcttagtagaagacagaggtaattgctgtatccctggtgcaa

SEQ ID NO: 622864 - DNA, 702 bp, Homo sapiens
ttttttggtctctaaatcttcttccaccaggtggatgtcctgaagtctctgtgaatccacgggtgatctctgggggggctggccgtgattggcgagaatgtggtctcggtggcctcaatttaaatttcctttaaaattttaaaaaaaaaaaaaaaaaaaaaaaaaaaaaaaaaaaaaaaaaaaaaaaaaaaaaaaaaaaaaaaaaaaaaaaacaaacacacaaaaaaaaaaaaaaaccaacacaaaaaaaaaccaaaccaacaaaaaaacaaaaaacaccaaacaacaacaaaaaacacacccacaacgggggcgggggcccaccaaccacccccgggcgggcgcccccccccccgaccacccagaaacgccgagcacgccgccccaccgaggcccaccaccaccacgcgccgcgcagaccacacacaagcccggcgccaggagccaagcaccacgccggcaccgcacgaccagcaccacacccagggcgggcgacgccaaagcccgccgacccacccacccgaccgcccactccgcacgacggtagcagcacaacacacacccccccccccagaacgaggaagcaaccggacagccacaccgacccacacgcgcgcgcccgcggcggcccacccacgcccgccccacccccgccccagaccgcacaacaaacaacggcacggcccccaccgagaggggggt

SEQ ID NO: 622865 - DNA, 212 bp, Homo sapiens
tttggtgtttccactgtatgccaacttaatttttaaggcaaaaaactctagcgatagcgtggctttaggtattgcaattgatgaatcgggtgatattcgtactgatatgcagtccgctagtaataaaacgacggcgtgtacaccgctactaacaacgggtgcaaccttaacgacagataacaatcaagtacagtacagaattgggacactgg

SEQ ID NO: 622866 - DNA, 358 bp, Homo sapiens
ttgcatgcactgtggcgaggtcaccgcccagatgtttaaccatcttcctgaagtctacagccctaccgcctggtgcacttcgagcctcacatgcaaccgccacgtactcatcaaatagcatacttattccgacccaaggaccatattgcttactctcacaccagcccattcttgtatcctttctgatgcgtcgctcgcggatctcaactccaggctagagaagaaagttcaagcaacctacttcaggcccaatcattgtaatttcaggatgcgatgtctatccagagtattcttgcgatgagcttcttcttggtgacgtgcaccttacacgggtgatggctgggtaccgcgctcgaat

SEQ ID NO: 622867 - DNA, 171 bp, Homo sapiens
tatcaggaccagtgctgcaggcttccagtcagacccttggtaccaggcagaccagcttcacctgggacgacagcttcaccagtgcgatcctttgggtgccagcagggccagtgagaaccacgttcaccagcgcggacccaacaggatctccatggtgcaagcaccctgtgc

SEQ ID NO: 622868 - DNA, 773 bp, Homo sapiens
ccgaggcaggtggatcacttgaggccatgagtgcaagaccagcctggccaacatggtgaaactctgtctctacaaaaaatactaaacttggctgggcacagtgactcacgcctgtaatcccagcactttgggaggctgaggcgggcggatcacgaggtcaggagatcgagaccatcctggctaatgcggtgaaaccctgtctctactaaaaatacaaaaattagccgggcgtggtggcaggcgcctgtagtcccagctactcgggaggctaaggcaggagaatggcatgaacccaggaggcggagcttgcagtgagccgagatcacgccactgtactccatcctgggtgacagagtgagactccatctgaaaaaaaaaaaaaaaaaaaaatttcccaagggtttcacacctcgggggtttaagtttttccccggagttgtacgatcatcaccacaagtctaattgcagagacagttttggcaccctcaacaagaaacccttgtaagcaggcactcccaatttcctccttctctccagaatttagaaccccgtgtttctaccttcggtctcgggggttggacatattccgtggacctttttcattattaacacatgattctcatactattgtgttgacccttttgggtgcacgggcctcccttaaaagttttaagccacaaatgatttccaacaccttcattccagggtgtgcacccaatttctccaatactcaaatccatttaaaggggcctgaataaatacccaaaggtgtg

SEQ ID NO: 622869 - DNA, 361 bp, Homo sapiens
gtattcataattggtgcctagctcttgcaaggccattgatttgaacttctggtagaaaacatggtccactcgctccttaactggactcggcttacacacctttgggctgctaacactttttttaattggaacaaggttcaactttctcagtacagtaaaatttttttgctccaaatcatcgcttattgctttcacaatcttgtcactgtcaacaacctttttcgatctccttataggtgcaaaatcggaatctacatgctccattgtctctatatactaaccacgttcgtatttatatctatattcgtacatatattgttctaacttattgaaattgatggttaagaagatcccttctgta

SEQ ID NO: 622870 - DNA, 1402 bp, Homo sapiens
  misc_feature (69)..(70): n is a, c, g, or t
  misc_feature (111)..(111): n is a, c, g, or t
  misc_feature (371)..(371): n is a, c, g, or t
  misc_feature (498)..(498): n is a, c, g, or t
  misc_feature (504)..(504): n is a, c, g, or t
  misc_feature (522)..(522): n is a, c, g, or t
  misc_feature (581)..(581): n is a, c, g, or t
  misc_feature (626)..(626): n is a, c, g, or t
  misc_feature (792)..(792): n is a, c, g, or t
  misc_feature (877)..(877): n is a, c, g, or t
  misc_feature (879)..(879): n is a, c, g, or t
  misc_feature (882)..(882): n is a, c, g, or t
  misc_feature (954)..(954): n is a, c, g, or t
  misc_feature (1046)..(1046): n is a, c, g, or t
  misc_feature (1059)..(1059): n is a, c, g, or t
  misc_feature (1085)..(1085): n is a, c, g, or t
  misc_feature (1102)..(1102): n is a, c, g, or t
  misc_feature (1105)..(1105): n is a, c, g, or t
  misc_feature (1120)..(1120): n is a, c, g, or t
  misc_feature (1175)..(1175): n is a, c, g, or t
  misc_feature (1219)..(1219): n is a, c, g, or t
  misc_feature (1296)..(1296): n is a, c, g, or t
  misc_feature (1326)..(1326): n is a, c, g, or t
tggcgcaccgtgcaggcggccgccatatgcacgcgtgagcgctcagcgggatatatctgcgctcatatnntcggccaccggcggagccgcgtgaccacatcctgctcttgnatatacatcttgtggctgcagcgcacatatatgtgcgtgtggtgccgttgctgcggagatcgacgcagcgagcactaccgcgtgcagggcgaagagcgagagagatagtggcagagggttagaatgctgcaaacgcagtacgatgcgacaccaacggagcagactgtcaccagtcaacactccaaacacaatcacagcataatagtgccggtgcggacgggccaggcggtaggcgcgccacgagagcgacagagagaagnacatacgacgcggacatgcgagacgcagggggtgatgtggttggaagagatgtgggtcggtcgctcgcgcctggcgcacaaagacaaatcacaactgcagcaacgacacgcataacacacacaacangcgcanccacacacgccagtactntcaaacccatgtgacacaacttctccagctgtctaccgtcgtcagtggctattcaggcnctatgttgtccataacgccctacgctcgacctcgacgagtgacantgagagtgaggtatgggtgctcacctcgcatagtcctaaacgaagacagcgacgcgcctgagtatcatagacagtagatgtcgaagagttatcgtgaacagatcatcgtcagcggtacgctccacgctctcatcaactatcaaacatgaatcttctctcataccancatacgacgacacatacctaccattatgatgaacataaataaatgtattgataatcagaaattaaatggaatcatattatcgcangntantgtcattgatgtgattctattctcggcgcacttgcacgagatcgtaactacacacctcgctctgacaatcantgtcgagttatagacactcatcccgaccgcagttgtatgtgtgatagagtgtactgtaggcgagcctactcagcgcagagacacgtcagcgngcgtgtgagatanagggcgcgacactcgagccgtatcanatagaggtcgtacatcnaantacatagtctagtancacacactcagcatacaccacgacatataaagcgaagcgaagacctctatagtgntgaccgaacgactgtgtatgttcatgtcagctacgagaccgcgncgcgccagtagatgcgctacgcagttacaatctgggtacgatagtcccgacctagtactcacgctctcggttcgcgncataacagcgtattgatgggctctcgtcangagtgtatggtagtaagtaggctatatgtatgatacactagtagactacggaacgactcatcgtccagccacacag

SEQ ID NO: 622871 - DNA, 94 bp, Homo sapiens
ggggtttgagggtgaaattcaatgactttcgtgaactccttggctcctatgtgctgttcaccgggaggaccagggtttgtgaagggatgaccac

SEQ ID NO: 622872 - DNA, 417 bp, Homo sapiens
  misc_feature (16)..(16): n is a, c, g, or t
  misc_feature (33)..(33): n is a, c, g, or t
  misc_feature (36)..(36): n is a, c, g, or t
  misc_feature (50)..(50): n is a, c, g, or t
  misc_feature (140)..(140): n is a, c, g, or t
  misc_feature (290)..(290): n is a, c, g, or t
  misc_feature (296)..(296): n is a, c, g, or t
  misc_feature (299)..(299): n is a, c, g, or t
  misc_feature (326)..(326): n is a, c, g, or t
  misc_feature (340)..(340): n is a, c, g, or t
  misc_feature (345)..(345): n is a, c, g, or t
  misc_feature (370)..(370): n is a, c, g, or t
  misc_feature (398)..(399): n is a, c, g, or t
atggtttaagaatatncagcatttcttcaaatncancagaattgtatagncaaagatgtattaatatacccttatattaaaaagtcttggcttaaagttaataataaaccagattgaaaatttccacacttacatagaangtttaaaaaaaagacacaccagagcatggtttcccaatcggtttcatatatttctcaaccctctctttcaaaacgcatgttaaatccaaagttgaaatgaaagagtttgtgcgctttaaattgaaagtgaatcaatgtggaaagaagatnatccangcntttatgagcacatattcgaagggtctnagccaatgcatgtnataanagggcctcgaggaaagaaaaagagnaagaggatatagacacactctgcacagnncgtgattctgagagtccc

SEQ ID NO: 622873 - DNA, 872 bp, Homo sapiens
gggtcccggcaccagtttcaacctagccattctgaggtcttctccgtgcaaaaaggattcacagcaatggaccagttctgttctgccaaagactgcagcaatgatactactcccgtctcgtgaacttctataatgtaaacgaatctctagtgtacaaagggactacatcgttggcttctggaccttgctgaaaacggtaacatataatggtatggatggtaggattaagttgttgagtagttttgtgaatcaagattttatgtaacatgttgtaaagggataattgagcacttttagtggttcttaagggaaaagaaacagaccttgtggagattataatttccttggctttcatgttaccactgttagagcggagcttcgctatcatttaacatatagtacggatagtgtaagctgtagggaggacaattattgtctgaagctaaaatgggcttattctcatacggactgatggaaatgatttcatctctgccatctgtaaagcacttttcattgaacactgttagcctaggatacgtacagtaaattaacaatgatagcagcagatgctctagctcatcctgggtttgcttctgaccttgtcatgctgtgtgccaccatacacgttatgggcaccttttatagataagctctcatgatcgagatggtgatgcgctagatgaacgctgtcccggaataaactgagagtttcatactgttctgaaatgactagctatggtgtaaaaaggaagtaagagtggtatagatgaagaaggtgcgctataaatgctgtgaattttcttgtaagacaagtattttggtggggaaaagtcaagtatctattgcttagcatatgtgaagttgtagttatt

SEQ ID NO: 622874 - DNA, 358 bp, Homo sapiens
  misc_feature (16)..(16): n is a, c, g, or t
  misc_feature (33)..(33): n is a, c, g, or t
  misc_feature (36)..(36): n is a, c, g, or t
  misc_feature (50)..(50): n is a, c, g, or t
  misc_feature (140)..(140): n is a, c, g, or t
  misc_feature (231)..(231): n is a, c, g, or t
  misc_feature (237)..(237): n is a, c, g, or t
  misc_feature (240)..(240): n is a, c, g, or t
  misc_feature (267)..(267): n is a, c, g, or t
  misc_feature (281)..(281): n is a, c, g, or t
  misc_feature (286)..(286): n is a, c, g, or t
  misc_feature (311)..(311): n is a, c, g, or t
  misc_feature (339)..(340): n is a, c, g, or t
atggtttaagaatatncagcatttcttcaaatncancagaattgtatagncaaagatgtattaatatacccttatattaaaaagtcttggcttaaagttaataataaaccagattgaaaatttccacacttacatagaangtttaaaaaaaagacacaccagagcatggtttcccaatcggtttcatatatttgctttaaattgaaagtgaatcaatgtggaaagaagatnatccangcntttatgagcacatattcgaagggtctnagccaatgcatgtnataanagggcctcgaggaaagaaaaagagnaagaggatatagacacactctgcacagnncgtgattctgagagtccc

SEQ ID NO: 622875 - DNA, 311 bp, Homo sapiens
atgtctttgtaatagaatactacaagtgaaattgctgttatggagaaaggaattaaacatgcctcaaagttacaaatagttgaacattaaagtgcttattctttccctttaaaacatgggttcccccaggcgtggtggctcatgcctgtaatcctaacactttgggaggctgagacgggtgaatcgcgaggtcaggagttcaagaccagcctggccaacatggtgaaaccccatctctattaaaaatacaaaaaattagctgggcaagtggtgggcacctgtaatcccagctactcgggaggctgaggtgg

SEQ ID NO: 622876 - DNA, 698 bp, Homo sapiens
gccatatagcagcggttattcggtgagcggggtggttatcttccgtgagtaaagggctccggacatctcaggtctcagggtcttccatcgtgaactatataaagttcagaaaacatgtctcgaagatatgatccaggaccactatattttctccagagggtcgcttataccaggtgtgaatatgccagtgaagctatggggacaatgcaggcacctgtgtgggaatttagcaaatgatggtgtttgtgtgcagcagagagatgcaaatccacaagcttctgtgatgaagtctttttttctgaaaaaatttataaattcaagtgaggacatggttgtgacagtgtggcaggcataattctgatgctaatgttctgactaatgaactaaggctcatgtgctcaaaggtatttattacagtatcaggagcaatacctgtgtgagcagttggttacagcgctgtgtgatatcaaaacaagtttatacacaattgtggaggaaaacgtcccttgtgggggtacatgtgctgtacatgtgggtggggataaagcactatggtttcagttctataagagtggcccctaggtggaaattacggggggatggaaggcaatgctttggaaataatagcgctgcagttgtgtcatgttgaaccagctataaagagggaaagacttgagtagaatgttagtatcaagata

SEQ ID NO: 622877 - DNA, 454 bp, Homo sapiens
tcgagctcggtaccggtgttatcgatgccaccgcactccagcctgggcgacagagcgagactctgtctcaaaaagaaagtagaaagtggaagcatctgtatgtatgattgaagtcatgctttccatctgtttttttccaccttttcttttttctcctaaaacactgtatcttaatcttcctcatgatatcaggtactcataagcattattttaatggttgtatcagaatcctttatctggactcattgtgatttatttatccatctgtagttgctggagatactgccctttctgccacactcagtcaccgttctgacctttcactgtgtccagttatctactaatacacatactggtcatttaggacttaagaataaatagttatcatggttcctaacacttaaaaagaatgtgtcttcctaaaaatagaatggcttggtggcatcgataaaca

SEQ ID NO: 622878 - DNA, 380 bp, Homo sapiens
gtccccagccagggccgggggccggtgtttccctgaggacctgcattagaacctttttttaaaggggtggacaggaagaggtgtgtcttaccccgcctcttaaagctgggtgtatttctttgccccaggggtcatgttgatggtttcttccccccctctgatcttgggtcagccaacgggagggtccttttgtaatgtcttccattcctcccccccacccaaaaccaaaagaaatatttgtggcttgctttcggtttttgaatttttggccattttatatttagatactttgaaaaatgtaaatggctaatttggcccttaaatcttgtgacaaaaaagatattaaaaagatattaaaataaaagtcaaataaaaacaca

SEQ ID NO: 622879 - DNA, 1442 bp, Homo sapiens
tactaccagacaagcgtagccaaaccatttacccaaataaagtataggcgatagaaattgaaacctggctgcaatagatatagtacctgcaatgggaaagatgcaaacaattcatagccaagccatacatcatcagccacaggacataaccccatcataccattcatgccatcaatgcacattacactcagcacaatcacactctctgccaacggcagcagcccacaagctcacagacccaccgcaacacccagcacgcagcctaccctcacagcaacgacgcctcacaacagcaacgccacacaccccgctcctcatcgctcgccaacacatcaggttgtgtgaaccgcatctttcatccgtgtcagcatgtgcctgcacaaaccctcacccgaacgcctggcgtcgcactcccgcctcggcttgctaccccaccacatcaccacacttccactaccactctccacacccttcacccactatccgcaccccaccaaaccaacccccatcctacacacctccccccctatgcctccccactcccacccccacgctctcacgctcaccacacaccgaacgctacccccaccccctcctctccgcgcacaaccatactccgcaacaccacccccccatctgatatccagccacacgctaacaacaacactctcccacccccccccaccactccgtctcacgccccctcaacacccccacgcacaaccacaagtcccccccacaagaccgtcaccaaccctcaacccaccaccaccctcaccctcaccccccactccccaacaacaacctcactaacctagaaaacattcctacacaaccccaacatatgccaccccaatatccacatcaatcccatacatcaaaaatcaaaacatacaacgtccacgcactaacatacaaccactcacccaccacatacaccacccccgccatccaaccatatacactcacaacatacaaaaacacacggcacccacccacctcacaccccccgccgaccccccgccccacacccaacaacaacgcccaccaaacacccaacccccgcgagcgacacaaacagcgacccggccccacccgccacgcccacaagaacgacacacgcccccgcccccgcccacccccaggccgccaccgacaccaccgcacccccaagcaccacccagacaccacaagcacacacagtaccagagacccacggcgaaccagcagccccgcacacataccgcgcacagggccgcaaccaccaagccccaacaccgcaacgcgatcaaccgacccgaggaaccaccgccacgacacacacaacccccagcccggacaggggagaaacacagccagcagagagacacaagcgacaacacaaacaacacctcacacgcgcgcaacgcgcgacacccacaaccacaaaccacaaacaaaac

SEQ ID NO: 622880 - DNA, 374 bp, Homo sapiens
attcggcacagattgagcttcaataccctgaagtaaaagataagatgaataagcacttcatacggtataaaaattcttgtatcagcacaaaatatctttggaaggataaaaaagagaaagtgctatccatggggaagaaaactgggagactgtcttcaccatttatttctgtactgtccaattttgtttactgcatgcatgcactgctttaaaaatttttaagtgcatttttaaaactacactaggataagtgctattgtgaaagtatgtaacagatgtaacagattttaatggctaaaagcagcatttgaatccacccgaaagacttcagtggaggtttgaggagtcaccaactgacttgggacggcattgca

SEQ ID NO: 622881 - DNA, 150 bp, Homo sapiens
tctcatctgctgtttgtgctcctcatctgctgaaatatacaagtcatcagccagatttctgactgacacatacgtatgatcagtgcaggagagacctgcgaccacaggctgcaaactggaggtctgtctcatggcagttggcagtacttt

SEQ ID NO: 622882 - DNA, 119 bp, Homo sapiens
tctgtctggttgaaatcagtgatactccataggcagttgcagttattatggctccagctatcaaattttagtgtacctttcccaatctgattctgggtattttggctaattttgggagc

SEQ ID NO: 622883 - DNA, 756 bp, Homo sapiens
cagcgcgctccgtgggtcatggagatccccgggagcttgtgcgagaaatgtcaagctgagcaataacgcgcagaactggggaatgccagagagcaaccaatgtcgacctaccaatggcccatcatgtcagccaggaacaagagaggtcagtgtgtggtgtggaccagactggtgggctttctgtggtttgcacagttttgggtaacagtgcttgtcttggagcgggaaaagactacttgttgagcaatgggctttgagatgggaagtacctgggtttgtcattggtattccattgctacactctgggattggttgacaatattctgtcaaggggtctccaaataacaaatcttggctttagatcctgaagacgagagaagagaatgttcggacagcgatcgcagaaagttgctaaactgtttgcaagatgctggcattagaatgtgcatcagaagttttcatatcacgccttacactcaggatcgcgaacaatgtcaaggcaaaattcatgaaggtgcaagttataccggtattttttggaaagatattaggtttgatgctccatcctgccatgtatatgtgcaacatgaggggaatgtctaaagggactctagcaaaaataagcccgggtcaggaagaaagttaaatgggtttgcaacatgggaatcgaatctcatgggaaattattgacagaaagggcccaagtgaaagggacccccttgaaagttaagaggtgctttggaaagaaaaaggagt

SEQ ID NO: 622884 - DNA, 704 bp, Homo sapiens
tgttgggtaagcagagtggggtctcgccgataattgcaccccaggctggcacttgcaactctcgggctcaaagcgacagcagtcttcacatcgtgcgggtcgcgcacaaaggttctcacagggcatgtacaaggtgttggagccaaaatgccctccagcaccagtgataacagtcttgttgtgtctagtgctgtgtgtagtgtgtcgatgtgtgtgtttgacacggggtactcattgctgttgcccaggcagtcagtgtagtggtgcgaccatggctcactgtagtcttgacgttctcaggctcaagtgatcctgctcacctcagcctcctgagtagcagcggttacaggcatgcatcaccacacctggcttatttgttaaaacttttttcgtggagacagggtcttactatgttgccatggactggtctagaacttctgggctgcgagtaatcctcctgccttggcctctcaaaatgcttgggattacaggtgtgagccactgtgtcataacaattattttaaaatttttatttatttatttttaataattatacaagatggagtctcactatgttgcccaggctggtctttgaatgcctgggcgtcaaatgatcttcctgcctgaccccccaaagtgctgggattacaggcgtgagccactgcgcctggcctataacaattcttatatacgctaagtgattt

SEQ ID NO: 622885 - DNA, 650 bp, Homo sapiens
tttcccactcagacatttcccaaccactggagcatggtaacgggaaaatatcccattgagcacggtattgtttccaatatattctgggataatttttcgagtagcgaatttagaccaaataacctcgacgcaagaatttggagcaacacggctgaccccatttggcaactactgcaaactgaatcgcaaggcgaatataaagtggccacgcatatgtggcctggaagtgaggttgtgtatgaggaccacggggatgtacctagggaaagaatgccattttattttgcgaaattcaatcaatgggaaaaacttcaagataaattagctcaaattttccgatacatagatatgcctcagcttaaagataggccagaattggtcataagttatatacccaatgttgattcgtacggacacagttttggatacgatttacgagataagcggctacaaaagctgatcggcgaagtcgatggattctttcacgatttgattgaaggcctgcaaaaaagaaacttgttgaaaattagcaatgttatgattgttagtgaccatggcatgagcaatgtcaacacgaatgacggtgagcatgttgttgtgtgggaaagggtgttcccggccgacgcaatgaccgcatttatatcgcatgt

SEQ ID NO: 622886 - DNA, 376 bp, Homo sapiens
  misc_feature (111)..(111): n is a, c, g, or t
aatgcccctaccttctatttttatcaatatttagataaggcagacataataaattttaataagatatacaggaataatcttgtattttgaagaatgctatgaaaaatagantagtttggagggagtagttagtatttgggctcatataattgtgttagggtaactaattctaagcccattaaaacatttgtatgcctaataccttaagagtttaaagtgaagaaatccaagattcattgaaaaagaaaaatttaattttaaaaaaattgtaattttaattggaaaataatagttggaaatatccgtctacagtgtaatattttgatatatgtttatgttgtaaaatgattaaatcaagttaatgtttataacctca

SEQ ID NO: 622887 - DNA, 766 bp, Homo sapiens
gacatgatctcagaatactgatcttcatcagatgaacgctacatcttggcaattacgcattgctgttcctccattagatcacccgatcagcaacagaaactctattccagagttcgattaagaagatccaggaggctgctctgccagggtctgtaattcaattggcgtgttatagccgtcagtacgcattccgtctcgtgaactctgcgcatggctatgcgagttgcgtccggtcgtcgtactatggcaacaagcgacgcgagcgatagccatgagattgccaaaaaacatgcacgtacggggatctacgacgtcacttggcagtaattgcagaagactcagggtactagggcgattgtagtgcagttgctccgtgctgggaagaaaccaatagtctcagagccctagctcaggctccatagcgggagatgccgccttcgcccgaagcaggtagcctatccttcacggccttccgtgtagcaagcggacgtatgagctgagacgacaggtttcgagcacgtacatagggcggttctgcaaataacactgggagtggcaatccggtaagacatcatacgctggtattgagaacggattgtaatgaggagatcgtccacatcttcaaggaggctcatcattggagattatcttactatacgcgtttgatcagatcacaatagctgatgaatagccatttcgaataggagtggaactggccatagtacgtagccctcgtccaccagtttctctggtccaattggctaac

SEQ ID NO: 622888 - DNA, 298 bp, Homo sapiens
aagagaaaataatcaaagaaacatggcactaaagcaagaaaaaccggactttagatcaaataagactaacaaacatttacagaacatttcatccaacaactgaagaatacacattcttataagcacatggaacattctccaggatagactatatgttaggccacaaaacaagtttcaacaaattttcaaaaaattaaaatcatatcaagtaattttcataacagtatggtataaaattaaaatcaataccaagagcagtttgggaaactatgcaaaaacatggcaattaaacaacatg

SEQ ID NO: 622889 - DNA, 131 bp, Homo sapiens
gattttaaatgtttaaacaatgttctgactgttcagaattcagcagccagtcatggttctgtaccaggaccaccagtccatgatttccaatagttgaggatcttttctgtatttggaacaaaatcttcttt

SEQ ID NO: 622890 - DNA, 188 bp, Homo sapiens
cggggtttatctagaggatccctgagagaccgtgttgcatgacccgctcagaactgatgagatcaatgggaatgttcaagcgaaaagccgatgcaggactggaccttccaatgatgtgccagcttcctgggatctcactgcagcagagctgctgaggcccatgcagcacaatcatgcagctgggtgcg

SEQ ID NO: 622891 - DNA, 171 bp, Homo sapiens
tccccggtcaccttctacgtgagtccagcagggccaatccagaagtgaggcattgtagtgatatttagaggtaatctcccttcttactcagacactgagcagtcagggggtttgtagtgggaggtgatgctagatggagtccgaagggttgtggaagtcgatcacatggat

SEQ ID NO: 622892 - DNA, 405 bp, Homo sapiens
taggagggtaaaaggggttgggatttaaaataggacatgggggaaaagggggggaaaaatgcaaaaggatttagtatcctttatggatggtacatgtgcaacagggaactcttacttcatataccctcggcagtattcatccagggaggaaaaaaacccgggaacatgaatgagggcggatcttggtttggtgcacgggggccctgccaggcttatagtgaaggtgaagtgtctctccctcagaaaaaaatgggtccctgtgctgtcccagtagggcatagctttcccagccctaactttagaactcagtgaggacttagatgggaaagaatgaggtaaatacaagggatggcgggacaacaactacggcgtggtgtcccggggggaaggagggggggatcctct

SEQ ID NO: 622893 - DNA, 481 bp, Homo sapiens
gcatacgtggcgctgactgaggacaagacctgacttagacggacatcatctgtactcgtctctcacaaagaagattattgagatgtgggtgtgacttagccagacgccatgtgtgagcacaagtatggcaatgcgccccgtgtccgcatcaaaggacatgtggctgcccggttccccttcatccctatgccactggactacatcctgccggagctgctcaagaatgccatgagagccacaatggagagtcacctagacactccctacaatgtcccagatgtggtcatcaccatcgccaccaatgatgtcgatctgatcatcaggctctcagaccgtggaggaggaatcgctcacacagatctggaccgggtcattggactaccacttcactactgctgaggccaagcacaacaggaaccccggatcagccccctctttggccatctggacatgcatagtggcgcccagtcagcgacttgct

SEQ ID NO: 622894 - DNA, 122 bp, Homo sapiens
tcacttgaactgagttcagtcaaatcagtcaggaggccacatctcctgatggtcacccccatggatccagagactctgcccatgatagggtagtcctttcttattagctacacccagtaagc

SEQ ID NO: 622895 - DNA, 110 bp, Homo sapiens
ggttacccaagtggaggggtttgtacacgacatgcgcctcatctccagaccagcagggcctcttacacgtataaggatttgggcaaatgggacttagactcgcagctcac

SEQ ID NO: 622896 - DNA, 401 bp, Homo sapiens
aaggagatgacaatgaatgtggcgaccttattaacttccagggatgagagtttggactgcaggctcgcagtcgctgaataggcgatcacaacgtgcatgtgcttctttcttagggaatattcgaatcttgtctcaatgctcataacggatcagaaatacagatttcgatagcaaagcgacgttagtcgtgagctcatgtgaggaaagtcataggcttactcctcttagagttacgaccgtcggggtgggtctacaccacgacgggactcgtaaaactctttctttcttagaaactttactttcctacgttctgtagacacctggtcgtattacgactgttctctatcatttaatacactatactagtggactacaaagactactacagtgctgtataaaac

SEQ ID NO: 622897 - DNA, 812 bp, Homo sapiens
ttgccatggtttctccgtttgagaactcctcttggtgtgcggggcgacaagtgtggtcggatcgtgtgcctttgtggtgtagggggttttatgtttacggggtcgtcgccccccgttttggggccgcgagagagttttttccggcgggccggctttagggtgtcggctggccaggtagaagcagggggccttctttcccacgtaaggattgcgtcggtgctctttgcgcgccctcttgttaggttggtttgcacacgtgcggcgcacagactagccgcctggttctctctgttatccacacagttcgtcggtattcacccggccacgctgtttttccgcccgtgaaaacgcaccagaagtcgagcgcaccctgggaacccccctggagggcagcggcccaccaggggagtctcaggcgcacacgctcacacgcgccccgctcgtggtgtgaacacacgaggcgtccctagagaagcaaagccgagtggtggcgcgtgctccggctcctcaggcgagacttgctcctccccgcgcgaggcagtgggccagtatgagggggagcctacacgcacgggggtgcagcgtcttcaaatcgtggatagccgaacggccacggcctgtggcctttcattgggattcgcagcgcaccccgttgttccacgcacacatggcctcggtggacggtggcacacagagcaattggcccctcccctacccgtcaagtcgcgtgtggggggggccgccattcccccccgtcacctatacgggcgaaaaaaggcccccccggggggaacccgcgcaacaataagaca

SEQ ID NO: 622898 - DNA, 182 bp, Homo sapiens
gttcgcaggcccacaggagggacgacgagacatataagtgtgtagcacaggagcatgtagtagcagaagtaagcgcacatagtccggtggcccagatgccagccccctaagtaccggcagacacgctactaccccctatgctaacactactaggctagtcatggatacacctatagcgctgg

SEQ ID NO: 622899 - DNA, 295 bp, Homo sapiens
gtgtctagaggatcccgtgttattcgtttcttgcacggtatatatggacattagttatgtgccgtggttgtgctcatcggcttgcatgttgagtgtgggggatactgtcttcggtttcgtgtaaatgtggcccatgggtttttctggcgttttcagttctctgtatttacatggggattcatatatttaagaacaccttcccatcattttccccttaattacctatcttagagacaactttgaaaaatacaaattttgcactgaggtggaaggatagcttgaggctaggagtttg

SEQ ID NO: 622900 - DNA, 957 bp, Homo sapiens
tgcccctcattgtacataaatattatactagcattgaccatctcactgctaggaatactagtatagtcggctcacagctcatatcctccctacgtatggcctagaaggaataatactatcggctggttcattatagctactctcataaccctcaaggacgccactgcccgtcttaggccagatattgtgcctattgagcatactagtcgttgccgtctgcgaagcagcggtggggctagccctactagtctcaatcgtccaacagcatatggcctagactacgtacataacctaaacctactccaatgctaaaagctcaatcgtcccaacaattcatattactaccactgacactgactgttgccaaaaaagccgacatacattagacatcaactacagaccgtatctgtgagcctggttcgccaaaccgtttgaccatccggacccccgtaagcaagccagcgtacataataactaaagctacctgactccgtagcgcctcacaatcatggccacagccaacggcgcgttatccagtggcacacccagtatcacgaaagagcaaatctaactctcctatacataattcatcagctagcaaagtctcccttaattgataacgcagtctcacaagtgcgacaagcaaataagtcatagtgcgagaaatcatcatgaggaagaaccacccacgagaatcacacacccgtggggagatacagcagaagaacaccggaatagaggggcgcagcccaaggccagggaaacggcacaggaaacgccaagggcgaccaactagcccaccctaactgccaacaacacacgcataggcaacggggaccacacagagcgcacgacacaaacaatggggagcgtaacgctcaacaaggcacagcaagcaccccctaagggaccaacgaaagagagtactaaagacagcagaccaccggggccacagaa

SEQ ID NO: 622901 - DNA, 189 bp, Homo sapiens
tgactgtggctgaatacttcagagaccaaagaaggtcaagatgtactgctatttattgatacatctttcgcttcacccaggctggttcagaggtgtctgcattattggtccgaatcccttcttggtagtggtaattctttcctgcatagtacccatgtcagtggccagggtagggggtcctgagctcga

SEQ ID NO: 622902 - DNA, 445 bp, Homo sapiens
taacctggctctgttgcccccaccatcccagccaaatgcagacatgtgagtgaggccatctgggacccagaccaaccagctgcagcccacctgccagctatggccacatagtgaaccaggtgagaccagcagaaaaactgaggaggaggtaggagttgactctggaagcagggctcaaacacctgaccaaattgaggactagctaaaacaggttgggggcagaagcagctttccataagaccctcccaccagcgtgcccatgttagtttaccattgccatggcaacatctggaatttaccatccctttccatggcaacaagccaacaacccagaagttaccaccctcatcctagaaatttctgcataaactttgtttgtttgtttgttttgagatgcaatcttgtctgcactccagcctgggcaacagagcgagactccatctca

SEQ ID NO: 622903 - DNA, 116 bp, Homo sapiens
ttagcgtggtcgcggccgaggtaccaaaaaaaaaaaggaaaggaaagaaaggggtggcctgacactggtggcactactaagtgtgtgtttttttaaaaaaaaaatggaaaaaaaaa

SEQ ID NO: 622904 - DNA, 643 bp, Homo sapiens
  misc_feature (497)..(497): n is a, c, g, or t
  misc_feature (624)..(625): n is a, c, g, or t
aatatatcccggcctatccccctttacttatcagtttatttatttttcccttggattcaataggagggaatacttattagtatgtttaatatttggtcagctagatcttttttcctagatatctgatctttagcctttagtgtgtcttaccttaactagtggtagtgttctatatactataatagtcttgttacctgttttactcttgagttttgtgagtgacttatgctgcttctagctaggcctggggattctgtccctaattgtcttgtcttttctttttttttttttttttttttgagacggagtctcactctgttgccaggctggagtgcagtgaaatgatctcggctcactgcaacctccgcctcctgggtttaagcaattctcctgcctcagcctccgagtagctgggactacaggcgtctgccaccgccatgcctggtaatttttgtgtttttagaaatacggggcttcaccatgttggccaggatggnctcgatttcttgacctcatgaccgcccctcacctccaaaggctaggattacaggcatgagcactgccccggcataaactctgccctaatttcattggcttatgcttttagaatatgtaaaactaccnntcctttattttaaattta

SEQ ID NO: 622905 - DNA, 147 bp, Homo sapiens
tcatataatgatgataggtgcatatcattgtttactattataggtgagaaaataaaaggtgtatttatatagctaaaggctggataattttctccgatgagaataaacaatactccctcctgtggatcaagtaggtggattctcata

SEQ ID NO: 622906 - DNA, 374 bp, Homo sapiens
tattgcctttccatcgtggcactctatcctcaaggacatactctcaggggccatctgctattctactacatcctcagggatgatacaggcccactcccttccctacacatcaagctcgaggatttgccccacccaggactggcaaattagcattactcaacatgacctgagtcagataactaaaatacctcttagtctaggtagacgcttagcactggataggtacaggccttccctatagggtctgagaaggccaccgcagtcatttcttccgttctgttatacataattcctcagtatagccctcccacctcaatacagtctgataacacataagcctttattagtcaaatcagccgagcagtttttcaggc

SEQ ID NO: 622907 - DNA, 191 bp, Homo sapiens
gaggcgggcccgcagcagatcctggatccggaatctcccgggcaggagcggaatctgtcccgaaccgggtctgagaggatcctgttgacttggattaggaaatcccggagccgggatcgattttttttttaaccgggaattaagatcgccaagtcccgtattgcggagcacagaccacggagtggactcga

SEQ ID NO: 622908 - DNA, 590 bp, Homo sapiens
ggaccatggattatagtgaggagttcatgacaccctggccaacatggtgaactccacctccactaaaaatacaaaactagctgagtgttgtggcacatgcctgtctacaatcccagctacttgggaggctagaggctggagaatcgcctgaacctaggatgtggaggccgcagatagccaagatcacgccattgcaccactgcactctagcctgaacaagagcgaaacttcgtctcaaaaaaaaaaaaagtgtgtccccactcaattccctacaatttccttatcccaaagcaggggttacgcatccacacaaacacacacacaccgagacagacacaaagagaaagagaagtgaccaaaacaagaataagacgtaggtttaaaaaactgcaggttaaaattcccttcttctccaagggcagtcatcctctataaaaaaaggttcttccttggggtgtaacagaaatttttatctaggaaatggccgtgcaggaccatttcaacggttccccaaacaagaaaacctttattatggtcccacttggggggcaggtgtctaatttctcaaggctaacactccattggtcctt

SEQ ID NO: 622909 - DNA, 133 bp, Homo sapiens
cacacgccgattagtggtcttgcgcttactttgtagccttcatcagtggcttgctgaatgatggcggtatatagtgctgagcaagagtgtggtgatggttgatctggggtttatctgattacagacacaggct

SEQ ID NO: 622910 - DNA, 270 bp, Homo sapiens
  misc_feature (28)..(28): n is a, c, g, or t
tttttttttttcaagttgctgagctttnctgggcatgagttttcttgtattgaaagtgcagataataattacttacctcacagggtcatttggatgaaatgaaatgaagtggtgagagagtgtctggcacagagaaaatgctcaataggcgctgattacctcctatgtctcctgttcccttggtgaccttcctcatgtcaacattagctttggccccacaaattagtgccccttctggctatcccctgaaaacccttctgtcgtcttctc

SEQ ID NO: 622911 - DNA, 221 bp, Homo sapiens
gtgcctcaccatgacgcctggctaatttggtatttttagtagagacgggggtctcaccgtgttagccaggatggtctccatctcctgacttcgtgatgctcccgccttggcctcccaaaatgctgggattacaggtgtgagcctctttgcctggccaaaacttttcttttttaaattgatattaggaaacagaattatatacgctttttttttttattttt

SEQ ID NO: 622912 - DNA, 1442 bp, Homo sapiens
gatttccctgaactgcaagaagagctaaaaagattgtgtcaaaatagctgaagcctacagcaatctcatttagattactgatgtccaaacagattatagtagcagcacagcaagaggatacgtgacatcatgttcgcggagaccctacatcaagggcttcagcagcgtgaacgatgctgcctcactatgccgccttcagtcagtaaccgcaagggtcacggcgggccatttacttaagatagagcagggctgtgagcaacgactgatgaaccacgtacttgcgacttcaagccagcacgaccccgttctaggatctagcacgatgaggccggtgatcaatccacgagcgatttggccagtgacagtggtgaatgtgtcgaaaaacaataagaacgctaagttcagcaaggatagtgaagatggacatcgatagagctccactgtgaatgcttatcaatacacagagagtaattcttaactcaattaaaacaattagcatttgtgtgccttcacacaataagaggcaagtacattaatcaataaggagtagacgcgggcgacactcaggacacagagcacttcgaagatagagtactcgacttgtcacctgttcaagtacgaacatacacacgtttcaagtgttgaagagccctcgcaaaaagtcagcgtgtgcagcgaacttcttgagcctagtgagcgtttcaatgtgccaggtatacaacagagtacactaaggcacgtgaaggcccagatctagtgagatccaagacacgctctagtacatacatgcactagcaggcacattcactgagccggaacgtaagactctagggcccaatagtcaaggttgggggcaaacctcttggattaaaatacccccctaggttctagcctttgcaagtttgattgggtccccgtaatgcgataaacagttgtaggttggagtacctttggccaatggcgaccaccaccgccgtttggcgggaaattttgaattgacccgcgtgtaaggccttccttaccgttaaccggcacgaagtaattagttcgggccttagccagaactttctgtccttctagaaacaccataagaaggcccccacagaaatttgtcgtgcgaataggcttaatgcgtttcccccttccccccaatgttaaagagcacacatattttgctaatgtgagaaacaacgacgcgaacagtgggatgacaacggtggtcatcttcgaaaacccccgggatgtaacacccggtccttcgcgtcgcctttttaacgaaaagagttttggagtatgtcccctttggaacacagtttgaaccaggctggacaatacccgtgtgtacaccgagaaaaaaggcgagttcacgcaaatagcttgctcgccttccacagtgggataaagaaagcgccctaagtgtgttcctgtccaccggaagtaaa

SEQ ID NO: 622913 - DNA, 389 bp, Homo sapiens
tctcatgcaaactacaagaaataaaatctataacaaataaattcagcaaggatgcactagcataaaacatagctccatacacataacaaaaaattcgtatgtcctatatctcagcactcatacctaattcaagacagataaaaatacaatactatttacagtcactcaaaaaatgaaatacttagatataaatataagaaaacatgtgcaggaatatatatttaaatctatacaacactaatgaaagaaaagaaatgtaaacacatgtagagatataacatgcccctgccactggaagacacaacgaggtaagatgtcaactgtcctaaagttgctatacatgtttaactcagcccctatcagaatccttgcaggattttttttttttt

SEQ ID NO: 622914 - DNA, 140 bp, Homo sapiens
ccattctacgaatgatatgctgtattcgatgcgatcacacgttcccaaaccaggtgcagtttcactgtgttcggaatctctttgctataccctatattgtggctgtttctattgacatttcactcttatatttcagatta

SEQ ID NO: 622915 - DNA, 386 bp, Homo sapiens
ggactgagctggtatcatcaggatcatgccaagttccccagcacagtgaccatgtagatggtgaggaagacagggagagtggcagctagagacctggatattccgagaggccctataaagtgaaagtgacgatatcactctggttttcttggtttctgtggacaatgtataaaatttgattcagagaaatgagaagttaattttggatacagcaggttaaaatgaggaaatgtggagagacctagtgaatacctataaatggtgttatggaaaatacttggtttcaacttttacattattttcaaaagctagaatttactaatatcacagttttagaaagagtatgaaatatgtgcaactggaatagtaaaataaatctgtggagt

SEQ ID NO: 622916 - DNA, 259 bp, Homo sapiens
agcgagccgcgggctgccagcgtgcccccatccgtcccagctcggcttagcccccgcggaccctccaggcctggaccccaggctgtctgtgccgccacgccctccatctgtgtgggtcctctgctgggcccgccccatggtcacatgccagacttgactcagtttccctgttgaggtccctgatcgagcccgatccttcccctccatgtgtaagcttggacccatgaagaatactctagacggaagaaagaaagaaaga

SEQ ID NO: 622917 - DNA, 165 bp, Homo sapiens
  misc_feature (92)..(92): n is a, c, g, or t
ctgcgaggtcgacactaagtaggatccaaagaaattcggcacgagggctgactgtgattaggtgctggggtcttagcgtccagcgcagcccnggggcatgctggaggctctgctccttagggcatggtagtcaccgcgaagcggcaccggtcgagcagcatctcc

SEQ ID NO: 622918 - DNA, 154 bp, Homo sapiens
cctgtcccagaaagacataaattaaaagtaagcaaacaggccaggcgcagtagcatgtaccataatctcagctacttggcaggctgaagcaggaggatcacctgagctcagtgactagcctgggcaacacagtgaaatcctgaggtgatcttct

SEQ ID NO: 622919 - DNA, 816 bp, Homo sapiens
  misc_feature (335)..(335): n is a, c, g, or t
agaaggtcacacgatttctccaacatggcggcggcggccctgcggagtggctggtgccgctgtccacggagatgcctcggcgagtggaatccaatttctttccagccacaatcctaccccatgggtcgacctatcagatgcgccgtgcctggtgtggagcagctgccactgtccaagactcatagttctctcgtggaagacgagacaacaggcgtttcgtgatcgcggccttgcgtagcactaactgtcgaaagcaacgagagttgagccgaaagagacacacagcaacatgagaacgcaagaggtagtaacaagaagagttccgtgacgaggcnctgaaggctcagtacagaatcgagacgatgctcctaggcaggccagcagaggaaatacaaaccatcgacgtctagaaaccgtgcggcacgagcgaggtgctacggaagaagcttggggagctgacgggcaccgtgaaggagagccttcacgaatgtcagtaaacagtgatctcggccggaaaatcaaggagggcgtggaggaagcagccaagacggccaagcagtcggcccgagtcggtatccaaaggcggggagaagctgggcaggacagcggccttcagagccctctcccagggggtggagtccgtgacgacggaaattgacgacagcgtcctgggacagaccgggccctaccggaggccccagcgactccggaacgagaacggagtatgcgggagataagttcaaggaggacgacaagtgtttgagccacacgaggaggccctgggggtcgtgctgcacaaggactccaagtggtacc

SEQ ID NO: 622920 - DNA, 152 bp, Homo sapiens
  misc_feature (113)..(113): n is a, c, g, or t
ttaactcgctctgaccctgtagactcgctctgaccctgtacgactcgctctgaccctgtagactcgctctgaccctgtacgactcgctctggaccctgtacgactcgctctgnaccctgtacgactcgctctggggtacccgacgctcgaca

SEQ ID NO: 622921 - DNA, 154 bp, Homo sapiens
atgaatatagatcaatgaggactgagtttggcatgcagattcgaggatcccagagactcgatcatccttctatgatggtgagcctatgcctggaagatggacgacaagcctacatcatcaacaactccatcatcactaccaccaaaggataact

SEQ ID NO: 622922 - DNA, 596 bp, Homo sapiens
aggggaactctatctcccggactggggggcgatggcacaatctcaattcactgcaatctccgactgtcagggtcacgcaataatcctgcctaagactcccaagtaggtggtactataggcaagcgttacgcacccagctaattcatatattgccattagagacagagttacaccatgttggacaggctggacagaaactcctgacctcatgtgatctgcctgactcagcctgtgaaagggctgggattacaggcatgagccactgcaaccagaccttcctaccatgtgtataactcatcccaagacaagataacgtgtatgtggggtctcatcaaccatgatgtgacgccctagggtgcagtagtgtttgttaaaaaatcatgatctatgggtaaccccaggcccgtgaaacctattgcataccacgctggagaaaggggactgccccacggacttgaggccagatgcccttgcaccaaccatatgaaatggtaaaaagagaattgaagattgcttgtgacacttgacttctagtgaccgctctttggggtgactttacattaattgccggagggcacgtcggcaagaagcatatg

SEQ ID NO: 622923 - DNA, 872 bp, Homo sapiens
accagtcatgtttaattgggaggtaaattcctataaggatatgaaaggattcagcaacgattgaaatggtgttcctcacggaggggctcgggccaaggtcgtgggtgtgggggtggtgcagagtgtgtcctcttcaggggtattggcggagccgctcgtgcttgagatgcttgtaggaaaaggagtatgctaaaagagcactgtagcatgccagcaccagggtaatccccgcttgggctgcgtggagaatacttttggcgatgcctactgggagacttggatatcgaatgcccagtggggcctgaccacggtgtgaggatggagtgtgggatgtgacgacaaattgttgtcaccagggagctcctcaggggtgatccctcgtggccacatggtgacaccagcccaaagccaagagcaactggccggagagctccactggccgcctcccaagggggtcatcaagcggaaacataaaagactgggacaggagtcacaagcatagcatcgcggactgcgcaagaacgtccacacgaccggcccgaacacctctcacgcgctctgcagaccccggaaaggcgtcacacaaggcgtgcacgccaagggccggcacaccacactggcacagaaaggcacgcgaacacctcaaagaagctatagacccccccccgcggagacccccacagagtgtggcgcccaccacacacaggttggaacaggagcacacaaaagagtacacaataaggagagcggttacaaatacaccaccaaggcgaaaaggacgagaacctctgcaacacgtggcccagtgagggaagagaggcgaccccctaagcgaaaccacaaaacccacagtggcgccgaaaaaacagaaa

SEQ ID NO: 622924 - DNA, 139 bp, Homo sapiens
ttggtcgattgacctctgccggtcagttaggagacaggccatgccttcaagtgcgtctggtcactgatttcctcgctcagtttccgcacagtgcccaccataagtatgtccaacaagcctggcagaaggcagacatcaa

SEQ ID NO: 622925 - DNA, 186 bp, Homo sapiens
  misc_feature (6)..(6): n is a, c, g, or t
  misc_feature (50)..(50): n is a, c, g, or t
  misc_feature (57)..(57): n is a, c, g, or t
  misc_feature (94)..(94): n is a, c, g, or t
  misc_feature (150)..(150): n is a, c, g, or t
tggttnggacccagggaccttaagggcccgcaaaccctcccggggccttnaaacccnaggggcccctaccggcccccctccccggttagggggnggttgtaaggtttccggcgggcgctgcctgccttcctcccaaagggtgtttcctanaaactgataaatcagatcgggcctttttacccttga

SEQ ID NO: 622926 - DNA, 1005 bp, Homo sapiens
tctgtactgtctgattctgtgccaagacttcctccaaaatataattaaacaacgtatgcgtctccacaagtggaagcaaccctacataaacactaccatgttaaccatcttgcgagtatccgagatgggcaatggagagcatgttgtacctttctcgatctatccagagtccgggactgactcgtacactcgcgaggttatacgtcaatttgtaaccaccacgaggtggctccttgcacatccatggcagtcatgtatgtatcttctcacaatgcatctggagtactccaaaagatgacgtcgtgatagttagacgagaagacagtgtagcacgaaaatctgcactgagtcccatggggtggactttcagctatgatcttcagaattataattctaagcgatgtaaggctttgaaagcttttgcgcctgcttcccttggtcatcactaaacttacgagttgactatagagcatgatacgatagttgcactcgaagatcttgacgatctagcctgttatgtcccagcagaccatgtagtattggggctcgtggacacgtctactgtgacacttgctactagagaaccagtatacgatcatggcatgaataagtggatctgtgagatgcgtacaaaaaaatatcttcagaggggcaaaattttttgggttggcccttacggaggaggtttttacacgacccgcgttcgggcgtcgcagggtccttcgaagagatgttacacggggagttctcgactaagaagatctggtttgccaattggcggggcttttgcaccccagaagattcggggaaaggacgcttcgggattcaaatgagtccggggtcagggggacgaaaaccaagccgggggagaaataccgggcgtgaggagattgtgggattgggacacgggcggaggggttagggagaaacccaattgtggtgttcgcgagacggcaggtgaatctcatggtgataaaaagctcgctgcggtctgccgcctgactc

SEQ ID NO: 622927 - DNA, 629 bp, Homo sapiens
  misc_feature (11)..(11): n is a, c, g, or t
  misc_feature (70)..(70): n is a, c, g, or t
  misc_feature (77)..(77): n is a, c, g, or t
  misc_feature (79)..(79): n is a, c, g, or t
  misc_feature (83)..(83): n is a, c, g, or t
  misc_feature (93)..(93): n is a, c, g, or t
  misc_feature (142)..(142): n is a, c, g, or t
  misc_feature (158)..(158): n is a, c, g, or t
  misc_feature (210)..(210): n is a, c, g, or t
  misc_feature (225)..(225): n is a, c, g, or t
  misc_feature (230)..(230): n is a, c, g, or t
  misc_feature (248)..(248): n is a, c, g, or t
  misc_feature (276)..(276): n is a, c, g, or t
  misc_feature (280)..(280): n is a, c, g, or t
  misc_feature (287)..(288): n is a, c, g, or t
  misc_feature (328)..(328): n is a, c, g, or t
  misc_feature (338)..(338): n is a, c, g, or t
  misc_feature (357)..(357): n is a, c, g, or t
  misc_feature (359)..(359): n is a, c, g, or t
  misc_feature (367)..(367): n is a, c, g, or t
  misc_feature (439)..(439): n is a, c, g, or t
  misc_feature (474)..(474): n is a, c, g, or t
  misc_feature (481)..(481): n is a, c, g, or t
  misc_feature (514)..(514): n is a, c, g, or t
  misc_feature (536)..(536): n is a, c, g, or t
  misc_feature (557)..(557): n is a, c, g, or t
  misc_feature (560)..(560): n is a, c, g, or t
  misc_feature (568)..(568): n is a, c, g, or t
  misc_feature (615)..(615): n is a, c, g, or t
gcgaagggcancttcagtaacaaaagaactaccactcatctttgacatagcagagcgtggttgtaataancatcatnanaganttggcatganagaacacacactccacccagtgccactagccttcttactccaagggatncagacagcaaagaatntctgtctccgtacgcggagcaacttcacggggcttaaaaaaaacacgtaacngccagccggagggcnggctngggacacattagtggaancctagtcactgcccaaagcgcgacaccnattnaggctanncaataaataacttcaaatgcttaaccataattgaagtgangcggaagagnagacttgacgcgaaatttncntccgttgntcaggcagagattcccagtatgcggaggggttcgtggtagagctattcctctcgacgagacacagcagcgcngggcctactgcacagccgttcattacaatattgtnacaagtncaatcagacatgcatttataaagagaatataanaatatgtacaatagctcatttncaatgtgtgtcagttgccganagncaccaatnaaagtgtgcaaaaattcatttgtcaaaaaatcagagaaagccttccntgggcaacagtgca

SEQ ID NO: 622928 - DNA, 287 bp, Homo sapiens
cgtcgacgcggcatttaaaaccctgcagctttgtggcttcagaaaaaagaacacctcatatcaacaaagacatatagaacatgcaagcctcttgtctggcctcgttaatttttttcagcagaatgcaacattggttctgcccttgaacaagactgaatcaagaaaacaccactgagctcatagacaatgaaaacattcgatgcgagcaagtgggtttaatctgtgtgataatgaggctggccagtgtcttggccactggtgttctccagcccagacaccgtcgacgc

SEQ ID NO: 622929 - DNA, 873 bp, Homo sapiens
  misc_feature (31)..(31): n is a, c, g, or t
aaacgatcggagaaccacgacgagagaggcngcggaggcacgaatcggtaagctgaacatgcgtacgtaagatgtgaccaagggaaagtgccgtagggcgtgagcataaggggcatgggaaaacgcagcgcaggtgaaaaagaagcgcaggtgggacgagaccagtaggcccgatacgtgggacagagatcgcgacattggggaaaatgtcaggaagagatcactgaacggaggaatcggatcaaggcagggacaagattcagggcagcagcatcaggaactgggtcggagaagtgtaacagtcgcaccgagcgctggaaggggacagcagggcacggcacggcaaacaccgaggacgcacaggaagcaaaggcgcgggagcgaagacccaacagaccaaagaggccgaatgcgccgccccacagcccgagcccgaccgcaagcccgaggccgaccagaccaccgccggagccgcaccagaccattccgagcccgagccgagccccacacccagccctaggcggccgacccaacacagaaccaacccacgggccccaccccgagactttccaacgcgcccccagcggcgggcccaaagcgctttcccacaggccaaacaacgcacgaacacgcacgcgcacgggccgccagacaacacacggggccacggcgggcacacgcccacccgcaccccacgccacggccacagcgggcaagggcaagccacgcgcagacacaggcaacatggccagcacaacccacccgcagccagcgccgccagcgcacacaccgggccacgcacacgggccacaaccagcgcaagcaagcacagccacacacgcaaccacccccgtgcaacagcggcaagcgcaa

SEQ ID NO: 622930 - DNA, 235 bp, Homo sapiens
  misc_feature (26)..(26): n is a, c, g, or t
  misc_feature (56)..(56): n is a, c, g, or t
agaaaaatactcaatgttattggacnaaataatcaaaaggataatgatttcataantttctatttgaaaatgtgctgaatcttggaatgtttcaatctccagatttatgaacattttttcttgagcaattggtaaagtatacttttgtaaacaaaaattgaaacatttccttttgctctctatctgagtgccccagaattgggaatctattcatgagtattcataggtttatggt

SEQ ID NO: 622931 - DNA, 613 bp, Homo sapiens
  misc_feature (485)..(485): n is a, c, g, or t
tacgaaatgcctaatccgaaggattcccaaatcagaattaatcctcctacctcaatctcccggaatgttaaagtttgcgaacgtagggcgctactgctaacctgagtggaggtttttgtgttatttttaattagtttggaatactagaggcttgtttacttcgaggtgagtctttaattagggtacgattcgattttagagctggggggtgggccgagtttgctcccgggggtattgctatttcgggtggatggggtgtttacgcctttgggggttgaagattaactaaacgtaataactcgctcctgtgatctcgacgctttaaagaaccagaacgaacgagtcgcctagaatcgaagattcgaagccgacctaaccggcgtaatagggccccgtctctgctgggggtgcgggggttgactaactataataacgcctacctgtgatcccaactgctcgaagaactagaacaaagaggtcacttnggcccgaaggacgagaattacgaaatactagagtcacgccgctacgatcccgacctaaatagtgaggcccgagctcttatcttggggggggggggggggggggggacaaaccacctctggggaaagtc

SEQ ID NO: 622932 - DNA, 235 bp, Homo sapiens
  misc_feature (101)..(101): n is a, c, g, or t
  misc_feature (204)..(204): n is a, c, g, or t
taagtcccaatctactcttccgaagcacaattcatctctcctcaagggggcattgtaatggcttcatatttatggagtgtatgaaaagtacatatgggctntggggaaaatggctcttcaggcacacctatcaacacaaaccatgaactatgaaaacaaaatctagtggctatcttaatagacatgaaatgcgactaatcccangattcataatagacctttttttcaagccttt

SEQ ID NO: 622933 - DNA, 154 bp, Homo sapiens
caatcttttataatgagtcgggggaaactcccatctttttcaaatttgtatctaaaggagccattggattatcagttagcttgcaatgatggcccctaaattgtcaaaagtgtatatatagctccagaaatagagaataaaaagttcttgctta

SEQ ID NO: 622934 - DNA, 329 bp, Homo sapiens
  misc_feature (5)..(5): n is a, c, g, or t
  misc_feature (19)..(19): n is a, c, g, or t
  misc_feature (44)..(44): n is a, c, g, or t
agatnagttggtggtgctnacacgaattccctgccggtaaaagngaagatccgccaaatttttccggtaaagaacttagtaccaacattaaatgcctgatgaagcctgtcactcgaggctgtgcattgccaggtgaatattctttcttttataggtaaccatttataaatcattgtaacaagatggcagtggtttatgtatctaataacctgggattagctcagggtgacttcagggtgttgagattccaaaacctttgttttaaaatagaggtgatgttcctaaaaataattgtactctatagcacataagatgaattaattgactag

SEQ ID NO: 622935 - DNA, 1326 bp, Homo sapiens
  misc_feature (452)..(452): n is a, c, g, or t
  misc_feature (601)..(601): n is a, c, g, or t
  misc_feature (640)..(640): n is a, c, g, or t
gcactcaagtagcgcactaagctgtctaacttcagcgacttactagtcttgcgctgggctccggttgactgatacacgagcagataccactgcgatggtccccttcaggtgacattggacacaccactgagtgtgtagttccttcgaggaaggcagtctgtcactggatatgagtatgaataacgcggttgaggttcgcaatagttagtacaatcctataaaggcaacatgcgttcctgggctgtacctgtgccctattccgtagtcgtctttgagcggcgatctaaagttaccaacagccattcgcgagtaagtgtcagcgaagaagatgctagtttgatatacccctgagtacataatagaaggaagtactgaattgtcgcttgactacattggcttgcttgatgacagcgattaaactttgctcgcaccgtaaactagactccgacaantggtctcggcttattctctacaaccaataccatggagaaacccaagtgtcgcgaacgcatttggaagattaccatggattaagcacgggagatgctaagcatatggtactatggtgacccaccgcggcccaagggacgaaagggtgggncttctacaatggagtttcgaatggaggagatacacggtntctatgtggttatcataggaggaccagaccctaacgtggtggtgggaatgcccgaactttgaggttacgaagtggaacactttgagaagattgtgcggtggcggacatgaaagatggtgggtttgcggtccaagtggaaaagaatcgtcacacaaatagcgtgtgtgagagttcgtgaagattgacaggacaggcatattttggttagatgcggtaatcaaactgctcgtagattcatgggagtttgggagtcttgtcaaagaacacgaaaggaatatgcttaggtacaagacaggtgggtgtgaaaaattgttttgttttgggcttgcccgctgagataactctgtccgaagcccggtggtccaccgttcaggaccactgagggcatctctggacagcgtaacgaacaaggactacaggctgagatggattaaggccacggtccactggtgtttggtcgtgccccaaatccagggtgtgccgctcgatgtgagaagaagtggagagcgccgtagcggacaccgttatttcgtgtgaaacaacgttgaggcacaattacactggggcgggaagaggataacacagagccgggggttagaaaaagctggcgatagatagggagaaagtgttatgatttcaacaggggatatatataactctcgtgtgtttatttgttggtgtgtccg

SEQ ID NO: 622936 - DNA, 506 bp, Homo sapiens
tccaggatctagagcactatctaggtgcatcatgagtgctcagacatatgttttttaatgacatctgcttccctagtgcacaatatgttctcccctataatgtgtagtctatctttttgcctttggtgaaatcaattttttttgatttagcctttggtgaaatcaatttctatttcttctatgtttagcatgtgtgtgtgtgtgtgtgtgtgtgtgtgtgtgtgtgtactgaaactactgtgacaatgtttcttactttaattctatactacccagatctctgtgataaaaattatatatatcataaagatagagctgccctgaggctacaaaaaatgtaaataccctcctactctgacttcttcagtgtcaaagtatctcacagaactcctgatatatatccacacccgctatatgtatacagtttcttataacacttatgcggcaactatctcaatatgactacgacatgtctctcaaaatgcgcactttcaaaacacttcgca

SEQ ID NO: 622937 - DNA, 1044 bp, Homo sapiens
  misc_feature (31)..(31): n is a, c, g, or t
  misc_feature (39)..(39): n is a, c, g, or t
  misc_feature (735)..(735): n is a, c, g, or t
  misc_feature (741)..(741): n is a, c, g, or t
  misc_feature (744)..(744): n is a, c, g, or t
  misc_feature (749)..(749): n is a, c, g, or t
  misc_feature (751)..(751): n is a, c, g, or t
  misc_feature (774)..(775): n is a, c, g, or t
  misc_feature (789)..(789): n is a, c, g, or t
  misc_feature (793)..(793): n is a, c, g, or t
  misc_feature (802)..(803): n is a, c, g, or t
  misc_feature (805)..(805): n is a, c, g, or t
  misc_feature (1044)..(1044): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 622938 - DNA, 749 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaacaacacaaataaaaacatgttggccgcttgggccagtcgatcttgacttggccgttatgcatgcggccgcattcgagctctt

SEQ ID NO: 622939 - DNA, 629 bp, Homo sapiens
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatggtgaatcagaacaataccccaagcccacagcgtcataggtagaagcagggcaggaccacatccactaccggactgcaggggaccacatggcagacagctgcgcgaagtacacccaacgacatagtg

SEQ ID NO: 622940 - DNA, 801 bp, Homo sapiens
  misc_feature (708)..(708): n is a, c, g, or t
gagttaggctagtacgaggcgggtgtgaatcggccgagggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaacaaaaaaaaaaacaaaaaaacccggggtttttttgcgggggggggaaaaaggggntgaagggatggcaattggtttcggacccatttttttgtaaaagggggaaatgggggggcccaaaggggggggtaaatgaagccggtacgtagc

SEQ ID NO: 622941 - DNA, 3777 bp, Homo sapiens
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgcctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttgggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtc

SEQ ID NO: 622942 - DNA, 429 bp, Homo sapiens
tccttcctctcttctctctctctctctttcttctcctcctcctcctccttcttctttttcttttttttttctgagacagagtctcaatcttgtcacccaggctggagtgcaatgatgcgatctcagctcactgcaatctccacctccccggtttaagcgattctcccgcctcagcctcccgagtagctgggactacaggcatgcgccgccacgcctggctatgttttgtatttttagtagagactgggtttcaccatgttgggcaggcttgtcttgaactcccgacctcgtgatccacccgcctcggcctcccaaagtgctgagattataggcgtgagccactgtgcccggccgacatggggttttatcgggattacatacaggggagagagtccagcggcagcaggctggacaggagagctgccttat

SEQ ID NO: 622943 - DNA, 809 bp, Homo sapiens
cggacgcgtgggtcgacccacgcgtccggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaatattaccaggaacacaacaaaaacagaaaaacaacaaaacacacaaggacaccccaaaccggcagggaacagaaaggccccaaaagacccaggggggccaggaaccataggccaatagagaagccttacagggccgagctaacctgcccccggccccgggagccaccttc

SEQ ID NO: 622944 - DNA, 3938 bp, Homo sapiens
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgcctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttgggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattcctttgttgccagtgccaaaaaaaaa

SEQ ID NO: 622945 - DNA, 667 bp, Homo sapiens
gttcacaaaacttttagtttgctttacactcccttgccttcttttgactcacatcctaatgccagcaagtacttatatttttgctatttcagttctatttccataaaatttattttatcatcttttctcataaatttgtgccctctatttttactcccagtctgtttaagatgaacaaatcttataaggccacatagctgactgtgatttcagttggactccaggaaggagaacctaaagaaaagttcaagtccaagcagaaaccgtgattccttccggatgatggctcaagagtgccatttaattggggtgccacctgctgacctcagcaaatcccagttatatgtatatgttcacattacaggctcattagcccaggccgacctctgcatggatctcagaatattttctatggagaacatacatgataatgtctgatttcagaacaagaaagtaattctcaatagcaaggaaatggagtagggtagacagctagtaattaaactcacttgtgcgttaaaaagaaattaaggaaaaaagaaaataagagaacatattactaaataaagaaacacacattaaatatttgctatagtttcacactaagagaataaaggaaatgcaataaagtggcctgaaaggtaaaggatgagatgtgtaaaagagg

SEQ ID NO: 622946 - DNA, 636 bp, Homo sapiens
taaaaatacaaaaattagccgggcatggtgacgtgcacctgtagtcccagctactagataggctgaggcaggagaatcgcttgaatccgggaggcggaggttgcagtgagccgagatcgtgccactgaactccaacctgccaatagagcgagactccgtctcaaaaaaaaaaaaaaaaaagaaagaattaccttggaaaaaaatcccgcacttcagaggaaagcttatttcggcagggggtctttcaaagatagacatattgggaacgcatggtttcctaagccgattggtgcgtcgaatggcggggtgacgctgggctggaggcaatcgcccaagcggggggcgtgggtggtggtcaagaagcactgtggacgccacaaagaggcccctcctatagtcagctaggggctcccctttttggggcccagctttgggcgtcgacggggggattccaactagaccactttcggggctccagtcataggatgtctcatcagaggaacgcagttaccctggcatgcaaaattccctgaaatagagttgtctgcacagagtccacttctgggaccctcgggacgttggaagggccccgtccggggtacacacggttgaggcaccggcggaaaagacctgaca

SEQ ID NO: 622947 - DNA, 942 bp, Homo sapiens
ttataccccctggggctacaacctggggccttgcgatattggatatagcctagaatttttcttcggtaccattaggaagccactggcgattagaatggggaccatgaggatagaaggccttgctccgagggcccacatcctcccggccattgcccgccatccctgggctttcgggggccccggcctccaggccccccgggaggagaactcctagggctactaatcctcgctggaggcggtggcttctttatccgggaggacctggcggagggcctgactttgggagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaactttaaggaaacaacacaaaaaccgggtttttgggggggaaagata

SEQ ID NO: 622948 - DNA, 3254 bp, Homo sapiens
attctgtttcgcgactgttgacacccacacagtcttggttgagccagaagcagagcttcagtcatgctctctgggcaggccaatgattcagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgcctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttgggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtc

SEQ ID NO: 622949 - DNA, 250 bp, Homo sapiens
  misc_feature (39)..(39): n is a, c, g, or t
  misc_feature (67)..(67): n is a, c, g, or t
gtggtgactctaaggatcccccggggccttaaccctatngtcagtaggtcatcagagtaacctgatnggctcagcctgattcatattctacatgtagaagaaagagtaggaatagagctaaatcagttttcccaatgacatggatttctgtgatggatcactcagtgatttttctgtatttgtgctaaaccattgtgatgtaggaaggaagaaagtgaattggtagtgctgatttatggttaagggccgg

SEQ ID NO: 622950 - DNA, 759 bp, Homo sapiens
gttcacaaaacttttagtttgctttacactcccttgccttcttttgactcacatcctaatgccagcaagtacttatatttttgctatttcagttctatttccataaaatttattttatcatcttttctcataaatttgtgccctctatttttactcccagtctgtttaagatgaacaaatcttataaggccacatagctgactgtgatttcagttggactccaggaaggagaaccaaagaaaactttcagtctttttaagatgaacaaatcttgtaagtccccacatagctgactgtgatttcaggtggactccaggaaggagaacctaaagaaaagttcaagtccaagcagaaaccgtgattccttccggatgatggctcaagagtgccatttaattggggtgccacctgctgacctcagcaaatcccagttatatgtatatgttcacattacaggctcattagcccaggccgacctctgcatggatctcagaatattttctatggagaacatacatgataatgtctgatttcagaacaagaaagtaattctcaatagcaaggaaatggagtagggtagacagctagtaattaaactcacttgtgcgttaaaaagaaattaaggaaaaaagaaaataagagaacatattactaaataaagaaacacacattaaatatttgctatagtttcacactaagagaataaaggaaatgcaataaagtggcctgaaaggtaaaggatgagatgtgtaaaagagg

SEQ ID NO: 622951 - DNA, 645 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaat

SEQ ID NO: 622952 - DNA, 3753 bp, Homo sapiens
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgcctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttgggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtc

SEQ ID NO: 622953 - DNA, 660 bp, Homo sapiens
gaacaacaacaaaacaaaacacaaaaagacaaaacctcgctagtgaggcctggggtatcggacgagggcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaat

SEQ ID NO: 622954 - DNA, 992 bp, Homo sapiens
attctgtttcgcgactgttgacacccacacagtcttggttgagccagaagcagagcttcagtcatgctctctgggcaggccaatgattcagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagatagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtg

SEQ ID NO: 622955 - DNA, 305 bp, Homo sapiens
tcagtcacttgagtgaaagcataagtgtctgtgtgacgttcggctctaagattatggtgatatcatttcaaaacatgtgcatcgtggttgactgcatatgctttcgtatagatcccagaccaaatactacagtcacttcatctataacactgacaggtattgaacacgtcgaagcagatctgtcaatgtgcacccttcatttatgacaacaccctcaggtatctcccagcgtaatgcttgcaaaagctataagttcagctaaagctagagcacttcctccagatcagagggcttaagcaagaaag

SEQ ID NO: 622956 - DNA, 613 bp, Homo sapiens
  misc_feature (103)..(103): n is a, c, g, or t
  misc_feature (105)..(106): n is a, c, g, or t
  misc_feature (112)..(112): n is a, c, g, or t
  misc_feature (193)..(193): n is a, c, g, or t
caaatgctaggagcgaggcggtgggaatcggccgaggctgttgggataagatgcacgacaggatccctcctcacctctggacggctagagtctcactcccagntnnccaaangtgtcctccagaagcctcggtagaggcagcccaccaggagggagggggctatagctacaggaaggcaccccccaaatggcncaaagctagggtggccttgcagttcagcacacctagtcccttcccctccctggctccatgaccatactgagggaccaaactgggcctaagacagatgccccagagctgtttatggcctcagctgcctcacttcctacaagagcagcctgtggcatctttgccttgggctgctcctcatggtgggttcaggggactcagccctgaggtgaaacgcgggagcctaaattccaacgcggaaccaaggcttaaatgcggagccccaggtcttccctacctcaggcaggaagggcaggaaggagagcctgctgcatggggtggggtagggctgactagaagggccagtcctgcctggccagcgcagatctgtgccccatgcctgtcagcctgggcagcaggctgccaaggccagagtggccttgc

SEQ ID NO: 622957 - DNA, 629 bp, Homo sapiens
gagttaggctagtacgaggcgggtgtgaatcggccgagggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaat

SEQ ID NO: 622958 - DNA, 124 bp, Homo sapiens
ggaagagcggccatgaagcttacagtcccatctccgaggtatgttaaagaacgatggccgcatcccaaaccaccgctgcgactcccaggtgtctccagtacctgctggatcagctaaatcgagt

SEQ ID NO: 622959 - DNA, 234 bp, Homo sapiens
aatatggtgtgtaggggtgagtgtcaaagtttgattccactgggcattgagattcagaaatcataaagatagaaagcttttacccttaagcttttcataagttgtaagcggagagtcgtataatcagttagctgtgtctgtggaagtaacctattggactctcagtatgatctagtggtgttgggtgataccgggcggtggggtccatttgccaggaatttatcaatggaaggg

SEQ ID NO: 622960 - DNA, 618 bp, Homo sapiens
cggacgcgtgggtcgacccacgcgtccggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaat

SEQ ID NO: 622961 - DNA, 331 bp, Homo sapiens
  misc_feature (81)..(81): n is a, c, g, or t
  misc_feature (165)..(165): n is a, c, g, or t
  misc_feature (219)..(219): n is a, c, g, or t
  misc_feature (254)..(254): n is a, c, g, or t
  misc_feature (303)..(303): n is a, c, g, or t
  misc_feature (310)..(310): n is a, c, g, or t
cccagcactttgaattccttgaccggtacccactggcgaatctgttcggcgaacagcttcatgtagtcggtagaggcaatnaaaaagacctttacggccagtcaggcactcttcaacgtagctcagctgaggcttttggcctgggtgcagacggttgtgacgctncatggccaggccgtcgcgacgcagttcgttgaagctggtaacgctccagacgtnagcaccgatgttgaactgttcacgcaggatgatcngcgcttcacggacttcacgcaggatggtgccggagcccatcaagctgcncgtggtngccgcttccttggtgtcttcc

SEQ ID NO: 622962 - DNA, 617 bp, Homo sapiens
  misc_feature (7)..(7): n is a, c, g, or t
  misc_feature (25)..(26): n is a, c, g, or t
aactagnctaggtcgaggcgggtgnnggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaat

SEQ ID NO: 622963 - DNA, 221 bp, Homo sapiens
tttttttttactggtaaaccaccacatttatttggtctggagtgtggcaaacctcgggtaagacagcacagaagcagggtctccttcaggcggcccggggccccagctcgccaggcatgcaggacagagcgggcagatgagtcagaaatcttggggagcagcgccggggaagcagcaggcccggctccttcccaggcccaatcccgccagcacaagggggg

SEQ ID NO: 622964 - DNA, 142 bp, Homo sapiens
tcctgcaggttacaggtggaagggaggagacaggccgaggacaaatacgcgataaaaagctatcagaatctcagataaggggctggcagtcccttttatctatttcaagtctcacacaatatgtaccagatacaatctgtca

SEQ ID NO: 622965 - DNA, 212 bp, Homo sapiens
gagtttgtagtttctcattcccaagaatcagaagctactactggaagatgtacatcatctagattctcatgcataacactctagcttctagggtagagaacagactgctgaaagacaagaatagaaacagggagagcaggtaggaggatattgaaattgcccaggcacaagactagtggtatctcgacagcagggtatactaccagagatgg

SEQ ID NO: 622966 - DNA, 125 bp, Homo sapiens
ctagaggatcctataccgggtcctgggtactgagcaagctgtatgagaacttacccctcccaagttgcccaccaaatgccttgcaggcaggacgactgatgccatgaagatgctgagtggcacat

SEQ ID NO: 622967 - DNA, 866 bp, Homo sapiens
gataaatttcaatacaataatagctgaagacttcaacaccccactttcagcatggacagatcatccagacagaaaatcaacaaagaaacatcagacttcatctacactatagaccaaagtggacctaatagatatttacagaacatttcatccagtggctgcagaatacacattcttctcctcagtacatgcatcattctcaagggtagaggccatatgttagaccaccaaacaagtcttaaaacattcaaaaaattgacgttatatcaagtatcttctctgaaccacaatggaataaaattataaatcaataacaagaggcatttgggaactatacaaacacatggaaattaaacaatatgctcctgagtcactagtgggtcgatgaagagattaagaaggaaattgaaaaatatcttgaaacaaacataatggaaacacaatataccaaatcctgtgggatacagcgaaagcagaactaagagggaagtttatagctataagctcctacatcaaaaaagaagaaaaacttcaaataaacaactaacaatgcatcctaaagaactagaaaagcaagagtaaaccaaactaatgttagtagaaggaaaaataagatcagagcagacataaatgaaatgcacatgagaaaacataccaaaagattcagaagaaaagtgggtggtttgaaaccttaaactggcaatttaggcgataagaaaaaagaagaccaattaggtcgatgaaaacgggattgggatggatcgcggaaattcagggtcctaagggtatggccattttccggttgggagcaaaaagggtatatcaaaaaggctgagaacgggtttttggagtcaagcaagacgtac

SEQ ID NO: 622968 - DNA, 491 bp, Homo sapiens
aaagctgctgtactcgtccgtactcgctttatttgatgcgtgccggtgttacgcagcagatacttgggcagtcgttgtacatgaaagtgtggttctgtaaatactctaatgatggcactaaacgagcaacaggatcaaaagatacaacagatatcatatggcaagttgatccgagatacacacctgctaaaactgcttaaaacataagaaggacatgcttatggcgtatcttatatgcatggagtccagatgacaactatacttgtgcttgtggcccagatgactgctctgagctttggctatggaatagtaacaaacaggagaactaaagacaaaaatagagccagatctacatgaagacaagtaatgacaagtgtggcttggaatccagatgggaagcgctatatgtgactggaggtccagcgtagggcagatctatcagtgtgacttaatggtaatctccttgactcctgggaagagggtacgaagtg

SEQ ID NO: 622969 - DNA, 461 bp, Homo sapiens
gcctgtgaaagtgagggtctcctaccatgaagctgcttaagtactctttgctgaatgccctgaacgcactcggcccccctacacggctcacaagaaccgggtatttgtctccgctaccttcaaatgccaccaaagttctttcagttccactaagcctggactgggtggagtgttgggctccaggctttgccgccagggctacatacatgctcaaccttctcattcaccgcaataaacctcaattacctgcaactggactacaacttcaacctgcagcctgtgaaaacgctcaccaccgaggatagaaagacatctcgttttgggaatgctttccacctttgtcgggaagttctgcgtttgactaagctggtggtggatagtcacgtgcagtatcggctgggccatgtggatgccttccagctggcagatagattgcagtatatatttgcccatgttgggca

SEQ ID NO: 622970 - DNA, 1052 bp, Homo sapiens
ccaaatggcggatgacgccggtgcagcggggtggtgcccgggggccctggtggccctgtggatgggtgaaccgtcgtgtggacttcctgctggcatggtttcgtgcagtggcatccggtggccggggctcgcggccgtggacggggcctggggccgaggccgcggagctcgcggaggcaaggccgagggttaaggagtggatgcccgtcaccaagttgggccgcttggtcaaggacgatgcaagatcaagtccctggaggagatctatctcgttctccctgcccattaaggcatatcgagagatcagttgatttctatcctggcgggcctctcgtccacagcggatgacggttttgcgaatgatttattgcccacgtgcagaaagcagaccccgttgcccgggcccaggcgcacccaggtctcaagggcatattgtgtgctaatacggggacttaccaatgcgcgcacgtacgggtccttgggtgttaaagtagcttccaagggcaggttggctccaccgaccatcccgtggggcccatcatccctgtgccaagctactcgcatcggtcccccgttgcgcagaggcttactaggggggaacaagattcggcaagccaccacactgttcccttttgcacaggtgacatggccggcttgcgtgactcctgtgcatgggtacgcctcattcccttgcaccccaggggcactgggcatcgtctccgcaccttgtgcctaacgaaagctgctccatgattggctggatatcgatagactgctacacctcagccccgggccttgcactgccaccctggagaacctttcggcccagggccacctttgatgcccatttctaagacctacagcttacttgaccccgaactcctgtgacgggacacctggattcaccaaagttttccctaatagggagttcctggaccaacctaggtcaagaacgccaaccagaagtatccagggcagcgggacaaggcccacctgtagcaacacataggggttttatcacggagacacaggagaataacgggtttaagcca

SEQ ID NO: 622971 - DNA, 254 bp, Homo sapiens
gggaattctgaatgtcaacaaacacagagcccaaatagaagcttttgttcgacttcaaggagccagcactaaatctgaatctttacggcacgggccggacgggtcttcagccctttggccacaggcgcgccgcccttggagcagaagttgagaccaccccaatacgcgtataagagtgagaagagctctgggttttggtctgccccttctctctcgggggccccctctctggaacccccctctggctctcaggg

SEQ ID NO: 622972 - DNA, 386 bp, Homo sapiens
gagctcaggagtttgagaccatcctgggcaacatggcgaaaccctatctctacaaaaaatacaaaaattagccagacatggtggcacatgcctttagtcccagctactctggaggctgaagttgtaggatggcttgagcccacgagatggaagtcgcagtgaactgaaattgtgccactgcacttttcagcctgagtgccacagcgagaccctagataagaaaaaaacaagtaaaaacaaattgtgggtcaaagtaaatgtatacagcttgagtacaatgtaaccaaagttgtcacgcagatgtgtaataagtatccaatttaatatatcttaggaggagcacaggagacagaccttagaagtgcctaccaactcttacatgcttt

SEQ ID NO: 622973 - DNA, 1339 bp, Homo sapiens
tatatgtttcgtctgccgtttgttggtatcacatgtgcgctgtcgtcgctgcggcgaaaaaaaggggaccgcgccctttgtgtgggtgacgcaccatattgggttgttgtgtgtttttgagcgcgcttattgtagtgtagtccaagatgggggggcgttcgtcgtgctatggtgggggtttcaatcacttgtgggagggccgcccccccgcccctatttatgttgtgtgcacggcttgggggggtgattttattctgtttgtggtagcgtcctggcgggtggccgcatgacttggtgtgcgtgccgcgtggtgcgcgcttgtcccccgtattgttagttgcgtattctggcgtggttgtcgtcccctcgatctcgcggcgcgtctcctcgagagggtgtagttggtgtgtgactgggggatctttctggcccccgcgaggctttctcatacgcggggaggcccctagattgtgtgggcaagttgaggttgcctgggccttgtcaccggtggccttctttgaggcgccccctttgtgggagtgttcactgcgtgttctgtgtgtgtgccgcccggcttatgggtggggccctggagacgtggggcccgttgggtgaatgtatgccccccaacgtcctcttccctcctgatgagaccctttcgggtttgtttagtcccgccggaggcactcgcgtgtttgtatccgctgttgttgggggcgcccccctgtccgcgcgtatattgtttccctcatttcccacttttggggagcagccctcgtgatatgttggcgccactccacttatggggggggggctttgcagctgtctcacttagagttttctccctcgtatatttccccagggggtgaccacccgctggtgggagcccgatacactgtacatgcgccgcagagataccccatatttcccactgtatgctcaaagatattctataccggcggttacaattctcaacatgttcttgtctcgcaccacatacacactctgttctcggctctattccccggagaatgctccccgagtcgtgtagactcgggagcttattcccccgagatgcacatatcacccaccactggagaacacatcctatttcacatcttgtatgggctcacattctacatttctctaacacgccgtcaatatttaaattaattttcactgagatttgaggagagccttctgcttctgatagcgcacaaggtcctataatatgtatgagagaacccctccatttaaaccctggaggtgagctatattggagatgcccccccccctaccacacattcgaaggacccgctatacatataaatttagacca

SEQ ID NO: 622974 - DNA, 745 bp, Homo sapiens
  misc_feature (349)..(349): n is a, c, g, or t
  misc_feature (429)..(429): n is a, c, g, or t
tatcgagctggtaccgttagcccacaaggactcccaaagtactgggattacagcttgtgccacggtgcctggcctagtgcaaataaagttttattggaacacagccacgcccactggtaaggccaaacccacgtggcttttgtgctataacaacagagttgaatggcggtgatcaaggactgtatgggcctcaaagtctaaattacttaccagctggctgttcatagaaaccttttcggatccccagcctaagtcatcgcaggctgatggcacaggtctgggcttcccagtccttgtgtggctggctcctctctccccggattgcctgttccctgctttccagaagcangcaggtggcctgggaagaagtggaacctgcagggtgtcattctccaagccgatgctgaagatgcaatgccttcacccgcntcttctgtgctcttcatcgcacgggtgggctagagcagggaagatggactttcaggctggagcctggctttctgtggtgggatgttctgtgggtaccgagacccccttactgcatcttcagggacagaatctggcttgggttgagagtttatttggccctttctgatctgtaatcgggagagattgattgagctttcctgacacagacgtggcaaagcaaactggcagtggggcaggctttgccaaggctcgtcatggtagcggaggcctggacagagcacccgccaacagctgctgcttaaccaaggacagaatg

SEQ ID NO: 622975 - DNA, 397 bp, Homo sapiens
catggtgctcgcccccctcctttccaccacacaaagaagttgcttctcactaacagagactcacccccccctccctttttttccccctctgcttgttttcatttactaattgctgtctggcagcgacgaggagaaggagtaaaacaaatcatctccttctttgtgtttaattaaaaaaaaaatggtggtgggtaggaaaaatagatgtggtggggggcacaccaccacgaagattaatgagtgtgcaccccactgggccccgcctgttttctcctcggccgacgatgagacccctttaagcaagagcgcccctctctttttttttttccaaaaaggtttttattttgggggaccccccttttttttaaaaacaaaaaaaaaatttttaataaaatta

SEQ ID NO: 622976 - DNA, 859 bp, Homo sapiens
ggagtaggtgaacgctgacctggccgcccgccggacgcaagctggaggacgagtgaacggagctcaagaaggacattgatgtacctggagctgcacactggccaaagctgagcaaggcagacagcaagccacatgagcaacaaggtgcaagcaaccatgacggcaagagcatggctgcgcgtggcacgagtccagtggccctggcatgaccaaggcagaagaaggcaattgcaaggaggcccaccatacaggaccctgggatgacactgcagagccgaggaggaccaaatgtgacgagcgcatgactaagagccaaagctccggactggacgcaacagagtggagagaccatggcaatgcatccctggagacaggcagaagaagctgcgacatggacacaggagacgggcacacagcgcaaagcaggagaggtgaccatgaagactgacagcaggcagtcaggtggactgcatgctgcatcaagcaaaagcagacagctgaaaggagcaagctcaagaaagaaggactccgagctgagaccagactgagccatgcgaggatggaagacgagcagactcattggagggcccaggatgcagaagaaagatcaaaggagctgcaggcatcagagcggaggagcatggaagaaggagactggaaggcagaaacgggacagacacagaaccacagttgaaagacagcaagagaacacacagagggcaagaacaagcaagccactggaagagaaacctgacaccaacgacaggccgagaaagaaggcacggacacgaaacaatacagagagggaaaaagcacaaggccatgccagcaagaggaaaaagacaaaacagaagaaacg

SEQ ID NO: 622977 - DNA, 403 bp, Homo sapiens
aaaaccaatgactggcagctggtacgtgatggcgggcttgcctttatggcagctcgctgtggatggggagagcactggcattggagctagccaggctgggttaccatgtactcatgatacacctgaacctcagcttttcagcttcactgcacataatacctacctggcagagctgtacgggttagagagaagcattaagtgccagatatggaataggtgctcggtaatagtagctgttattgttcatccccttctcagaatacaggaaaaggaaatagaactttggttacagggttgtgggcccccatagcactaggaaaacacacccgtgtgagtacagtctctgttaataaaatggtccagcaacagagctgagttggttggcttgggccccagggccaca

SEQ ID NO: 622978 - DNA, 399 bp, Homo sapiens
gagtgcagccacggaatgacaacataatgagagttgtttgtgtgtatcactttttgcctgcgaacatgtactctaaaatgttggcagtattaagttgcaggtaatgaagcaatttttaatttcaaacatgtttatatatgttctgactctctacagaggacccaagggttatttactttaaaaaaagaatttccaaaactgggtatttatgtaaaaagcactggtagagatgttaagatacaggttctcgtaaggtatgtaaatagcttaaggtctgcactttatttcatatcccataggcacctctggaaagttacttgctgtgtatatttcttccacctcagagatgaacacaatagtaacggctcttattttatatctagagagtactttatagat

SEQ ID NO: 622979 - DNA, 139 bp, Homo sapiens
tggatcctgcatcacactttctgtgatagttgaggaggcgcccgtgatcaatactaacttgaaatgtctgtgttcattgcagaaccgtgtgtaatcagacttgtgtgaccgcggttcttcgtttgggctgaacacgtac

SEQ ID NO: 622980 - DNA, 135 bp, Homo sapiens
catcaatcttctcttccatctcctccatctccttctcatttgctgcatcctgcagcaatggtctatgcaatttccaacacaggcattctccaggcatccagccaacatcagcaacgcgcatgcacgtggcaggcc

SEQ ID NO: 622981 - DNA, 440 bp, Homo sapiens
  misc_feature (3)..(3): n is a, c, g, or t
gcntctctgcgtcgctctcacgactcccgagctggtgatgctttgagttgtcatccagacgggaacacgacaggtaccagtgtggcaggcagctcccggctgacctgaggttgccctcgcgggtcttgaggctgtagctggagcagctgttgtccaaccccccacaggccacaaagttccctgcgggcgcgtcggcacaggtcattacccaggcagcacgcagggggcatggtgtggcacttgttggtggtgtcactgtccccacatgctgagcttccccatcctgggcaggcgctgcaccagcagccttgcagtcggtccccccagtgcatggcatagatctttgccaggtgcccacggcgggtcctccgggtcctcatctggattctccccactgggtccagccccagctgtgcatctgggtcagcatgttgccgggt

SEQ ID NO: 622982 - DNA, 1099 bp, Homo sapiens
tccccccctttgtcctcttttttttttttttttaaaaacccccttttttgtttcccccccgggggccccgcggcccccgcggcggggaaaaaacatccgggggggggtcttgagaagaaggtggggcagcagagaaccccctcgaggaggagagagaaatgatcggagaaacaacatctctcctctctcacacaagaagatcgaagtgatcctgaggacgacgacggagcagatcatcaacaaagatcgtcatcaccacagagggtggccctgaggaaaaagaggctccccgaggggtggcagcgagacacccccgcgcgcgcggacggtgagtgagtgatgagaaccgacccacaagccacataacacacacaccaccacatctagatagaaccagacaaattcgctatttatagaagcgaaacacgtgagtgcgagcgagaacaacgaacgacgaaccaggaggcgcccccgcgaggggaagcagaatgagaagagagcgagtcggcttacctcccacacacaaaacgagaaagcaccgcacgaggagcagcacatctgactcacacatgaacgacgagaggaaaacactagtgctggggagagcatagacagactagcataatcatatagatgctcccccccaagaagaaaacttccttacaggatcacaacgtagggagggacaacaagatatagaggaagccaagcactgacaccaaggaaaagaatagtgcccccccaaagagcagagggcgggggagcggaccgccaccgtcgcttgtagagagaacatgactaacaccccaccaagaaaaccggtgtaggcgtgagaacatatgtagtaacccccccgaacagaaccaacgaaaaagctggctcctactacacctcgatgtgccagcatgagacgaacaaaaaaggcagagctgaagactaaaaaatcggaagggaaaaaaactatctctaaaaaacccccctcacttgtgtaagaggggcgctcccccagatgaaaaaaacaacactcgatcccgtttataaacaaatgggcggacggagagagagaaactactcaccaccgaggaggagaggcacgata

SEQ ID NO: 622983 - DNA, 178 bp, Homo sapiens
attcaatgtcatctctttcaaatgccccatgccatttttcacagaactagaacaaacaatccaaaacatttctatggaaccataaaagacccagaattgccaaagcaatcctgaggaacaaaaaccaatacagcggcataactctctcagactccagacaatattataaagctattgt

SEQ ID NO: 622984 - DNA, 372 bp, Homo sapiens
  misc_feature (138)..(138): n is a, c, g, or t
  misc_feature (150)..(150): n is a, c, g, or t
  misc_feature (157)..(157): n is a, c, g, or t
  misc_feature (164)..(164): n is a, c, g, or t
  misc_feature (193)..(193): n is a, c, g, or t
  misc_feature (211)..(211): n is a, c, g, or t
  misc_feature (228)..(228): n is a, c, g, or t
  misc_feature (275)..(275): n is a, c, g, or t
  misc_feature (285)..(285): n is a, c, g, or t
  misc_feature (294)..(294): n is a, c, g, or t
  misc_feature (316)..(316): n is a, c, g, or t
  misc_feature (357)..(357): n is a, c, g, or t
  misc_feature (366)..(366): n is a, c, g, or t
cctggggccccctttagctgtgaactgggcagcaaggccatcaaaagctgagtacagcaagggggcagtgagcttggccctcagtcccccccctccgcctcttggcctccgccctgcctgtgtttggggcctgggggnttttcccctcgntgttgcnccctggnttccagggtttgggtccctgccctcacgngccccttcccaggttttnggggccccttggacctnacccctagcaggaaggggttatgcaaaattgtcccaggttggggggnctccctttgngctccccgnccctgcctcctccccgatgtgnccccgctcagagcccttgggtttgtgaactttcaatgaaanacccatgcngctcca

SEQ ID NO: 622985 - DNA, 310 bp, Homo sapiens
  misc_feature (155)..(155): n is a, c, g, or t
  misc_feature (214)..(214): n is a, c, g, or t
  misc_feature (253)..(253): n is a, c, g, or t
  misc_feature (292)..(292): n is a, c, g, or t
agtctcactctgtcgcccaggctggagtacagtggcgtgatctcggcccactgcaacctctgcctcctgggttcaggcggttttcctgcctcagcctcccgagtagctgggagtacaggcacacaccaccacacccagctggtttttgtattttnagtagagatagggtttcaccatgtctcccaggctggtctcaaactcctaacctcaagtnattcttggatctctatcctgggcaaataaaccatctganttctcaaggggcttgctgtgttctggtcctgtggttgtnacaaggcttgaaccacct

SEQ ID NO: 622986 - DNA, 612 bp, Homo sapiens
cggccttgcacatctgccgtcctgcggaaccagccggacatggatggagctgctggtgcatcacggggccgactgttaatctggagtggacctggatccacgacgcagtagccccattgtgaccatgtgccagctgatgtgatgccatgatgctgcactgcgccctgtccgtgcaaggctgacacatccatgtgaccattggagcctgattgtcaattgcctgactgacaatggcatgtgaaaaacttgctctgcatccagtgctcttggccatgcatgcgcacggtcggtgcatgcatccaacaattactagatgacacattacgtactcattcacttggacagtgcaggtggccagacctgtcaatgtgccaccgacccaacagcatgcgggacacacgttgttcacactgcatcactcttcactgcttggtgagacctgtgggcagtgggacaaacgaggagtgcccagactgatcaacctgctatcctagctataccaaagtacacactggcatgactgctggcacactggtggccgagcaccagcgagtgcccagaccactgagtccctcacccacatctgcctgaagagctttaacttgacttaca

SEQ ID NO: 622987 - DNA, 352 bp, Homo sapiens
cattgtggtttgttgttgttggttcgttttgtttttttttttgtttcgagacacagtcttactctgtcggctaggctggaggacagtggcatgatcttggttcactgcaacctccgtctcccaggttcaggtgattctagtgcctcagtctcccgagtagctgggattacaggtgtgtgccaccacaaccggctaatttttgtatttttagtagagacagagtttcaccatgttggccaggctggtctcgaactcctgatctgaggtgatccatccaccaaaatctttgttaactattaaccctccttcctcttttttttgagacagggtcttcctcagttgtgcaggttgg

SEQ ID NO: 622988 - DNA, 212 bp, Homo sapiens
  misc_feature (8)..(8): n is a, c, g, or t
  misc_feature (20)..(20): n is a, c, g, or t
  misc_feature (38)..(38): n is a, c, g, or t
  misc_feature (78)..(78): n is a, c, g, or t
cctttttncaggcaaaatcntgcccctactcctcctanacctaacctcccattaaaagttattacctaaaaccatttntcagcccccaatttccccctccatcatcccctcaacccaaaaagggataattaaactttacttcctttctttttttttcccactcatcctaaccctactcctaatcacataacctattcccccgagcaatttca

SEQ ID NO: 622989 - DNA, 131 bp, Homo sapiens
ggctggccccgttttcaggctcctctccgtgaactcgaacccttatccccgtcacccgtgtgtgtgccgatgaatagcgatcgctattcatcgtgcaccgactgcattattttgtgatcgtggggttggta

SEQ ID NO: 622990 - DNA, 945 bp, Homo sapiens
ctagttctagatcgcgagcggcgcctttttctatggttttatatagggaaataaaaccacaactatattgggcccgacggattaaatttttctggtggaaaagagtacatcttcccaaactggacatcaaggaattgctacccagaaaaaccacatccaggataaaaaggaccagccagagctcgcttcaagaagtggtatttccaaaaatcatcggggagaacgccggatagcaaaattatccccgttaactgctgagaccacaatttacacctgtaactggtatttccataaatggagtaggaaagaaagatgctaaaatgtgatctggggaggagtcccccagtccccgcgaaaaagaagaagacaaaacagaaaagcagaactcacaaacccctgtgttggctcagggccaatgccccataaaaagggcccagtgtaaaaatacaacacaagccgcaaaacagtgaatgctaaaaaggaaggcccgggcaaacgggggggccgagcccacatcctcgtggagcgggaaaaggggtttagccccacggaccgttagggtcaaaacgtgtctgaaaaacaaccaaaagcctcccgtgccccggaggaaaagcctgcacaaacatcagatttaccagtcgcccaaagaccgatttcgaattaaaccttcacccccccaaagtcatttacaatggtaacaaattggccttatttgaaaaaaaaagcagtgtcccatataattcccagttgtgagaagaattccgaggaagtctctcggtgatcaggagttgaatctgaaaatttatgagacaaaagtagacaggcaggataaatgacgcagcctttctatacagggatcagtaatcgccataagatttgcttcttttgacagtaagatggacaacagggcaaggacggcaaaagacatggtgggtagcaatggag

SEQ ID NO: 622991 - DNA, 1036 bp, Homo sapiens
  misc_feature (51)..(51): n is a, c, g, or t
  misc_feature (77)..(77): n is a, c, g, or t
  misc_feature (90)..(90): n is a, c, g, or t
  misc_feature (93)..(94): n is a, c, g, or t
  misc_feature (105)..(105): n is a, c, g, or t
  misc_feature (115)..(115): n is a, c, g, or t
  misc_feature (124)..(124): n is a, c, g, or t
  misc_feature (140)..(140): n is a, c, g, or t
  misc_feature (142)..(142): n is a, c, g, or t
  misc_feature (145)..(145): n is a, c, g, or t
  misc_feature (157)..(157): n is a, c, g, or t
  misc_feature (163)..(163): n is a, c, g, or t
  misc_feature (185)..(185): n is a, c, g, or t
  misc_feature (222)..(222): n is a, c, g, or t
  misc_feature (231)..(231): n is a, c, g, or t
  misc_feature (242)..(242): n is a, c, g, or t
  misc_feature (246)..(246): n is a, c, g, or t
  misc_feature (257)..(257): n is a, c, g, or t
  misc_feature (304)..(304): n is a, c, g, or t
  misc_feature (322)..(322): n is a, c, g, or t
  misc_feature (326)..(326): n is a, c, g, or t
  misc_feature (352)..(352): n is a, c, g, or t
  misc_feature (355)..(355): n is a, c, g, or t
  misc_feature (364)..(364): n is a, c, g, or t
  misc_feature (428)..(428): n is a, c, g, or t
  misc_feature (434)..(434): n is a, c, g, or t
  misc_feature (443)..(443): n is a, c, g, or t
  misc_feature (481)..(481): n is a, c, g, or t
  misc_feature (485)..(485): n is a, c, g, or t
  misc_feature (556)..(556): n is a, c, g, or t
  misc_feature (683)..(683): n is a, c, g, or t
  misc_feature (838)..(838): n is a, c, g, or t
  misc_feature (858)..(858): n is a, c, g, or t
  misc_feature (889)..(889): n is a, c, g, or t
  misc_feature (953)..(953): n is a, c, g, or t
  misc_feature (1020)..(1020): n is a, c, g, or t
ggggaggcgagggttgggccagagctatgtttgaatgggccatcattagantgagcagatctccttggtatcttganttatcagctggtnttnnggagttaatgnttggtgtggntgataggtnttgggatgcggatatncnggnctctctccagangccgtncacaatcaatcaaatagtttantccatcgatgaccagtggcaccagccccacctctganttgcctagncggtccaaatnaganatatcaaaganaccgcctgtggcagcagtgtccactcctccagtaccacgcttttggngtcttaggttctccaggntctncgggaagcggctatctttgcctagcnggngcagtctgncgtgcactcctgcccgacgtccagtccccaggttagatggacaggtcaagacgtatcccaaacnctcatnccacatganctcccagccacgtccttggataagtctctccacctctntgangcctcggcagaatctttcaaacactctcttcatgtcaccacccttctccatggagatcacccgtgtatgancctcctcattcacccagatcaggaagctcttctcattgttgttccaaattccacgagcatctggccagtctcgagccattcctgctgcagtcagcaacggggacacaggcttatcaaacagaaagtngtcatcaataagctgctgctgttcagcctctgtcatctcactgagcctatagtaacgtccagccaggtcacccttcaggccactcagtgcatccaccacaacacgttccacctctcgtcgctctgctcgagttcaagccggaggcagactgagtnctcggatgcttcggccagtnctgactctagaggacaatacatacctctcancaaagtagccagaacggattttactggcatctagatccgtggtgtgcttcaatgtccgggggtnatatccattgtgtcgctcttggatcacagggtcaaacaggtcagcaaatacctcataggtctctcanctcagccaccatgcac

SEQ ID NO: 622992 - DNA, 534 bp, Homo sapiens
tacgtgggtgcgagggcgctcctccgcgggcataatcagtacgcccacgactggcaaagattacatctgccctgaaccgaggacctgagctcctggaccgctggtggacacctgtggctcagatcacccagcgcaagtgggagtgcggcccgtgaggcggagcagctgagagcctacctggagggcctgtgcttggagtggctccgcagacacctggagaacgggaaggagacgctgcagcgcgcggaccccccaaagacacatatgacccagcaccccatctctgaccatgagggccaccctgaggtgcttgggccctgggcttctagcctgcggagatcacactgacctggcaggggaatggggaggaccaagacccatggacacggagctcggtggagaccaggcctgcaggtgatggacccttccaggaagtgggcggcttgtggtggtgccttctggagatggagcagagatacacctgctgtgtgcggcatgaggttctgcccaagcccctcaccctgagatgggagg

SEQ ID NO: 622993 - DNA, 123 bp, Homo sapiens
cggtgactcagaatctttggttgaggcctttttttgctttcttcttcttttcttttttttctttgtctttttttctcatgtcggatttcctcttctccttcttgctctttgggttgctttgat

SEQ ID NO: 622994 - DNA, 2692 bp, Homo sapiens
gacccacgcgtccggagacaagatggcgttgcgagcgatgcggggaatcgtgaacggggccgcacccgaactgcccgtgcccaccggtgggccgatggccggagctcgggagcaggcgctggcggtgagccggaactacctatcccagcctcgtctcacctacaagactgtctctggggtgaatggtccactagtgatcctagatcatgtgaagtttcccagatacgctgagattgtccacttgacattaccagatggcacaaagagaagtgggcaagtcctagaagttagtggctccaaagcagtggttcaggtatttgaagggacatctggtatagacgccaagaaaacatcctgtgagtttactggagatattctccgaacaccagtgtctgaggatatgcttggtcgagtattcaacggatcaggaaaacccattgaccgaggccctgtggtgctggctgaagacttccttgacatcatgggtcagccaatcaaccctcagtgtcggatctatccagaagagatgattcagacgggcatttccgccatcgatggcatgaacagtattgctaggggacagaaaatccccatcttttctgctgctggattaccacacaacgagattgcagctcagatctgtcgccaggctggtttggtaaagaaatccaaagatgtagtggactatagtgaagaaaattttgccattgtgtttgctgctatgggagtaaacatggaaacagcccggttctttaaatctgactttgaagaaaatggctcaatggacaatgtctgcctttttttgaatctggctaatgacccaaccattgagcggatcatcactcctcgcctggctctgaccacggccgagtttctggcatatcagtgtgagaagcacgtgctggtgatcctgacggacatgagctcctacgctgaagcgctgcgagaggtttcagctgccagggaagaggtccctggtcggcgaggcttcccaggctacatgtataccgacttagccacaatctatgaacgtgccggtcgagtggaaggtagaaacggctctattacccaaatccctattctcaccatgcccaatgacgatatcactcatcccatccctgacttgactgggtacattactgagggccagatctatgtggacagacagctgcacaacagacagatttaccctcctattaatgtgctgccctcactctctcggttaatgaagtcagctatcggagaaggaatgaccagaaaggatcacgctgatgtgtctaaccagttgtatgcgtgctatgccatcggtaaggacgtgcaagccatgaaagccgtggtgggagaggaagccctgacctcagatgatctcctttacctggaatttctgcagaagtttgagaagaacttcattactcagggtccctatgaaaaccgaactgtttatgagactttggacattggctggcagttgcttcgaatcttccccaaagaaatgctgaagagaatccctcagagcaccctgagcgaattttaccctcgagactctgcaaaacactagtagctgctgctgcttgtgtggcgtgaccctcttgtgaagtactggttctgtttcctgattccttttgcactcctccatcccacctgtgagtgggagtttacctgttaccctgtaattaaaaacaaaggctaggtaactattgtgccagtgttgacagtttaaactgctaacagattgagagatccctgctcagaaacctcacctttagtgctttctttaaagaagctgaggggtgaagtttgcttactgatgtatctatttgtacagatagtggagagctagttgctaataatgtcttgtttgggtctcccaaaccctacctctcaactcccttaagagtatcactgttctgaagctaaaatgcttcagtctcaaatttaggggcaaagtggagactggaagaattctcctttcagaagaaccacgaggctctggctgagcctccctctggagtgctagtgtacctgtgggtctgtcctctgctctgtgcagatgggttttactgtctgctgtgttttcttacgaaaagagtttcgttctgccagtgctgtgagttgggaattcctgcgtggcgactttctctgaggcccacagagaatcaggtaacattgcacagcctgcgttctcctgcagtggtggcacgccttgtgctgacgacccccactgggctacagtcacaggagaattgagacttggaaaaggcttgggtacaattaagaaaaaccctacatcccaccctcctcttgacgcgtttctggtggtttcggtttctgcgttgccctccagatcctgaggtgggccgtgagacgacttgctttaaactgtttaatccccaggctttctgagtccgctctaccttttctgggtgatcttgtggcacatgtagcaatgtttctttcattcctgtcccttcctggcttgagctcttggctgtattctgtgtgcctctaccatgtctgctgtttgggtctctgcgctgtgtgttctcaggtgcagccatgactccccactctgtgcattccaccttccagttgtttttctctgaggggatagtgggggggtcagcatgattatattttaatgtagaaaatgtgacatctcgttataaatgaaaataaatgttaaattaaatgg

SEQ ID NO: 622995 - DNA, 1329 bp, Homo sapiens
gagagcgcagcgcgcacgcccagcgagttccagagagcgccagtggaagctgcggcggcggtgtctcgcgttcggcagggatttctacttcgactccggctctggcctaggtctacgtccccagctccagccgccggctcggactctggtctctgacgcccgcaacatcggttccccatagtccgggccgcaggatctgggacacataaaaaaattgagaacgaagaaagaaacgaggaacccacgcacccgacgaacgaagaagaagagaaagcgacgacgggacggcacacacaagcagacggcaccgaacccgccacgcacaccggcacgggcacagagcacagcccaaaacgaggaggaatcaccacaaatacaacaagacggcaaccagcgccgacaccgaggggacacaccaagaccagacgacggaccatagcacagaagacacagggacgacacaaacccgaacaacaacagcagcaaacgaaagattggcaaccagaacaaacaccacaaagcaagacgaacacggaatacaacggacaggaacaccacggaagaggaaaccacgcagcgcgcacccacgagagaaggcccaccaaaacgaccccaacgcaaccgcgacgaaaacgcaaacacacaaggagaaccgagccagacgagagcgggcggagaggccgaggaaggagaggaggggagaaaagagaggagaagcaaagagcaggaaaacaggagaacgggaacgaaggacagacagcaaaaacagagcaacacgagagagaggaaagagagaccaacagcgagccgggcacggagagcgccgcacacgacgcacgcgcacgacgagacgacgaaggcggaggcgcgaggaggcagagagagacaagggaaagagacgaccgaccaggggacgagagcggggagagaaacgggacgcagagacgccagaaagcaggaacgaaagagagacgagagacaagagggaccgggaggagaaggaaaaaaagcaggagaaggaagaggcgaagagacggaaggggctgacaacagagcgggggcgcgggggagagcgggcgcagcggcggcggagagcgacgcgcgtagagagagaggaggaggaagaggaggaacggggaggccacgaccggcgggcgaggcgagggcggggaggagacggcgaggggagaagcagggacaacgaggagaagcgagagaccgaggcccgagggacggagggcgcacagggagcgaagcgagaggagacgcgcgaggggagagagagggcagcggagggcggacgcgcgcgaggggcggaaggacggcgac

SEQ ID NO: 622996 - DNA, 151 bp, Homo sapiens
ggagttctagaccagcctgggcagcatagtgagacccccatctttataaaaagaaaaaaaatacattaaaagaaaaaaacgaactattcgtgctttagctgaagctcagtaatgacagttctgtctcctgtcccgcgcttccttgttcctg

SEQ ID NO: 622997 - DNA, 1256 bp, Homo sapiens
agagagaccccggagccgaggacggagagaggaacgcgcagaacagaccttgagggaagacccaggcccggcaagaacatggacggttggaagagaggaatgaaagtgtgtgaagtttcattgaatcatacagatccatcctgaatggacattattgcagccatgtgcaagatgggggactgaattgacgatggagatgtcgggggacacaagattgataacataagagtaagagccatatatccagagggtgcatacatcacatggaatcatcttgatatagacacaagattgaggttcaaataaattatagacaagaatgagggatggtcattacaactacttttaacatgagatggagaatataaaggatagggaaatgcaatgagagtgggagcctttgcaaaaagggaaaagaacataatatggttatatattgaattcaaacagatgtttgaacaaagtattgtatagtagttattaattaattcaatttgataagagtatgagaagagaatgaggacaggcacgtgcagcaactattggaccgattgagacattacactggcatggataatcaaggacagcacatgacgcggggtgcaaagtagctcaaagaaggcactataacgtaaccacgcctagacagtatcaaccagagacaaagacacagaactgctaagagaaacctcgagcccccggaacacacacagacagagagcaaagcaagcaatgaacaaggtacgcagatcacacgtgagcacacaggcgaacacgtgcacggagcacaggcattgatcgacatcggtaggaatcttggaataaggagcgcacatagcaaatcagagactgatcacagccacagacactagctgacggcgacgacgacgtcaagaaacacgacacaataccactaatcgaacacgacacagacaacacagaacgaaagcacgacggaaggacacaaggacacaggaaaatacggagtggatcacaacgagacgaggcgacacgaaatgagcagcgatcaccagcgcgagcaacaagaacagatagagaagagagatacgacaactagagagaggagcagaagtaagcgaaagagacccgacaacaagatgaacgacgatacaaagagcagagtgaagaggaacccactacggatgatacagcggaagaaagacgaagaagcagaagaaagagagaagcacacgagcagaacaaaagaaaatcaagagaacacaagcaatatagcg

SEQ ID NO: 622998 - DNA, 111 bp, Homo sapiens
ctcatcaacttggtgagcagactgacaggtcttcaccagtaaggctgcttggtgagagagaatccactagcagtattaccgtataaagagcgtacaggggggtcgttatca

SEQ ID NO: 622999 - DNA, 448 bp, Homo sapiens
  misc_feature (8)..(8): n is a, c, g, or t
  misc_feature (32)..(32): n is a, c, g, or t
  misc_feature (128)..(128): n is a, c, g, or t
gtttatancctactttttacaaaagggttacncttggcagtctacccttgggatatgggtgattcatccctaccccaagaaagcctacatgtgaaaggaaagaaatgtactatattaacctacaaggnaatcaaagacgcaagaaaaatgttttaaaaaatatatattgggccgggcagagtggctcacacctgtaatcccagtactttgggaggccaaggtgggaggatcacttgaggtcgagagctcaagaccatcctggccaacatggtgaaacccccgtctctactaaaaatataaaaattagctgggtgtggtgcgggcgcctgtagtcccagctactcgggaggctgaggcaggagaatcacttgaagccaggaggcggaggttgtagtgaaccaagatcgcaccactgcactccagcctgggcaacaggagcaaaatccgt

SEQ ID NO: 623000 - DNA, 590 bp, Homo sapiens
gagcggatgggagccgaggcgggccgcgcggtgggcgcggagaggagcgcgagcggcgcggctaggccgggcgggtggcggcagcagcggaagaagccaaataacgagtcgcagacacgggacggttaggacgagtcttgcaaaccatgccgcatacacaggtgtgcatgatcagcggtattctcagaattccaagatggagcctacggctcgaaactctcgaacggcgatgggatcatgctgatccttgaatgtatggtgcttacgtaaccaagaatgcgtccaagctatgttgttcgacgatgttcacaggttgcagtccaagtggattacccgtgcgattgaactcacgctcgcgcaaaggatgaatgtgttgacaacataatggtcgatagtcaccgtctctatcagtgtgcatgcagcgacgcgcgtcaaaggattgttgaccctttcaagctatccttcagtactagggcagctgcgcaagcccaggaccctgtgccggataagacgtcccatgtacattcaatgctacctgcagaggtaatgctctgtgcttggagaacccgatccgccgaaggacctcagca

SEQ ID NO: 623001 - DNA, 246 bp, Homo sapiens
acgagtcacacccaggaaagagtaatcaaagtaagctcaaaacaaatgatagacagtacacaacactgagaggacgaacctgagcgtgcgtgatagctagtatccttgatcatttttattgccacaagtaacctcctcggactcctgcctcactcatttacaccaaccacccaactatctataaacctagccatggccatccccttatgagcgggcgcagtgattatagataggtggtaaatggcg

SEQ ID NO: 623002 - DNA, 392 bp, Homo sapiens
  misc_feature (1)..(1): n is a, c, g, or t
  misc_feature (290)..(290): n is a, c, g, or t
nttcggcacaggcggacgccgagagcgtttgtctccgtctctggagttgcaggcgagaggtgatcatgtccggtcgcgggaaacagggcggcaaagtgcgagcaaaggccaaatcccgctcctcccgcgcggcctgcagttcccggtggccgagtgcacagactgctgcgaaagggaactacgcggaagtcgggcgccgggcggctcgtacctggcggcggtgttggagtaccttacggcggagatcctggagctggctggcaactcgcgctgatcaacaagaagaccanggataattccccgccaccttgcaagctcgccatccgcaacgacgaaggaagttaaacaaagctgctggggcaaaagttgaccatccgctcagggcggcgtcc

SEQ ID NO: 623003 - DNA, 653 bp, Homo sapiens
  misc_feature (174)..(174): n is a, c, g, or t
tcatggaggtgagagtgtagtggaggaagcagacagtaactgcttaaatactcttgggactacatgcaaaattacaacggtagtaaatgagtgcttcagtgaagggataaacactaacatgagatttctgagggtatttcaccagtttgtttttgggagtggaggtggcatcantcaggaaaggaaggaagaaggaaagtttcaggcagaggaaataacatgtgcaaaggcccttttgtctatgaaggaggcaagagcagcccctgcaacttgggagtgcagagagtgaccatgagcatggtgtaagtctggaaaatgtataaatcttgcagatcatgataagagttttggtctttatgccaggagcagtgggaagccatggaagtgttttgttttcatttgtaaaaggagcttagtggatgagggcaaaatgatcaggctttagtttttataagatatcaggaggtggtatggtaaataggttgggtggatggagttagaatccagacagttccttaaggagacttttgcagttctcaaggcaaaaaataatgattggagtgggatgataacagcaaagacaaagagaaatctaaatttgagaaaaattagagaatgtaataaacagatgttgtgatggattgatcatggac

SEQ ID NO: 623004 - DNA, 257 bp, Homo sapiens
cacacacacacatacacacacacatatgtgtatgtatacatgtgcacacacttacatgcacatactcacctgcacacacatgcaggcgtatgcacacattcgcatgcacacttgcacacactcgtacacatacacatacaggtacacggcatacacatgtccatatacatgtgcacacactctcatacacacatgtacacatgtgtgcacgcacatacaggaatgtgcacatatgcacgcaggcacatggtcgacgc

SEQ ID NO: 623005 - DNA, 268 bp, Homo sapiens
tggtaagcaatgtcaagtttcactgattacgactacagttttggtcttacgattaccattattgtccagtatagttctcaaaaaacttgaggtcccagaagtacgaggctttatgagtaaacgcaaaggtacataagataggagaattttcaagagccagtgtcacgttatatcgtaaacgtcatcgaggttgtcacgaaggaaatactttgtaagtcacccctcaagaggaaggtcgagacggggtgaggacggaaagatgtgaaca

SEQ ID NO: 623006 - DNA, 668 bp, Homo sapiens
ttcagcgtaaagcttttcacagttgtgcataaaattttaataccatgtagtcagaggaaaggctccgggcatactgtggacacaggatgtacacagctgaaacctttagcccttccctgtggcagcagccaacattttgctgcattctgcagtactgaaccaactcatcattttgaagcaagctccctgggaaatatgtaagtgaataatgctgctctgtgatgaattacggactgaacacttcctgtatgtaacaggtggtgcgttaccatgatgtccgacaaaatgtccagctgaaatactagccccacaccgtgacgaaacgcacatagagctcaggctcagacctattgcctgggcccagccttgaaaagacagggaccaagaatggcctgggcatttgaaattgcttagcagccaaatggcttattggtgagtaccatcaagctgaagggtcaatggaaaaattctggaaagttcaactggacctagtttaagcaccaaagtcaaattttttaaaaatgagggcttgtgttttaaaagaacccaaggctttttgtttgtcaatatgggcctggggagattttaggctaaataacagattcccagatctttccccaaacctctctttccttccctttccgagactttatttaatcctgtctctg

SEQ ID NO: 623007 - DNA, 422 bp, Homo sapiens
cactacctggacttctccgggaggattcacatttccaaagccacgctggactgtctcaacggtgactatacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatgtaagtcctctcttcctccttctgcttggccatgaatgcatgctcgtgtgcatctccaatccagacacctcagagaaaactgattcatctttaaccttttctccaatgaacaccataattgcaaatgatcaa

SEQ ID NO: 623008 - DNA, 688 bp, Homo sapiens
cgtctccagtgacaggcagccaccatgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcacggcccattcttcaccagcgaagacgaagatgtgttcttgagatcctgaatttgcacgttgtccgaagattatac

SEQ ID NO: 623009 - DNA, 718 bp, Homo sapiens
cgagcctccgtacaacaatacccctgatggagtgatgggtggaagaggctaggaatacgcattgagacggattcgctgcctggtgtattataactctgatatacccggaatggatgtgagcatcaaccatgcttctaccctacactgtgtattaggagagaataggtacttaaataataatcacaacctataccctcaaaggacacatgagagagagagcagctctccggggattaataaaatagtaaatagttcctatcatggcagaactgacactagtggaagacatgctatagatgggagtccacagctgtgggtctcacactgtatctctttcatttcttggagcaactaggacctcgtgagcacataaacatatagaggtcacagtgcagctatagcccgcatactcccttccatgaagacttacctacaacctgcagcttgtatgtccaaattaaagaggcgcattgtttagacagacactgtaatatgtacacaggggtatcccatctccttttaacactcaagagcactaatgtgaaatgttatcgtgtgtaataagacgcacacttgaccagatacagagtgtcactatccaaacttgtaggcgtacatagatgcgcgctctaccaaatttatctgagcaagatacacactttcgaagtgttactcacatagcaccctctctgaggtgcaattttgttgtacgggcggg

SEQ ID NO: 623010 - DNA, 1021 bp, Homo sapiens
  misc_feature (1020)..(1020): n is a, c, g, or t
tcaggacctgcctcctaatccccttacttctctgtccatctcccttcctgtcccatttctcccctgtgtgcttatttctcccagtctcatagtgaagaagcaccgaatgagcatcggcctgccctggacttgataggggatagcatgatagaacatagacgagggaagctgggagctggagggccatctgttatatccaggccagaacataatcaagagaaacggccaatcaagaaagagaccaccgggaataacagacttagaagcaaacggacataaagagaaagaaaaacgggcacaacacgactggggcgcaccgcgcagccaagcagaccaagagcaacagtcgatgaggaaccaccccaggccactggtaaacttcacaccctgatacaccgcccagaagagccggcaagcacgtgccacggcatggaagaagccaaaacacaaaaaagaacgacgcaacaacccaacaagagcaaagcagggaacgagacgcaaaacgcagaaaacgtcaaggaggggagaagctcgcacgacccgacaggcaggaagcgagcatgacaaaagagctagcacaagaagagagccgacaagacacccgatggccccaacgacaacaaagcagacccagggcacactcagacagacagcagtcctgagacacaaacagacaggaaacaaacagacacggaacagaaacaaccgacgacagaagaaagagcaaagcagaagactaggaacagccacaaggaccaagcaacaaacgaaaagacaggcgacagaagagcgagcacaaacgaccgaagcagcagaacgaatacgccaaaggatcagaactggagagcagaacacagagcaagacacaacgaaaagcaaacagacgaccgcagctaggacggcaagaaggagcgacaacgcaaagcacaagaagaaaagcaagcgagagacagaagaaccaatgaagagagaaaagaggaagagaacgaagaaaaatagtggcactgtcacatgaggacna

SEQ ID NO: 623011 - DNA, 415 bp, Homo sapiens
tagaactcgagctggtaccgtcgcgaatgtgtatcccaagctgctcagcctccttgagtagttgggattacaggcgcgccaccagactgcagcgtaatttttttgtgatttttagtagacgacggggtatcgccatgtaggccaggatggtctccatcttctgaccgtcatgatccaccggccttggcgtcccgaaagtgctgggattataggcgtgagccaccgtgcctggctgaaaatttttcttttagtcatattttccatgcagctgtttagcacagtactggacgttatatacgaaagtgcccaacccagggcttcacttgcagagacaaaaccctttcatctctcaagggacttcccaggcccacaaagccccacaaaacttggtattgcacaaacaggtggcagcccc

SEQ ID NO: 623012 - DNA, 111 bp, Homo sapiens
tagttgtagtggaggctgctcctgtgtgtctggttgcgctggctgcagaagcgacagtcttccctgttgcccctgccgtgggcccttggagcaggaagagcagactcagca

SEQ ID NO: 623013 - DNA, 159 bp, Homo sapiens
gcatctgtctttcaactcagaagctccaatgagaatttttatggtgataaaatactgaatacagccacagagccctataaaataaagtgggtttactaagcatagaaagatgggctgtaagagcaatgtgtacagctatggtgtcacctaggggctcag

SEQ ID NO: 623014 - DNA, 778 bp, Homo sapiens
  misc_feature (33)..(33): n is a, c, g, or t
  misc_feature (74)..(74): n is a, c, g, or t
  misc_feature (83)..(83): n is a, c, g, or t
  misc_feature (97)..(97): n is a, c, g, or t
  misc_feature (102)..(102): n is a, c, g, or t
  misc_feature (140)..(140): n is a, c, g, or t
  misc_feature (151)..(151): n is a, c, g, or t
  misc_feature (158)..(158): n is a, c, g, or t
  misc_feature (162)..(162): n is a, c, g, or t
  misc_feature (177)..(177): n is a, c, g, or t
  misc_feature (184)..(184): n is a, c, g, or t
  misc_feature (191)..(191): n is a, c, g, or t
  misc_feature (202)..(202): n is a, c, g, or t
  misc_feature (207)..(207): n is a, c, g, or t
  misc_feature (212)..(212): n is a, c, g, or t
  misc_feature (229)..(229): n is a, c, g, or t
  misc_feature (231)..(232): n is a, c, g, or t
  misc_feature (238)..(238): n is a, c, g, or t
  misc_feature (240)..(240): n is a, c, g, or t
  misc_feature (242)..(242): n is a, c, g, or t
  misc_feature (308)..(308): n is a, c, g, or t
  misc_feature (353)..(353): n is a, c, g, or t
  misc_feature (384)..(384): n is a, c, g, or t
  misc_feature (456)..(456): n is a, c, g, or t
  misc_feature (736)..(736): n is a, c, g, or t
caagacttgtgattaaggatttaaaaagagcancgctgcctgaataaggctctggcagtctaaatagatgtagnaaagaaggnaaaattgatggaancatcnaaaatccatcctccatcattcctgctggcagaagcccngcctttgcaangtaatanagtnaaatatgtagcaaanactggcntcattcnaatcacagggnggatnctgantggtctaaatcaatcangnnggcaanangncctatgaagaagcatggctgaggtatttgcatatagacccaattttggccaatgacactggcaganaagctgtctggagggggagggtaggcttttaggggagcagttaanagtcaacatcctcttttctttgtggaccaanaggtgatatctcaagtctgcccaactctgctggtcttgtcacagtggaaagcagaatatccctgacctgacncagcccacagctacctcatgggtaactggggaaaggagggctgagtagaacagcaggcacctgggcaggtactccttcaaacaactttctttaaataattatttaatatatggagtcaggttgacaaagattttctattaatattttgtttactagaaacaaactaacttgaattcattttctctaactgaagcagagtcagtattctgaaaataccagtcagttcatttctcctgtagctctcctcttttcaagctctctttcataatttttggaacanacaagttccttaggggcacctgaagagctcacagtttaagga

SEQ ID NO: 623015 - DNA, 265 bp, Homo sapiens
catggctgtgtgcggcctggggagccgtctttggcctggggagccgtctttggcctgcaagggtgcttcggcgccgccaaggttccctgtatccccgtttccagagccgcggccctcagggggtggaagacggggacaaggccaaagccttccttgaaggaaacccaggatccccaagatttaaaccaaaacgggagaaaaagggttttctagtaccttcacaggagaagggagccccaaaagttgcccaagtgtttgacgccgt

SEQ ID NO: 623016 - DNA, 1856 bp, Homo sapiens
agcgggggggctgcgggggaggctgcccggaggaggcagcggcggcggcagcgcgtcctcgcgtccccaggaccacggtcttctttcctgccagatctatccatctggccatccatcccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 623017 - DNA, 680 bp, Homo sapiens
  misc_feature (109)..(109): n is a, c, g, or t
tagtagaatccacctgtcttttttgaaatttgaagccatccccaggcttaaaatcttgtgtttccagaaagacccgtttatacccatgactgcttaattatcccccccnagaccttctgattgaagtccatgtaccagttccatggccctaaattctctcgcccgttttaacattgctcttggccacagcctcatcttcttgagaaataaagtgtatttttatgtggtcacaccgtgtgatgtgtctctcacaaacagagctttggtgtccccccacggcttttgggctctcataggagaaagagggagtcccacacactggggagacacactttgtggagcaccaccactagactctccacaaagagatggtgagacctggagctataaaccaacctcttataccttcaattcacttctgtgatcacaaacttttcctataacaatcacaaattctcacaggagcttgttccaacctcttatgagatcttctaagttataaagtttaatataaactatacgttgtcacaatacgcaccctcacttctatgcactttataaaactgcacttaatatactaacataaaattgttaatttatacaccacaacatacccttatacatagagagagattttcggtatgttgccagtattttttccgattaaatttattttccca

SEQ ID NO: 623018 - DNA, 1643 bp, Homo sapiens
ggaattccgccacggatggatggccagatggatagatctggcaggaaagaagccgtggtcctggggaccgaggacgcgctgccgccgccgctgcctcctccgggcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 623019 - DNA, 1585 bp, Homo sapiens
cccacgcgtccgctactcatgggtgagatgcacatggtagacaccgtgacatggcacaagatgcgaggtagcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 623020 - DNA, 111 bp, Homo sapiens
tgattctgcaatggtagactatgaccatccactgacagtcgagatacatctaagctaactaaagtctagtccttctcctataactcacagaagtggtagcagcaatgatga

SEQ ID NO: 623021 - DNA, 861 bp, Homo sapiens
gaactccttgatcttctatcctgcgtggagagccttcgcgggtgaggcttaacgcgcaggaggtctcacgagagtggaagcaactctcgcgaattttaaaatttatctttttgcctagcgactgacaacaggcttggttgcttggcgtggaatcctcaagtggcctggctttgagactggagtgagaccccagccctaggcgtggggttctataccataatagaggagacggattcagaagggctacagacccaaggtgtgttgacaaccagacactatgatgagcgtctagagattaacgactccgaagaggttgcaagtaatttatacattccaacccccaagaaccaaggactatcctcgtgctgcccatcttcctaagcaaggctatggctgataacagcagtgatgagtgtgacagagggacacataacaaggagaagaagaagacctcacaggatgacacctcacggggggctttagtgaaaaatgcggatgaccgatgatgatgactgatgattcatctggaatgatctgagttctgatgatgatgatggaagagcttggaggcccctctggatgggggcctattagacctgaagactaatgagcattatgaccagtagactggtggaaaatatgggagatacgttcacgaaagtaagagggtacacactacggatgtatgacctggaccaaaaatgagaggcattaattcccttgatttaatccagtgtcaggggaaattgagagattagaaaagggcgcagacaggagaaagagacgaaaactggcatatgaataggaggaccaaaacgagaaacacagtgtatacccgtaaaaaagtaagggaaatacaga

SEQ ID NO: 623022 - DNA, 391 bp, Homo sapiens
cataagtcacttaggctttcctcacttttcatcctgtttttttctttgtgctcctgactacataatttcaaatgatctgtctttatgttcactgtttctttcttctgcttgattaggtctgcttttgaactcctctagtgaatctttcagttcaatttttgtattctccagcttcagtaattctattgggttctttttaatagtctctatctctttatttaacttctcatttgttcttgtatctttttcctaattttatttagctatctctcagtgttctcttgtaactcactgggcttctttaagacatttattttgcattctttgtcagttaattcagggatctctgtttctttcaggatggttattggagatgactgaattaactgac

SEQ ID NO: 623023 - DNA, 1136 bp, Homo sapiens
gggccccctgcccctcgccgcccgccgctgcctgggccgggcctgaggatgctggcgcagcgcctcgtgcggccaggcttgctcccctccggcacgcctgctaacttcgcccgctacgtcccgttctgccgccgggcacaacgaccagatctcaacagatgacccatccgaggtcagagagatcctccgaagagacgccaggcagctatgccagacgatgatgccactccgcacgctcgcccgaacggcacagagacatcaacacagaacatgagacacacaaggaaacacaagaggccagaaacaccagaaacatcagaggcatgagtcaagtagcattgacacacacttcatagaccatcagatgacacagaccacatgcgatgcgttggcactgaacagtgagaaccagagggcctgatgaaacatagagagcggaccgaacagaccaattccgacattgaaccctgacacacatgatatcccggaaaggacgacatagctcgagccgacagcactagcacgacccacacccacaaggtagcaagacattgcacgtaccagacaaagccatggcactagcaaggaaaagacagacccgagaagctactacgcagagggacatagaatatcagacgaaaccaaacattaaatcaccagacaccacccatagagagacacgtacagaggagcagaacatagcccccagttgacaagggaaagaatagattaacaaaagacacataaaaaagatatatagacacaaggacaatccagaggagaacacctatgacacaaccatctgaacataacccacactcaagcaaacacccagagaaccgagagccaggatatggaaccaaggacacaaagacaccccccgcattaggcacaagcaacagcaagccaacttagcaacatgaccacaaagccagagcgagaccaagaagacgagcacacgcctgactagaccagattgggacacagccctatggtagcaccgggcaaaggaaccgatcctgagcatacacaaccacgctcccaaagctcagcacacaacaccacacccatatagagcaagacccaacaagtaaccatggaaacacaagaggtgacaccagcaagagcgagatagc

SEQ ID NO: 623024 - DNA, 145 bp, Homo sapiens
cagccaacaccactggcacactgacccaacacaacatgccatcaacaccaccactattgtgatcccaaccccaacaccaccggcacacatatctctaagcatgagacccatcagcaccaccaccatggtgaccccaaccaccaac

SEQ ID NO: 623025 - DNA, 1100 bp, Homo sapiens
ccagacaaccttagctaaaccatttacccaaataaagtataggcgatagaatattgataaccgtggtcggtcaatagatgatagtaccgcaagggaaagatgaaaaattataagcaagcataatatagcaaggacgtaagccccttataccttctgcataatggaattaactgagaaataacgttggcaggaggagagccaagaggctaagaccccgcgaaaccagacgagctacctaagaacagctaaaagagcacagcccgtctatgtatgcaaaatagtgggaagatttataggtagaggcgacaaacctaccgagcctggtgatagctggtggtccaagatagaatcttagttcaacgtttaaatggtgcccactagaaccctctaaatccgccttgtaaagtttgaacgtgtggagtccgaaagaggaacagctctttggacactaggaagaaaaccttgtagagagagtacaaaaatgtaacacccatagtaggcctaaaagcagccacgcaattaagaaagcgttcgagctcaacagccactacctaaaaaatcccaaagcatataagcgtgaactgcctcaggacccaatgggaccaatctatcaccctatagaagaactaagtgttagtataagtaagatgcaaaacattcctcctccgtgtaagcctgcgtcagattacaagagtgaactggcattaacaggccaatatcgtacgatcaaacaaaaaggtgcttattgacctcagtggtaaccaacagagggtgcgtcatagggaagggtcaaaaaggtgtcacgggccggcatgttcccggcggttccacaaaataccgtagggcacgagtataggagacgcggtccaagaaaagggttacagaggggggaaccaaaaggaaagggggggaccaaaatggtggtaattagagaagaatatatagaataaaagggagagtgtacttaaagaaagagacgtgaaagaggtggaaaaaaaacaaaaaataattaagtggtaacagtgataaataatatgatcgggagagaccgtgatagatcagatatggtaacaaaagtgactatttatgtaacttattta

SEQ ID NO: 623026 - DNA, 732 bp, Homo sapiens
agacctcgctttatttgggtgcttatgtggcatctggatgtgaggagcttgagggcatatgtttgatagagggagcatgaccacaggaatcctttgtgtgaggtggacacagcgggcctgaatcattgtgctcacacctaacttgaaatctggtcttactttcatgctggtatgttttcacctggtgaatcagtgtgttaactacgataggtaatagttgcaatggccagtgctatttaactggatgccgttagaataacgctctcctattataccaaaagttcaatttactttcttgcctttacttgctcacagtgatcaagagtcattcatagggctctgacgttagaaatgatgcataggatattcgaaatcattgagacgtgaggggtttttttgccggattgatccttttggttttcggaaaactcgagactttatcttgttttaccgcgcgggagatatgatgcctatggaggaaaatggctgctccttctcatgtatgcagtaaataatacattctttcactcacccaagatggccatggttatcacgttttgctatgttaaaagtggcagaacaggatagacgaattatgtttgccttctgtagcgacataaggatgaattctgatgattctctgggcattacagggaaacaacatagggctctacctcttttaggggcggaagaggcttcattttgatctgtggaattcaacgtggaggctag

SEQ ID NO: 623027 - DNA, 329 bp, Homo sapiens
ggctgatcgcttaggctttaattaaatatgggggtttcttcttagagcagctcgtactgacgaaggtgtattgcgctgaatgatgttcacggtagtcgttgaacacacggcggtatgttctcaggtgtccacagcgcaggttaaattgagggtagcagtagtgacgcccatctccactggcagtgctgatcctcagaaactcatctcgaatgaagtacttggcccgggtcacgcgtgggtcctctccgggctcgggagtagcatcctcaggagtagtgtagcgagcaaattctggaaagtagtcctcaatcttcgcttaagcggatcag

SEQ ID NO: 623028 - DNA, 510 bp, Homo sapiens
cgtgcctttcctagagcctgtgaaccccggtttggtgagggggaccgggcgcatctcaaaaatcctatggatttttcccccatgcgggagcggttgctcagggagaggtccacagctaagaggagtttgcggttgatgccctcctggtatttcgcaactgccagactttcaacgaggatgactttaaagtaggcaaggctgggcccatcatgcgccgctttttcgaaagccgctgggaggagttttatcagggaaaccaggccaatttgtgaggcaagggaggtggggagtccccttgtggcatctcccccccccttccaaacaaaaacctgccattttcccctggtgatgctgccctgggtccagactcaagtcagatacaacccttttttttgaccttgcccttggcagggccccccatccttttattcctacatccctttttcccttccctcctcttgctccccaagtaagaggggcaaaaatggggtccttttgggctaaaagcca

SEQ ID NO: 623029 - DNA, 431 bp, Homo sapiens
tccagattgactcccccacaattgtagctacataaagcccctcgtggagatcagctacgaccccgccaaacgcgctacgacgctcgcgctacgcgggctcgatttcgccgatgcggcgcggatattcgaggggccgatctacgagaccgaggacgatcgcttcgattatcccgagccgcgctattccacgatcgggctgctcgagggacgaatggtcgtcatcatctggaccgaaaccgaaaagggtcggcgcatcatatcgatgaggaaagcaaatgagcgagaacaagccaaataccgatccaggctggcttgatccggccgacgacgcccccgaatggaccgacgagatgttcgacatggccgcgtacatcgttggcggcaaggtgatccgcgaagcgacgggctatctcggccccaacggcatggtg

SEQ ID NO: 623030 - DNA, 690 bp, Homo sapiens
  misc_feature (559)..(559): n is a, c, g, or t
  misc_feature (632)..(632): n is a, c, g, or t
  misc_feature (690)..(690): n is a, c, g, or t
agccggtggaccttcagatgctagacctggtacagagcatatactgacgcagccgcacccatagacagtgactgcctcagaacctgacatgtaggagatcagcccatgactggaagagaccgctggcactgagccaacgacacacgacgccatgctggcgcaggaagacgacaatagactatgaaccatatagtaaggcaaaccacatgcgcatcgaatagacctgaccctgggttatgaccatcctggacagtaggacagttacagcagctactactagtcagtgatcgctacatgtaagagtaatcactatgacctgacctagccagatgaatgcaggagccctgctgacgatacttgcttagttgatggcagagcctggagcgaagattgattatagcaagcacaactggcacatgatgatagagtcataggtcatggagacgatgtatgatgcattcacgattacactgagcatgaaactgatcacgcgtagagtgaccagcattactgccatgctacacgtgccgaacgtggcatagaataggtcatgtgacangcttcagagtcgatgagcaagggcaggcccagccctgaagaccacctgttcagcatttgtgaccgcagatatngtaagccttgaaggctttgatcactagcctcttaccctgaccattcttgagtgctttn

SEQ ID NO: 623031 - DNA, 1116 bp, Homo sapiens
  misc_feature (1)..(1): n is a, c, g, or t
nagcgacacttttggggtgggcacccttgtgcaacccccagggtgtgtatagccccccccgcttcaacacgaggttctggggtgtttcttcccccaaccacagcgcccgtctccgcctacgtgctctgccctgttgtgagggggtgtgcccatgccacattggccccctggggggggacttcccctgggccagttctttgttatcttgtgcgtaccttgggtataatccatgtggaagaccacggaaccacggtgtgcctgtgtccccgcggggtgaaactctcacttcacgggagggtcccgcccccacacactatgagagctgggagaccccccgccacgtcttgaaagtcgcgagaaaatgctgagagaacacgggctgtgcaacccctcccgggggaaaaacctggccccgtgtcacgccctctgggtggttcccgcgtggcaaaagggtgtaaaaagagaaatataggtcccttcaccacgtgttaaacacggctctgagaaatacacgggctatagtcgagagtgggcccctcgggaggagaccaccgagagggggaggaaaatcttataagagaggcccccgggctgggacacaggcgttctaagagtgggcctcgcgcacagagaggcacacacatgcacagcacccctcgcctcggggagagcctcggccctcaaaggaacgcctcgcggcgcggtgcacagtgtctccgctggcacagagaatgtggagagcacgcgttccctcggggttctatatccgccgaggtggcccacgtaggcgtggtggcacggtgaacataaacacacgcggggtggcaccacctcgtggatgaacacacccgcgaaatatgtgtctccacggagttgtgtgaaatatgtggtccccttgggggcacagaaagtgtccccacgttgagaaatctgccccacgagggacaccaccccaccacccacggcctcaaggagttttgtgttgagtcaaagttccaaggaaaaaggaacacatttcacagccgggcgtggtggttcacgcctggaatcccagcacttgaggcccggagttccagagcagcctgggcaacgcagtgagagaccccatttttacca

SEQ ID NO: 623032 - DNA, 84 bp, Homo sapiens
gtgggctccaggaaggaggagcttcctacttttgagtttctctgtggaaataaaacatgaatcttgtttccctaaaaaaaaaaa

SEQ ID NO: 623033 - DNA, 182 bp, Homo sapiens
aagacttggtcatcctatagcggagacccatcctaccatttaaggatttaaacccacacataaggcatatcccattaaggtgtataaataatttcactttaaacttaatctagatcacggagacccagggtaccaggcaaggcgggtcaccattaaaggccatttaacccatttaaaggcct

SEQ ID NO: 623034 - DNA, 327 bp, Homo sapiens
agtgtcatatagcgggacaaacacaggttattaacatatgtgtgctcatatacttgggagttctcagtgatgagtcactcactaggtgatgaattgggggtctaaatgtctaacttagtaggggaagcggggaggaaagaaagggcccttttggcaaagaaaattatttgggaaagatcactgagctcttaagaaacatcagcatcaagcagcatggtcagttgctcctgggagtcaggggcatttcatgcaccacattccagtccttttcagtcattcatcattcaggcaggctcctgcttttcaaggccagcatccagggcattt

SEQ ID NO: 623035 - DNA, 338 bp, Homo sapiens
  misc_feature (57)..(57): n is a, c, g, or t
ctttttttgcccaacccgtttttaaaagacagggacaggttgccaaaaggtgacccnaaacaggaagaaaataaggtccctttgcttttccccccattcttccccgggggggaggacctccccgttttaaaaaaccccgggcaaatttgggggcacaaaagtgggttttggtttggacgggggccaaatttccgtggataaacggggtttggatttttaaatttataaaaaatttaagggtttgggagtccaaaaccctcccctttcctcagggcactttggcatttggcgggttttttccccggacagcaaaccaaaaaatggtgtgtttgggtgga

SEQ ID NO: 623036 - DNA, 837 bp, Homo sapiens
gctgccgcctactactactaaattagcggccggtcgacgtctgagacagggtatgtacaagatgagcttggggtatctagtgccagaagcaatatctactgggtcctgttaaagcaacacagaagccaaccttagggaaatcctgctgtcaaagttagaacaatttgagcattataggactaatgagcgcaatggacacatgaaatatataaacagaagataattccataatgctaaaaaatagtctactttggagtttactaaggaatcaactcattattctaaaaattggtaaataaagtatgataatgcaacatttaacctgccagttgtgtttgaactgtatttcagggtaaatgaacagcttctaagaaaacattatttttagaactcaaactaataaactcaggaccagaaaattataattgtgtaaactctcagaaaatgctagattgggtccaggcaaaaattatctaagggtgctacaatttttaagtgaaaagtaggtgggcaaatttaagatagatggatcaggcttaaaacacttgaacccactgatcaatcttagcattactacaagtagaggagccagtcttcatgtacctcccgatgggatgcaataggcagttatatgctgctcttgaaatacacttgcaaaagagaggggagctaaatttaatgatgcctttacagctaacatctaatttcaggaaatacaaagaatgggggaacctattaaattataccaggatgatacaattggccaaatccataacttagttaaatctacagagaagcatggtctgctttctttagcaaattcatttcataggagga

SEQ ID NO: 623037 - DNA, 466 bp, Homo sapiens
gaggatccccttacacatcctaccaaaataacacaaaatacaaaagaaacccacaaaacccgtgttggttagattttctcaaaagctttacaacagagcaggcttacagtagataaagactctgctgttgcccaaaatagtaattatgggaaataagttgctatttacaattgaagtatgtctcgttttctagatcagatattgccctgtttgttctattgatcaggtatgttcactgtaagagggtgttggcatggtaggaatgccccttggtgtgtgagacgtgtttgtagctcaattcgcgcgatagggaatttggttgtcgtatatggagtctcgaggcaggtggtttttattgaaccttgtgattcatccgtacctctctaggcttgtcgcattgttgctaatttccaacaaggagcacagctgcttcagtatgtaagccgggcgtaggtcacctgatctg

SEQ ID NO: 623038 - DNA, 306 bp, Homo sapiens
  misc_feature (273)..(273): n is a, c, g, or t
tcgggcctatccagctgggtgacagagcgagacgtcgttcataaaaaaacagaagtataggagaaagccgggtgtggtgggctcacacctgataatcccagacactttcaggaggccaaggtgggacgggtcacttgacggctacgcagtttggacgggggcaacactagtgatgacccttttctctacaaaagaaaaaataagggccagtgcatacgtgggctcacaccttactaactcccacgcaccttggcggacgggggactcctctangacgtcagccctggcagggcaatgcaaggactg

SEQ ID NO: 623039 - DNA, 761 bp, Homo sapiens
ctgggcactcgtcctcgcggtgtcctactatcgacgacactgtaagaccggttttcaagcttgaaactgccttgcctaagatagacgaatcaagagctattccacaagcttcttgctgaagcactgaggagatgtgtaatactcctaaaggacgggccaaatctagagattttcaatcatagacttgtgacagcattggggaactaaaagatccatgtgtttcatgcctagtgggagagagtgggggagaggaagagagagagagagcatgtatacccgtatgttatcatagagcacgattctccagtggatggatacctggaagtggactcattaagatgaagagagtaattcacatttactctagaacctttaacaagcactgaaagggatagaaggccctgaggatttgactccttgacaatttctggaaagcactggatcagtcacacttgtcctggaacagagtccaagttacccactaaagcttgacggtgcatgttggcttcactcctgcagcatcaatgctggccctagaaagcgagcattttcattcttcccatggcacgctgattctttggtgccagtcttcatgttttctccataggccttgtgcagaaaggtctttctcattgcatccatacttgtgagcaataactgcagcaccgacaaggacacactgcctgcaggcgcccacggaactgggccactgtccccagaacgggttgtgcctcagcaaatctatttctctccagcatgtg

SEQ ID NO: 623040 - DNA, 94 bp, Homo sapiens
aaaaaagggaggcaacaacggctaggacagcctgggtgtgaatcggccgaggcagaacgctgtatttggttaattctgcacgggagacttctga

SEQ ID NO: 623041 - DNA, 401 bp, Homo sapiens
  misc_feature (22)..(22): n is a, c, g, or t
ctattgtgtgttctttcacatnatttgtaacttattttgtacataatgtttctgccatcgtctcttatgatcgaaaagagcttcaagataccaggacagcgattactcaccccatactgtcggacacaaaggatttactccagacccccgacaaggccctcatctccgtcattcgcaggagaaagagacagagatatctgggacgtaggtctgggtgccctgtaagtatctgatggcaagtgggtaatctgccttaccatcgatcctattagccaatgtacaatcacatgataacaaaatagccactacgagcaagagtttgtaactgctctaattaaatttcaggcatatggaaaacattaagctaatcttcctgtttattgacaaactaaaaatagagt

SEQ ID NO: 623042 - DNA, 386 bp, Homo sapiens
  misc_feature (379)..(379): n is a, c, g, or t
  misc_feature (385)..(385): n is a, c, g, or t
tcaagagttcgaaaccagcctgaccaacatggcaaaactccctctctactaaaaatacaaaaattagccgggtgtagtggcatgcgcctgtagtcccagctactcaaggaggccgaggcaggagaatcgcttgaacccaggaggtggaggttgcagggagccaagatcacaccattgcactccagcctgggcaacagagcaagactccgtctcaaaaaaagagacagaatctagttctgtcacccaggctagagtgcagtggtgatcagggctcactgcagcctctaccttccatgctcgtgatccttccatctcagcctcctgtgtggcttgcgaccacaggcgtgcataccacacttggctatttttttttttgtanagatgng

SEQ ID NO: 623043 - DNA, 217 bp, Homo sapiens
caacgattgtctcagctgacgctctctctgtggggaggtgcagctgaggagcagtataaaggctgtcctccagaagcagaaagacctcagtgcaaatcttgtctggggcactttacaggtgttagccaacaaggccagccctgaggatttcttcaggggaacaggagagcatgttttcacataacttgtcacgaaccgctgaggacagaaagccttt

SEQ ID NO: 623044 - DNA, 959 bp, Homo sapiens
  misc_feature (686)..(686): n is a, c, g, or t
agcggggcgtcggcgctcaggaatcatggcactctggtgggcataccagctggtgccctgggcgcgtcaccgcgtgagaaagtacacggtcctgacagactgggtccctgcatgggcctgggtgacgagttatctcacagcgagctggtggagaggcgtgggttctgctaggaacatccgagaagaggctctggtactcgtgtaccaatggtgctcccgtgggcttagtggctttgtggacctctgctggtaaagaggcctggtacaaggatctttgcgaatcagcgttgcaattccacatgggccatccatccgaaagatgagaataggcgacttggaatgaaagatgcttggtttgcgagtcacggaggggcaattagtctcgccgaatgatacttctagggactgctgtgtcgtcacaactgggtaacgagagcgaactctagagtagggatcctgtcatgccccagagacctacacttgtggtcgcaatatctactagcggtgattcatccatgtattgcctccgttcatcaactctaactgtaactatcctactgggcccattgcatgatgcaagtgtaagacctcaaccttcgtaccctggggtcccccccgtatcatcttacagagttaagagccagtaagtccatactgttggtgggcttgtgtagtcgtgtggaaancgccctatctcgtagtcccttggaaggcagcatcccggcgtctaaagaccctagccttcaactccaagcagtttcccaccttgcacgtagatgcagactttgcaccgcatggaaaccggtcaagaacaatccttccgtctaaaaagtggggccataacctagttttccactggggggttggggtttgcccgagtcagaagcttaagagggacctagcaacctgcaagtggccctcttgactctttaaatgtaccactgactggcttacagcct

SEQ ID NO: 623045 - DNA, 463 bp, Homo sapiens
  misc_feature (43)..(43): n is a, c, g, or t
  misc_feature (244)..(244): n is a, c, g, or t
agaatgtgtaaaagactgtcagatgagtgacatgggggtcttngtgctatttcttcttagcaagcacggttttactgtagttgcttagcttaactgatagcataggaggtagaatgggtagaagcaatgataatattacagaataattccaactatgtaaaatgttagtgtgaagaagaaaataatttcactgatattagtgaacatatatggattgagattatacatgactttttcctccttngtaatgtttcattattaatgttttacaaaaagcaaatgttaattgtagaaatataaaatattttaaattcatcatcttgaaattatacaaagctagaagaaaataatgaagttcagagtttcttctgcaggtacctttatctagggacttagtaacataatcttttatggaaaggaaaatgaaaatggtgtttagttgggggtcgttgttacacattct

SEQ ID NO: 623046 - DNA, 328 bp, Homo sapiens
  misc_feature (96)..(96): n is a, c, g, or t
  misc_feature (198)..(198): n is a, c, g, or t
  misc_feature (299)..(300): n is a, c, g, or t
attctatggccacctccctaaatgtcaatgatctcatttctaggcttccagggggtgctggcatcttagcagtggatctcccaatacctgcaggtnacagggccacagaggctgggcctctagaagcagaagaaacagagaagtaaacacaagactgggagctctggctgcagtgagagacaaaggcctgtgtttgtnttttgacagtttgattataatatgtctcaatgtggctatctttgagttcatcatacttggagtttgttgagcttcttggatggtttatattcatgtctgtnnatcaaacttgaaaagttttcagccatta

SEQ ID NO: 623047 - DNA, 190 bp, Homo sapiens
tcctttccaaacaggctttgttgttgttgttattattaaccaccccaacacacacacacacacacacacacacacacactatattcacatactagagattacatatttaagtcagaaatttgtagcataatgacagctgggtctctcgttagtagaagaaagaagtagaaaggagcgcgcgtcaaaatcg

SEQ ID NO: 623048 - DNA, 204 bp, Homo sapiens
agataagaatcgagctggtacctttttgtatttttagtacagaggggttcaccatgttggccaggttggtctgaactcctgacctcaaatgatccgcctgccttagcctcccaaagtgctgggattacaggtgtgagccactgcgcctggctttaggcctgtgctacttcttatatttactttgtgttcaattcacgcaagtga

SEQ ID NO: 623049 - DNA, 1422 bp, Homo sapiens
  misc_feature (522)..(522): n is a, c, g, or t
ggtgaagccggccgtgtaggctcggtcggtcgctagctcgctcagatgagcgatcgctcgccgagtccagtgtgcggctcttcgtggcggactgttgggacttctcgcctcctggtcttctggcctctgtggtcctccagctcgcgcacgcactgtgacggggctctcgctgggcatagctcggggcctagccagtgctggtgcttggtgcagcagacagggttgcctggtggaccgccgagccacgggcacgcgaagcagtgctgtgcttgctgcaaggaacgggttataggcgacgtaagtaggagagtacgtgtcacccaacgtgcacaccgccgtggggtaccatcagggagaaagactcgtgttggacgaaaagtcaaacgaagatctattcacgccgtgactggaggtaggcgtagtccgcgtggaactaatgtagagacaagcgtcacgctgcgccgggaaggacaggaggcctttggtttcgccaagacgacgcctctcttcacctcgaccgtntccttctacatagcccttttcttacccgagcggaaagccgcgtgtcgcgggaggatccgcatagaggagtcgcgacgcgaacgcaaagctcaaagggcctgataaacgaacaggacacgcggaacagtttgggcaggcatacgacctgtatgcgggcccttggacgaacctggggaactggggttgtcgcacccgcgttgaggagtctacaaggccccggcatgcatttccggacccgcgccatttgagcagagacgggcaagagcccccctgtgcagcccccctctctattttggacgcagaggccagtggcacagagggtggcactagagaagactttcggctccgtgggcaatcctcaacgcgagagaattgagtgccccaaacagattatcggccaggccctaggcacttgggacactggggacccctttatccctgggctttgagggcgaatcaagtgcggggctggggggaactccacgaggtccggtcacacagttcgccgttgggaacagtggagaacttgggacgatcgttgggtacaatgcggagccgagaagcgtatgtgtggattctccggttccaaatggcgttgcggtaacttgtctagggcccgaggaaaaattcgcaccatagaagaagtccccgagagaaattaccgccaggcaatacatgtatttgacccgtatggaatggcgcggaagtaacggttaaaacgctctgggcatgggaaccccctggtggttgtacgccagggctggacctggtgccataggagaattagaggaccccgagaaggtccacacgcaaaattggtgccgaaggcgcaaagaggagacggtcggtatgaggatgtgtaacacacccatctcgtagatgcggcaatccacacatggc

SEQ ID NO: 623050 - DNA, 418 bp, Homo sapiens
tgtgcccctcccgccgccggccaacagcagcccccgcgcgagccaccggcggctccgggcgcctggcgccagcagatccaatgggagaacaacgggcaggtgttcagcttgatgagcctgggctcacagtaccagcgtcagcgccgccgggacccgggcgccgccgtccctggtgcagccaatgcttctgcccagcagcgccgcactctgatcgtgttgagccgggacaaccgcaccaccgaggcgcgaaagtggacgaccggctcatttggagtcaccgctccctgccccaggcccaccgcccgtgcaatggttccaagctggctactcgacatctagagcccgagaaggtggcgcattgcgcgcggagaccctgacagcgccgcgaaaagttcatgcgctcagtaacctgcggccg

SEQ ID NO: 623051 - DNA, 371 bp, Homo sapiens
cgtatggtgttgcttgcccgtgtacgctctccggtctggtgtctgaatcactgtgtgagcgctctggtcctggtgtctgatatgcaccgtgtagcgctctgcatgctggtgtctgatactgcaccgtgtgaagctctctgcgtcgctggtgtctgacatgcaccgtgtgaagcactgcgcgtcctggtgtctgatatgcaccgggtgaaactctactgcgtgctggtgtctgatatgcaccgagtgaagctctctgcgtcctggtgtctgatatgcaccgtgtgaagcactgtgcgtcctggtgtctgatatgcaccgtgtgaagctctctgcgtcctggtgtctgacgtgcaccgtgtgacgctctctgc

SEQ ID NO: 623052 - DNA, 286 bp, Homo sapiens
ttttttcccccctttttttaaaacccgggaaaacccaaatttttgggggttcgccccccagggccccaaaaaggtttttttttaaatggcccccccggaaaatttttttttccccccaagttggagggggggggccccccttttttttttttttttttttttttttggggggggggccttttcccccccccaaggggggggttttgaatttttttgggggccccccctttttttgtttttgggattttgggggggccccctaaaattttccttttcggggccatta

SEQ ID NO: 623053 - DNA, 729 bp, Homo sapiens
tcccgggcctcagcttgaaacagagcctcgtaccaggggaggcctcaggcctgggatttaaaggtcggggagtggaaaaatttcagaagtgctcccgggatctaccagcagaaactagaagaatccattccagaaaacaccgtgaacagcaccgaggagtactcgggccttcctcgtggggacctgcggcgcagccatttcttcctcccgcggtgtcgtggtgggtgtatgtgccaattttgggggggggggctcatgggcaagtgcccgtgggtggtgccgtggggcacttcgtgcagcaccgaggctagtgaagaacgcccaccaatatacaacctctttcagccggggggatcctcggacctccgggttccgtgccctgggaaggccccgtggaggtcatagtgacaatggggcgcaatataccctttctggtccgggcccgggggcggcaacttcaagaagggcctcttggagaccgggtgctgcgcctcacatcctcagcaatcaccaccggtcacgtgtggaacgcgttaaagtgggccatccttaaacacccggtacacgggggcccaaatctgggaaagcacccggggggccggggccctacagagaatcctgcgggaatacggccgggggggctacccacgggagacacttacacccatggcccaaacacaccgagaatccgaaggcgactcaaagtgcccagtactttcccccaatagg

SEQ ID NO: 623054 - DNA, 707 bp, Homo sapiens
  misc_feature (140)..(140): n is a, c, g, or t
tggcaaagaaaggttaggtttagattggcaattattataaatgctgcgtccacagggtggtgagtgggaagggggaggggaagggggggggatctggggatactataagtgtggaaacatgtggtggtggcagctgtggnagcactttgttgtggagaaacaaccgtcaaataaccacgataagtatcctttgtcgagtctctagtcgagtgcacctggtgctatgagtcaaggcaaagagtgccctgtctgccgccgaggggaatgtgagcccgtgcagcgcgacctgcggagtctcggaccactccgatctatctctaccgtggaggtcctatccacttactgctagcgtggaggtggacatcgctaccaattcctatgccacaacgaatcagatactctacctactgctggtggacaaacaaatccgatggcgtcctttctggtgaacacaacttcccctacatctcgatcacaccaaatctccgctgcgctggggaggagctacactctatcctctcggcgcgcgctataatctctgtgggcggtgacccaacacgagggggcgcgcacgccagagatcagcgccgtgggcgtgtgcgccacgagcgggggggcccaaggagagcaggtggggcgggggcctcactcccaccagccggggggcgcaccgcttgggggggcgcaccgctgggaacctttagccc

SEQ ID NO: 623055 - DNA, 944 bp, Homo sapiens
  misc_feature (570)..(570): n is a, c, g, or t
agcggagggtcgctcccggtcgctcggcgccgagcgtcgccaccgtcatcgccacctgctctaacagcggtctgagtctgtagtcccgtaggatccctgccatcatgtccatagagaagatctggggccgggaacgatcatggactctcgcgctgggagaccccgactagtggaagcgtgagtatctcatatactgccacagaggtctttttcctgggctgaaatgggcccgaatgtggagcctcatacgagagcaatcgtactgatggccccgtggcagcatagagcgagagatgcgagaccttaacacacgcgttaggttatcatataaggcacaaaggtggtccgtgaatcgagacaggtggagctactaggtcaagcatccagggcaatcgacgccatggcactcatgtcacgacctcacgggtcgtcatcctgttgagttggagtcaaagaggtacaaacctggaccaatccttgattgcttggaggttgtgtgactcgagagacctgaggaatcaaggatccggaggatatttgggcgctcgaagatgcccactcacttggggntgattgatcatctctggcccgataggttgtagacagcgcatagggcgcacgctagacgcagggaaactagttcccatgatatctgccaacaattagctgaagcagggacgggaagcttccagtagccttcatcctggtctgttggccggcattgcacacgtggatcaagtggatggtctctcattggctgggccatccaagctggggcactcgcacggatgtttcatgattcctgccctattgtgggaagcttgacgaagcttttcgagggattgcctattgcgacctaggttgcaaagggtctaccattagcacttcaacgcgagtcagtcaatggaccttgacttccggcaagggattgctaccgaattggg

SEQ ID NO: 623056 - DNA, 301 bp, Homo sapiens
ctaaagggacctagagccactttaaaaagtaactggtccgcgcgtggtgtcacgcctgtactcccagcattttgggaggccgaggcgggcagatcacttgaggtcaggagtttgagaccaccctggccaacatagcgaaaccccgtcgctactaaaaatacaaaaattagccgggtttggtggcttgtgcctgtaatcccagctacacgggaggctgaggcgtgacaatcccttgaacccaggccttgttgccgcgagccactgcactccagcctgagcgacagagtcagactcagtctca

SEQ ID NO: 623057 - DNA, 280 bp, Homo sapiens
gcgccttctcctgacctcagcctcctgaagagctgggattacaggcacccatcaccacgcctggctaatttttatactttcagtagagacaggggtctcgtcatgctggccaggctggtctcaaactcctgacctcaggtgatctgcccaccttggcctcccaaagtgctgggattacaggcgtgagccaccgtgtcccgccactgggagcatatagaaaggctagaagagaaaacagggaactaaaagcaattcagtgtcgcagaagtgcgcctgggtg

SEQ ID NO: 623058 - DNA, 165 bp, Homo sapiens
gaacagaagactgggagcgctcagccggccacggaagacgggtctggcagctcccacggctcaggccacggaaggggtaggagcaaccacggagtgggtcttaagcggttctggcataggctcttaagcagcatggaaaaagggtggagggaaaataaacatcag

SEQ ID NO: 623059 - DNA, 337 bp, Homo sapiens
tccgagctcggtcccagtgttatctccacaaatcagacgagagtctgtgttcctaacaggcctttgggatatgccaagtagattgatgggtggcgtcaggaagctgactcatgtagggagagtgcggcttgactaggttcatccggttcaatgcggagtgtcagatagcattcattcctgcaagcctccttgtttctagtaaacttgagtgtctctctccgcccattttcaccctccctgtctttacttaacaccagcttcactacctgtgttttccatcacactccttcctctctcttctagccttggcccatcacctgtttgtggaggtagcact

SEQ ID NO: 623060 - DNA, 313 bp, Homo sapiens
  misc_feature (34)..(34): n is a, c, g, or t
  misc_feature (79)..(79): n is a, c, g, or t
aaaggggggaaacaattttttttaaaaacccttnttggtaaaaccctcccccccgggggggggccccgtgccccccttnaaaattttaagggaaaaatccaaaaaaaggaggggccccccccttttcaccaagggttttttttttgtgggaaaaccagttggaaaggggcccccccctttttttttacaacccccaaaaaaagtcccctttgcctttggtttggggctttggggggggggtttaattttccccttttaaggtttccccaaattttttggccctttcctttcaaaaaaggttttgctttcccca

SEQ ID NO: 623061 - DNA, 105 bp, Homo sapiens
gtcctgagtggctgggtggtgtacagggggcagttttagagtaatatagaaggtatagctactaagaagaattttatggagaaagggacgcgggcgggagacact

SEQ ID NO: 623062 - DNA, 856 bp, Homo sapiens
gaggtgaacgcccacttcgttgcggcagccatgttccacgccctatttctcggtgagagagcaaaatacatggggcacataaatgagcttgggcccccactcactgcgctgatcccccccactggggaacacttctcgtctctgtttgagacccgcgcgccccctcgcgtattttccacgcggagccccatatattgtgttgtcggacatgtctttgttgtctcccaacacaagggttgcactccgcaggcgtgctcacatcgcatcattgctgtgggatttacacacaccctcctattattaggagacagctctccgccaccgtactgcgcgtaccataccccaccctgtatgatatgaatatctattttccgcccacgcctcgaaagcaatacatttaggaacgcactcacgtttctgatttcctccgtgcttggcataatcacagatagacataggcagcgctcctcacacatcggtcgccccagggaggacatcaatagacgatggaaatattatataaatctctatagtggtctacccccacgcggaatataggggtttgtatattttgaaggccaagacaggagcccgcacagccacctggatgtgggcactagctactatgattaggtgcaataaatattctctcactcgcggaattattgtctctctcaagcgtttaagttaggtggtggaaaagataagtttcgcctcagcagtatcaggcgcggaggcgagttcagcataattcaatctctgggcaccctgtcttctaggtacaacacacccttctttgttctgctctcgcaccatcagattaatccagacattccccccccagcaaacaaagacg

SEQ ID NO: 623063 - DNA, 187 bp, Homo sapiens
ctcacctcagctctgagtagcttggacataacacatgcaccaccatgttcagttaatctttaaattttctatagagacagagtctcaatatgttgcccatactggtcgtaaattccgtgggctcaagcaatcttcctgcctccttcccagagtgcggggattataggcgttagccattgcactccgg

SEQ ID NO: 623064 - DNA, 124 bp, Homo sapiens
taaaagtaagtagagagatgaattcaggtttttaactttgatactgtcagacactcatgtcaggcactttatacacttctgtctttaaaccatctataggataacccatctgtaagcatcagat

SEQ ID NO: 623065 - DNA, 209 bp, Homo sapiens
tttttttttccccccccccccctttttttttttcccccccctttaaggtttttgggcggaactaggggcccccttccccggaagggttggttttttttttaaaggcccttttttccccccccctatggggggggaaaaaagggggggtttttttccccggggattttttttttacccccccccccttttccccccccggttttttttga

SEQ ID NO: 623066 - DNA, 173 bp, Homo sapiens
ggtacattcgatacgaaatgattctttttgaattctgatccataaatacactttttgtgtttcaaattcacaaaattcacagtggtgcggactgtgtactaaccactattgggaaacatcccgtaaaacctagccggtggccatgccattggagtgacggcacggcccacaac

SEQ ID NO: 623067 - DNA, 149 bp, Homo sapiens
gtgatatctctgggcagttcgtgaaggatgaccctctaccagacactgttaacaatatatatttccatcaatccagacgctggcccagacagggaggctttgcagttactaggcctctaacctgggccatgtcaagaggccaacctcca

SEQ ID NO: 623068 - DNA, 259 bp, Homo sapiens
  misc_feature (113)..(113): n is a, c, g, or t
  misc_feature (115)..(116): n is a, c, g, or t
  misc_feature (124)..(124): n is a, c, g, or t
  misc_feature (136)..(136): n is a, c, g, or t
  misc_feature (138)..(138): n is a, c, g, or t
  misc_feature (166)..(166): n is a, c, g, or t
  misc_feature (184)..(184): n is a, c, g, or t
  misc_feature (209)..(209): n is a, c, g, or t
  misc_feature (251)..(251): n is a, c, g, or t
ctgcaggaattcggcacgagaagaaactctccaaggaccggatgaagaagtacatggccaaggaagggaaaattgggccaaggaaaaacctgcggccaattgcctggttggancnnaggcccanttgggaaggacntntccttttattgccattgacttagggctncagtgccaaggaaatctnaaccgggtcaccaaccagcccgctnaatgcgaaactcgatctgtagaagatgtgtccaagcttcttnaggcctgt

SEQ ID NO: 623069 - DNA, 392 bp, Homo sapiens
  misc_feature (96)..(96): n is a, c, g, or t
gaatagagacataaggccaggtgtggtggcacatactgtagcctcccaatagctgggactacaggcgcgtgccatcacgccagctaattttttttntatttttagtagagttggggtttcactgtctttgccagtatggtctctcgatctcctgacctcatgatcccccctcctcggcctcccaaagtgctgggattacaagctggagccaccgtgcccggctacctctgtaaattttttatgcaaaattgtagggtgtttggggaaaagattcgattttcagaggaaccttatctccaaaatggggtcttaatctactttctctagggagcacaaaatggggcttacgtaggctggcaaggcagggggggcagggagaatggggcccaagt

SEQ ID NO: 623070 - DNA, 115 bp, Homo sapiens
ccagagggtagtcacatctcgacgccgtgtgccgtcccctatttcctgccagcaggttctccaatcgctgacatctagcctctggccactgtttgcgtcccatatgttaccgtca

SEQ ID NO: 623071 - DNA, 161 bp, Homo sapiens
tgctgggttcacaggcgtgagccaccatgcccagccacctggcggtttcttaaaaggttaaacctattcttcacagatgacccatcccatttcacttccgcatattcacccagcatacatgcaacccatcatgtcctcacagtgcacttcatcatatatgc

SEQ ID NO: 623072 - DNA, 218 bp, Homo sapiens
tggccttgcgatgatgagatgggtgtacagccacatgtctacctactgtgtctttctgggaatgtgtaccatctgtgtgcctgcagctgtgtagtgctggacagtgacaagcctattctctaccagtatactaccactccaaggataatagttcactatacacctaaacccaaaggagaaaccagctactaaggtccaaatgttctgttcatcacgcg

SEQ ID NO: 623073 - DNA, 270 bp, Homo sapiens
  misc_feature (115)..(115): n is a, c, g, or t
cctggacccatctgaatttttagtgtctttatggagtttctgtgctttgaccaaccagaagaaggactatttttgttaaagaggggggtggggagccattccaaacatgccatanaagcaactgactattgaaggagtcacccttgctttgacattttataacaatgatctatgtaatacttaagactctttaaatttgagataatagaaaatgtaactcaaactagtttaaacaataaagtggggggggggctcatctaccagaggagt

SEQ ID NO: 623074 - DNA, 799 bp, Homo sapiens
gagcgtaggtgctactcgaccggtatgaccgtcgaccgctcgcgattttgatggcaatggaagagtccggtgcatgtgcacagactggatacaggggtggtgactgaattagctttacgcatatgggatgagctatcttgctgaaactatcattctccatgcggagactggactaagtgtgcatttgttcatcgagagtccaagtacttggattgtccctagtctcccgaggaatttccgcgtcgtatttaggtatcactaacagggggtattgttcgagaggtctcgcaaataggcacttttatgttccggaatcgtgagggcgacggggaatttcgaatccaaggggatttcgggtaattggaggattcgtccaactttgttttggggcctgggactttaggcaaaactccgttgctcaaagaaatttggttattttgccttgcctgtgccggaaaaaaccagggggttggtgtggtgcccatgcgaaattgacggcaaccattaaattggggagaatgccgccctttttgggtcgaacttccccgttcccaaagcaggaaactttccaagaaaaggcggtttatcccccagaggggctttctacctcgtgggggagaaagactccgaattaaacggagggcttacaagagggatcggttgtgggttgccaacgccctccttttcaaaacactgtggtgtgagaaccttgtggagttttcccaagccatatgggcaacatttggtagcacagaagcggccctttggagtggttttccgacttagcaccacaagggga

SEQ ID NO: 623075 - DNA, 514 bp, Homo sapiens
cacgaggcaccctggccgacagcgaggcccaggtcgatgctattctctccgcgttgcgctcgatgccggccgacgcctacgcgcgccattggcgataagcatcatcgccacgccaggcgtcgcctgaaaggccccgagccggacaagcgaatttcatgtattcggtcatcccagtctcgcgttcgatgtgaaagctcctcaatgctccgcgagattgttctcgataccgaaaccaccggcctcgatccgcgcaagggcgaccgtctcatcgagatcggctgcatcgagctggtcaaccgcatcccgaccgggcaggagttccatcgcttcatcaatcccgagcgctccgttccggcggaggccgaggcagtgcatggcatctcgaccgcgtttctggtcgataagccggtcttctcgaaggtggctggcgagttcctcgagttcatcggccaggatgctctcgtcattcacagtgcgaccttcgacgtaggcttcctgaacatggagctcgagc

SEQ ID NO: 623076 - DNA, 166 bp, Homo sapiens
aaaacatgagattcaagggcagttgaagattttgggaaggagtttcaggcataggaatttgggacaagtgagaagaatagaataagtgggataaaagtccacgaaaagctagtcatctgcacattgaggggccttttcagatgggtatgtggtacagcttgtgaga

SEQ ID NO: 623077 - DNA, 1362 bp, Homo sapiens
gctccgctccttctaggatctccgacctggtatctggacacgacctgccatccactcctgacctctaccatgtccatacagggatgacccagaagtcctacaaggctgtccacactctgtgcaccccgtggacctacagcagacacgctccatacacgagtgcgtgcccggattacccgcaatcagctcctcgagcttctccctgagttgtgtgcatgctagccaactttcgcctggtttgtgcacatggagacggcggcatatggctggggccagcggacatgggaggcatcacacgacagtatacgagatcaaccagcagcctgcctgagcccaccttgatccatggaaggtggaccacacaacatccaggccgatgacgacaccaccggagaaggagcagatcccgaccctacaaccaacccagtcacagcctcgcttcatacgcacaaggatacggcaccctggagcagccagaaccaagatgctggagcaccaacgtgtgagccctcctgacacgccagcacaacgaccggctcgcaccgccaccccactcggcccaaccatgtcccgacgacgccctccactccaacaacccctccagggcaggcccgcatggacgcacctcaggggcccaaggagaccgctgaacgcacggacgcgcgcaccaccggcaacccatgcccaggccgcacgccggccagcgccctccacgacccaacgcaccgccgcgccgccgaccagcgcccccacccgcagcactcgaagcaccccacccgcccccccacccccccgcgcaccgccacacgcgccaaccacagcaaccacggcgccccacgccgcacgcatcacgcccaggtgacagagcacgcaaccgcaccgcacaaacccacgctgaccacgggcaccccagtcacgtcgcagggacgactcccgtcaccgctccctacacacacacgcctggtcccccacttctctgctcgctctcaccatgtacacccgacgtcgtcccgtcatacctccgacgccactcgctgacaggcaccagccagcaacgcagacgcacgctgccacgaaggcgcaaccaccgccgagcagcgcgccccaccgagtcggccgaccgccagggcggctggtagtgctgtcttgtcgccccaggcagccccgcgccagcaccatccgcaagcagcagagtcaacacgggtgtcgcagagcgactgcgtgtgacgcccgcacgacgcggtcgccccgcgccctgtctcgcgccccgagagcgagagcggagcccccacccaccgctcaacgcgctaacgccagccatcgcccacgtccgcgcccactccgcactcccctcccccaccg

SEQ ID NO: 623078 - DNA, 556 bp, Homo sapiens
cgaatcagttaaaattagagtcatacactgggtcttggaagatgcagtcatagtcgtggggcgtacagaaggcatttccggacaccatttatccattacctcactctagaaaagggcaagtggaaatgagaggggagaaatattagatacctcaaaaaagataaaagagacaggagacaggtccagggttggtcacttcgggaaacagcagcggaggggtccggagggccctataagagcaaatctcgtacagttccttaaagtaaaatcaagacagcctcacacacacacaaaaaggggcatctttcttatgaccatgagggccagagatggctttaaaccaaaaaaaacccatttcaccatttcgtaaatctaacatctaagaatagggctatccagcctagggttaccaggtttcagtccattttataagtggaaaatcagggtgatgtgatagaagggagaggggaaacctggccctgggtcccagttctggcctatggcaaagttatcaggccgagaggagggcaagtgtcctcattcctctcttcccgtg

SEQ ID NO: 623079 - DNA, 381 bp, Homo sapiens
  misc_feature (41)..(41): n is a, c, g, or t
  misc_feature (78)..(78): n is a, c, g, or t
  misc_feature (91)..(91): n is a, c, g, or t
  misc_feature (186)..(186): n is a, c, g, or t
  misc_feature (241)..(241): n is a, c, g, or t
  misc_feature (266)..(266): n is a, c, g, or t
  misc_feature (307)..(307): n is a, c, g, or t
  misc_feature (315)..(315): n is a, c, g, or t
  misc_feature (355)..(355): n is a, c, g, or t
ctagtctcgagttttttttgtatgcttattagatgattagnggttggggaacccctggaagcttcgggatgggggctnctcacaggacagnccaaggtatgattagaggataggatttttcagtcccacgccccaacctccaggagatgaggggctaaaagttaaactaatcaccagtggccaatnatgtaatcaatcatgcctacataataaagcctccattaaaaactcaaaaggactnggtgtggggagctgccgggcagctntaacatttagaggttcctggagggtggtgcacgttgggagngcattggngatctgccacccttcccacagaccctgccctatgcatctnttccatctggtttattttaaagccgg

SEQ ID NO: 623080 - DNA, 830 bp, Homo sapiens
gccctcttcgtcgcgttcggccagtgtgtcgggtctgggcccgttgacaagccacctgaggagaggctcggaagccgggcccggagcccgaggatgccgcccgctatctctctagtctcacgaggggttgcccgccatcgctaccccgcaggctacatggacttgcctttcccttcatcgttctccgcagtgtggagggagccagcgcatctaaggccggagcgagccatgggggccagccctgccgtgaagacatcgcgaggggacgcgattcaccaatggaagggcgcctggcggcgctgaagcgataaagaaaaaggatagagttcgtggacacagtttgaaaagagaacaacaggttctcgacggactggcagggccacgacaatctcggggggaaaagtacgaggaccatgttggaacggttgtttcagcactgaaggcttggcatacgatacatgtgttggccactattcgagcggtacatgtgttgacggattcaggaatgttcgtttggaatacaggtgggcccttcatggtttgaatggaaagggggaagtacgcgaagatgcgcaggggtaagtaagtgccggtggtggaaggggaaaccacgtgtccccggcggactggcccagggcgagcgaataaggggcaaaaacacgggaccaggaagtggaccccgcacgcccgcggccacacacaactgcacccatggccctgatgccaccccaggacaccagcccccaagggcacgacgggccagggccccacgggacaccacccccacgactgacagtcggagcagcaatgacaaaacacaaccggcggaa

SEQ ID NO: 623081 - DNA, 695 bp, Homo sapiens
gctcatgttggctggtcccatggtgtgaaagggactctctcggggaaaccaaggcccatgcccctcccccctcccccatgtgctagagagccaggcagtagctgaggccacagcgtgtctggagaaacgccaggtctgagcagagcagctggtgaatcccacacgtggccacctgtggattgcagcccttctccccgcgctctgggactctgacatcttaagggctgcgactggtctgtgtccttgatctgggtgaggcacatgtcatgtgatcctaaggttcctggaaactgacacaggaaggggctgtgaaccctaagtgggtgtctatctcctccgaccgaggcttctcaccctggagatggggcagttactcctggccatggttgtcctagatcattggtggcaggaccatgtggcaggccatccctactgtgttatctagcgccttctcatgcaagtgagacccttggggtgagaacgggtctggtggccgagtgaacgggaggttggactttgcaagttccttgcgcccaatcatcgcgacgtgcagcatgagagagtcgtgtcttgtgatcactcgtgactgctgtagtccgagtgagcagataatcttgggattacttcatgtcattccagggaatcttacccctagcatgcgacaggtagtgtaatccacgagggaagacaccagg

SEQ ID NO: 623082 - DNA, 131 bp, Homo sapiens
tatctagaatgaatggaatgattgagagtatttgataagcaaagtggaatgaacaacccagtatacgaaagaacaacgtacagaacgagttagacactgattagtttcaaccttaagtagaaatacaactc

SEQ ID NO: 623083 - DNA, 152 bp, Homo sapiens
ggggccaccccttcttaattaaccccttgaggtacttggaagaggccattattctggaccccctggcaaagtccattttttcccccatggttttggggttaatgctctcttcttggctacagatgaagatctgccccttctgtcgtcttctc

SEQ ID NO: 623084 - DNA, 607 bp, Homo sapiens
tttgttaatagccaatgttagaattattttttttgtccaccgcaaagggggaaagtgtatatatctataatggttgataaacgttcttagatcattccaatggagtgcgaataccagttgggctattgaatgcaaataccacctgaaatatgaattatgggcattcttatacgctggactaggcatatgtgcatagcgatttcctataacaagtattcctagtagagtgattcagccttattgtctccaccctgcacgacaaaagctaaacgaggctgggacgaacagttctcctaatgaaagctgtgaggcactaattctcaaaggaactttatccttagggaacacatagcgtatatatatttatgttgcaactggtaaagatttttttttgaaccacagcaattcctggcgccctctatgttgtaattaagcacgaagcgatcacattttatgggggtgacacataaattttaagatcagtatatcaattgggaaaattgcataaaaagatttttaacgttgttttaacttttaaaaagatcgtggtttaacttcgtcatacgacccaaaccttattcccaagatttcccgaatcttttaggag

SEQ ID NO: 623085 - DNA, 350 bp, Homo sapiens
acgcggagtaggctactcgtgcactgaacagatgttggatttctggtaatttcatgacttactctctgagttcagaaacaagcagactctatggcgaagtaagatgacgaagctagagacgcacatgttgaatacagacactcggactgaatctgcgctgtgaggcacgctagcttatcagcagagtgagcagtgcttccatcggatgagtgagtataggtttaaattctggccacagacaacctctcctacacaattcactgaacctcccctggaaggaggtatccacatcctgcagaggctaactgggcaccaatcatgcttccactaacctttacacgggtaccgag

SEQ ID NO: 623086 - DNA, 208 bp, Homo sapiens
gggtgatctagcaggatcttgtgacggtaccaacattctgttcatgctctcttagggcatctctaagaagactgaggctttctctacagctctacctctgctgcccctcaccacacctgcggcttaatgatttgttcatgacaatgtaaacccttttctacgtatgaagcgtcacaaactcagctctcctaccccacttacccagttt

SEQ ID NO: 623087 - DNA, 599 bp, Homo sapiens
gcccaacggtagatttctcaaaaaaacaaaaatagaactaccatacgatccagcaatctcatctcactgctaggtagacatccaaaaacaaaacaaaacaaaacaaacaaaaaaggaaatcaatatatcaaagagatatcttcactcaagagggttaatttgacttcaaaaggtctgcatggctggaaggtcaggaaacttacaattatggtggaaggtgaaggggaagcaggcaccttctttataaggtggcaggagagagagagagaaagcaggggaaactgctgcttttaaaccatcagatctcatgagaactccctcactatcacgagaacagcatggggaaaaccgcccccattatccaatcatggctcaaaccatccttctacctcagactccagagtagttcagactacaggctacaggcacatgccaccatgcctggctaatttttgtattttgtatagagacggggtttcagcatgtttcccaggctggtctcaaactcctgagcttaagccatccacctgccatggcctcccaaagggctgggattacaggcgtgagatgctgcgtccagcccctttttattcttgagt

SEQ ID NO: 623088 - DNA, 261 bp, Homo sapiens
atcacgcaggttgtgggtgcccccttcccgaagcttcggacggaaggccccaggtgttccgcgtagatgtcccaagccgtggtggggtgcactgtcaccggccctcgggagacagttgggcggcccccggcgaccgcggggacgagtggccgcgtcggtgcagcggttgtgagcgagatgtggtagcacgtgagcttggaacgcatagcctaatacctgttccccaccacccgagcgctcctttctctgatattccgccgg

SEQ ID NO: 623089 - DNA, 113 bp, Homo sapiens
aaggatgatcgttcagcatgcaaagcatctcattcaatttgtttcagtttttctgctctgatccactccccaggttctgccattatttgcttttgcccttctgtcgtcttctc

SEQ ID NO: 623090 - DNA, 358 bp, Homo sapiens
gaggccacactggagaaaaaccttacaggtgtgaagagtgtgggaaaggcgtttggtaggagcttgaatcttcgccatcatcagagggtccacaggggagagagacccgatatatgtgaggagtgtggtaaggccttcagtgtcgcgtcaaatcgttcgagtcgacgtgggtgttcacaggagggaaaaagtgtgtagatgtgaagagtgtggtaaaggcttcagtcagagtgcacgtcttgaagcccatcagagagtccacactggagaaaaaccatacgagtgtgacatatgtgataaggacttccgtcaccgttcgcgtcttacatatcatcagaaagtccatactggtaaaaag

SEQ ID NO: 623091 - DNA, 101 bp, Homo sapiens
tcgtagatcaggatccctatcacacaatcggccaggcataatgtaacaggaaagtgtgagggagagacgagttcccccaagaatcagcagcttgctggaat

SEQ ID NO: 623092 - DNA, 135 bp, Homo sapiens
  misc_feature (52)..(52): n is a, c, g, or t
  misc_feature (105)..(105): n is a, c, g, or t
  misc_feature (123)..(123): n is a, c, g, or t
gatcagcacatccaaaaacaccaagacaaacatccatgtggagcagaacctntcctgcctcgggagttctgaccaggttccccagcagggtgttaagcctctgtntctggccctaccagcatncgggttccactt

SEQ ID NO: 623093 - DNA, 196 bp, Homo sapiens
ccaccagacagaccaccaaagtcagagatctaggaacagtctagacactgtccatagaaatcaggatcccctgaagccttctagcctcgagacagactgtacaaaatggactggcgagaaatctccccttcaaggcacacctggattccagacaagcacttctggaagggcattctggtgtacggttgagcggaga

SEQ ID NO: 623094 - DNA, 435 bp, Homo sapiens
ggcgtgcagctgatgccttggggtcgattctagatggatgcccttcagtcctctctgtactgcccaggtctgggagatgacatagttgctcagtcttgcgggtaacgcgcatggctttctgcttccctggagttcacggcaattgctctccctcctgctcctcagatgagcatcgcagtgcgggctttctccaactctgaccttgccgagcttttgtcttttcgctggacactcggttttacatgttcgtcactagtagcacccctcccgtgggctcaggtgatctgcccacctcggcctctgaaattgctcagtgcaagtcttactatttcttaaataataagacttaaaagtcaaaattactttttgatctgtgtgctgcagaatgaatgttgtgttagcaggtgtgaaaacattaatctgtttgtacagctc

SEQ ID NO: 623095 - DNA, 460 bp, Homo sapiens
agttcgagagactctcactatctggtccagtgagagtctctgaggtggctgttgcgtccaatttcgatctagaactgtttgatcgttgaatgcttccttgttattctggtcatgataaataatgtatattcaaccgtgtacgtatcttgcacttatcctggagacattcctatacctattatgaagattggcttcagctcttaatcttagtgtgatatgctcacttctgttacatctagaactataaacacagatttcgacatcattgaagatcagcacatttagcctttttgatggtactctacaagagcaactgaggtcgtcctgttgatgctagtatttaatgtcttaaaacccgtcataaagaacagaacattttcctgttcaatctatctaagcccaacgaaactttaactgtatcccggcgaacactctatggctctctgaaagtcatttataa

SEQ ID NO: 623096 - DNA, 243 bp, Homo sapiens
  misc_feature (87)..(87): n is a, c, g, or t
acgaaagagcgccgcctaggcgaaatccaggcccaagaggccgatccttcgttctggaacgacaacatccgcgcccagaaaatccanaaagaaaaagcggccatcagcgccacgctgaacgagttcaaatcgctccgcgggaaggtcgacgacgccggcgccctcatcgagctcgccaccgaagatccgggcgataagtcgctcctcacggagctcggcgcctcgatcgccgacatgcagccg

SEQ ID NO: 623097 - DNA, 169 bp, Homo sapiens
ttctcaagaagtctctgctctctccgtggtgggtgtgcttccttgaggtttccgtcgctttactggtgtgtcccggatagagcctgacgaaatgttgtggggggtgccggggccagagtttcaacattgcccccctgaatgaggagccatagattggggtaaggagggt

SEQ ID NO: 623098 - DNA, 569 bp, Homo sapiens
cctgttatctgtattgacacagatttccttgtaaacatgtgcctagtttaccaaaattaacaacagggggggacaggaccttagaacttcttaaggtaacaatcaaactatagctacagcataagagaatcgagaaacttctgatcagaggtaacttgttctacatgtaactctacatagtacttgttacatcttcttatctgcttagaatctaaagatgtgtttagaacctcttgtcaacaactaatagactgcttatcataaaatcacatctcacacatttgaaggcagtggtcaacaggtaaagcctatgatgtgtgtcacttcaccactgccggaatatagcctctgaataccttctcatgggggacaaatttttgggaaccactcatgacatatccttacaaggaccttgaccaatgttttaagctaacttgtagggctggataatcactgtaactactcagctatcagtctataatactgcacgttcggccattaacgacgcctaagggtcccactaacaacaagcactgccatacaggacccagggactgatgctgacgtag

SEQ ID NO: 623099 - DNA, 213 bp, Homo sapiens
aacacaagcggactgcgcttgtccagtgtgttgaggatccgggttgccgtgagctgtggtgtaagtagcagatgcggtcggatcccacgttgctgtggctctggcatgggccagtggctatagctccgattagacccctagcctgggaacctccatacaccatgggagtggcccaagaaatagcccgcttttatgttccccgcgttttgtgtt

SEQ ID NO: 623100 - DNA, 404 bp, Homo sapiens
  misc_feature (22)..(22): n is a, c, g, or t
  misc_feature (134)..(134): n is a, c, g, or t
  misc_feature (173)..(173): n is a, c, g, or t
  misc_feature (192)..(192): n is a, c, g, or t
  misc_feature (210)..(210): n is a, c, g, or t
  misc_feature (229)..(229): n is a, c, g, or t
  misc_feature (304)..(304): n is a, c, g, or t
  misc_feature (401)..(401): n is a, c, g, or t
cccacggttaatgaagtctccnattggagaagggatgaccaggaaggatcatgccgacctatctaaccagctatatccgtgctatgctattggaccggatgtgcaagccatgaaccgctgtcgttggagaaganccccttacctcagatgatcctctctacttggaatttccncagaagtttgagagcaacntcattgctcagggtcctnacgaaaatcgcactgtctntgagactttggacattggctggcagctactccgaatcttccccaaagaaatgctgaagagaatccctcagagcancctcagcgaattttaccctcgagactctggcaaagcatttagctggctggctttctggcattgctccggggctcttggtgaaaatcactgggtttcnggt

SEQ ID NO: 623101 - DNA, 262 bp, Homo sapiens
gagagagagaactgctgcactaatccagatgatggggtttgaaccctgcacagggataagttgaacctaaagctgccttcttacatattttaaattcggtttcctcatacatagtgaacagtaacctaactggatatgtaaacagactctaacctactcttgtaacaagtagtagcccaggagcagttgctcgtgcctgtaatcccagcattttgggaggctgaagcaagaggttcgcttgaagccagaagttagagaccag

SEQ ID NO: 623102 - DNA, 219 bp, Homo sapiens
cccagaatggaatcccactgccctttcaataacactcttgcctctagaatcatatgttcaaagtatgaatacacacctaagctacatagtcaagtgctcaaagtattaatttcctgccttgaccttcctctatctaccctgctgtcctccatattccccgctatgaattccaatcccaattactagcaatattgacattttacactgattatgcataaa

SEQ ID NO: 623103 - DNA, 1016 bp, Homo sapiens
acgggcagcggcgtcgagggtctcacctgctgctcagatacagcggggcttaggtccgtccttgatcgtctgctttcacatcccacgttcgccatcattgtccgaagatgatccgcgaccccatgacactttttccagtaaagtgttcctgccggccagaggctcccagaatttgacgcggtgattgatgcgagttcggtaggtgtccccagagacaaggacgcgagtggactcgttaacgtgatgtcgtagtcgctagtgaggagactcgcggcgcaatttgcctcaccataatggtcgaggccagcccagggatgcgtgcgagtgagagttgacgtctcatgatgaattcaccgactatagttggtcgccacatgcgcgatgtaccttgggtgtttccccaattttggtgcactaccatagcaccgataactagaagcagtgccacctaactaagtggcaatgggaggaacgtgacggcagactgtctgagcgtggctgcttggcatgctgacgtagcatgaacgcgcaactctgcgtgcgtgcggcgatgccagatgacgaatagacgtagacatcagacgtgggtgcggcaacccgtgatgatcgatggctcatgacactacgacatctgagtactgcttcctttgcggaccagctcctattacccccagtaccataccaggcgtagtctcgtccagcttggactttaacccacgaccacagaaccggtgtgcttggaccttcgtgctgacagttgactactggtccctgaggaaacgatggccgcagtaggactgccaagacagttgtgctgagaacgacacggcctcaaaataggacggctcgcacggggacagaagaagggcctcacacgtacaagaggagccgacaccgcccaggcatgaaggggcaccgctcggaaacaaggcgggagtgccccgtggtccctccagcaagaccaccggataagtgtgtctgcccgcgccggcctgcggacggcacaggcacaagtc

SEQ ID NO: 623104 - DNA, 236 bp, Homo sapiens
cggcatgtgggccaggctggtctcaaagtcctgaccgcaagtgattcacctgcctaggcctctcaaggtgcggggattataggcaacggcgccaggccagcttccttacttgtaacatgggataaaaggtcttgatgtctgtctggtagaaatacttcaaaagcaatgatctggtgggtggccaagggtggggacacagatgaagcatgacgggccacacatcattaaccttggcc

SEQ ID NO: 623105 - DNA, 886 bp, Homo sapiens
caaaggaaaacatttcaataaaggatcatttgtgcttaactggctgggcagtcgcacagccccacatgtttccctgtcagcgactcatagtctatgcagcgatgcccgagctatcaaggactcacaggatgcacccgcaatgagccacggcgcgtgctagcatgcgactgcgcgcaccggacccgaccgcaaaacacaccgcccgacgaccacccagcgaaacaacgaggcatacccgcaggggccaatacacaacgtacacgcgacaccactcgagcctcccacggccgcgacgtgtcgcccagccacactgtggcgcaccacccacccaaaaactcctcaccacgacaccactctcacgaagaccgctaacagcgcccaccagcacctaccacacacagagtacacgcacacccccggcaataccacccgcccgcaaacacaacaccacagcgccacgccaatacgtgccaccaggcacagacggcaggtgaccagacagcacatagtacgcacacaaaaccacgcgcgcgagacccaacagcgcgacctccgcagcgcagcaaagccacgaacaacagccaccacaccccccgacgcccgacaaacactagccacgggagcacccagacacgccagcgcagagagcgacaacgcgcgggcccagaccaacacacacgagccgccgcaagcacgcccgccggcaccggaccagcacagcccaacaacacgcccccccacccagagcgccggagaacgagagcagcgaacaacagcagacagagagtgggatgaccgagcggtggggagcacgacgagcaggtgcggacacgcaaagccacgcgatcgagagtcaaccacaacggcacacctcacaccaccccga

SEQ ID NO: 623106 - DNA, 660 bp, Homo sapiens
tgaatttataaagagaaaagaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctatgctatatgatttggattaattctatataattttggacttttaaatattaaggttaaaaaatacctgtatctaattttatactttaatacctttagttttaagacaacagttaacagaatcaattttagatacaggtattaaagtataaaattaaaatttgcaatttttttaaacaaaatagcaattgtgattctcatgggggaaatcggagataattttattctttttggcctcgggcagttcaaaggtttccttatggcgataagtacggggatcccggtaatagatggcggtatggcccctatatggagagttaaaacattggagagttaaacacatacagttcgaataccaacctaggtatatatactccggggtacacttccgctctggtcataactaaaacatctacaaccta

SEQ ID NO: 623107 - DNA, 357 bp, Homo sapiens
gtttggatggaacacggagatactgtgtagtggtgaagtacaggtgcggtttggatggaacacggagataccgtgtagtggtgaagtacaggtgcggtttggatggaacacggagatactgtgtagtggtgaagtacaggtgcggtttggatggaacacggagatactgtgtagtggtgaagtacaggtgcggtttggatggaacacggagatactgtgtagtggtgaagtacaggtgcggtttggatggaacacggagatactgtgtagtggtgaagtacaggtgcggtttggatggaacacggagatactgtgtagtggtgaagtacaggtgcggtttggatggaacacggaaat

SEQ ID NO: 623108 - DNA, 363 bp, Homo sapiens
cacggtctcactttcctttatataatatatataccccagatattcataaaataaccatgtcccagtcctaagaagttgcctgggggtggcccagaacctgtgactctggggatattaatttaatttccctggagctatatcttcatctgtgaaatggggataaaaatacttgttgctgtcacaattattaccatctctccagctagcaaaattactaccagagccgttactacacacaaaggctatagaccgagcacataccatgtgccacacaccttgacaaaatcttttaatacagtttattatgtactattcaatctttacacaatgtcacgggaccagtattgtttacccaatttttta

SEQ ID NO: 623109 - DNA, 211 bp, Homo sapiens
gatccttatgcggcgcctttccaaccgagcatatggtacgaatggtgttctccagaaagacttaaaactggacatgctcttctgcagctcagagaaggctggctctggactacactaaggctgtggtcatcaacaagaagacaggcaaagaaagatgcgctccaagcagaaatcttctaggcatggaggcttctcgacgctttaactgtat

SEQ ID NO: 623110 - DNA, 776 bp, Homo sapiens
gacatctacccacttttatgtcaatatcatgggctttctggtggaggagataacataggttgatacctgaaggacaaggaaaagcttcccagatagaggaaagaggcaaaggcaaagagcctgaggtgaggaagagccctgcagagttccactccatccagtttggtgctagagcaaagggcagagtgcagtaagtggtgagaaacaaggctgagtaacttggcaagaattacattgacatgggtgtttttatttcatggtgaaaaatttggaacttttcctgagaacaagtgtaagccaatgacacagtaaattagaggagatttaaaatgtcacctgtcaagtgactgcttatgaagggttattgctcagctaagtatttctgaatgagtcttaggtctgttggccttcaatctctaccgaaaccctgagaacttgatgatgctttgttttctgagaatcgtttcagtgtgctggctgacagttccatgaggatggcaaaacttaagaaactgtagagccagtgaaaaagagatgcacagacttctgggaacctgtgtaaagcttagggaaacctggatgaatttttattggtggccattaaggtaccagtctttctcctggtgaacacacgtttttccgctttgtccacccattctttttcccttttagcactggctggctgggcgtagggaaaaccaacaattttctttggcgctcgcggttcgtgagaaagtcttaacttttaaaaaccccccaaggggaaaatctgggcc

SEQ ID NO: 623111 - DNA, 302 bp, Homo sapiens
ggtgagttagaggatccccaaagtgcgggataaggtgtgagccacgggtggatggagcttaatgttactttgatacatgtctatgatatggtgtgttctaggactacagttagcacatacctatttagtaatgctttactttgaaatagtggtaaatacgaaatcattcctataccactgaagcagcagcaggacactgagaaatggtgtcacttttaagtctttctccttaaaggaggcatatgtgaaacactattaaaatgcgggctgtggatggctatttatagttgacactggcgagg

SEQ ID NO: 623112 - DNA, 211 bp, Homo sapiens
  misc_feature (33)..(33): n is a, c, g, or t
tgcgtggaaaatgttcgcgaggcgcggtggcgncgagcaggtgttcggtggcggcgacgcttcgagatcctggctgccgacgaagtcaggattcgctgccggcgaaagtctggtcgatgacgacgatcgggcggcgcatgtttttcagctctggagatattcctcagggctggtcgcggcgggaacatgagcaggccgtcgacgcgcgctc

SEQ ID NO: 623113 - DNA, 211 bp, Homo sapiens
aggatcacataacaggaaatagagaaactaaaacaagcagagatgaaaacgaattacaaaaactaactatgcagggaggaacaaagtctgtatcttattaacatcttcaaaatgaccagaaaaggtaaaaattgggaattaaaaagatgctacagaaagctgggtgtggtgactcccacctggaatcccagcactttgggaggccaagggg

SEQ ID NO: 623114 - DNA, 210 bp, Homo sapiens
  misc_feature (8)..(8): n is a, c, g, or t
  misc_feature (201)..(201): n is a, c, g, or t
ggcctccnaaagtgctgggattacaagcccgcaccccacgcccggccccaacttttctttctctctttgctggagaggaggcttcgaggttccctgttccggccgagtccagcgccgccaaggcctcccctcggcatccccgctccagttctgactaacttacgataggccgcctctccacagagcagccccgcccaacgncgcggtcgc

SEQ ID NO: 623115 - DNA, 137 bp, Homo sapiens
cacgaggtgcccccacagccagatgcagcccttcttgcccggaccacgcaggaaagactgcgacgaccacctgcccggggaggtacggtaagtcatcatcaggaagatgtccgtgttgcatcaagtgcacgaccgac

SEQ ID NO: 623116 - DNA, 144 bp, Homo sapiens
tataccccctcacgccgtccactctgccgtatatgtatctcctcactggcccccagcactcatcttccaactccttacaggactctgccttctaggctcatcttcaaatctcctatactactcactcgtcgtgtctcgttttac

SEQ ID NO: 623117 - DNA, 660 bp, Homo sapiens
tgggttggggaaaccccccaaaagggggggaaaggttgggtttaaaattgggtgtttttaaattagaaaaaaaaaagggtccttaaaaaaaaaaaaaaaaaaaaaaaaaacaaaaaaaaaagagggcgccgccccacataacaaatacacaccacccgcagggcgccaccgatcctccacccccccccccgttgtgtgtgagaaccgcggcgcgcccctccatctaagggccctcgccatcaatacaccaccgcccgaccgccaggccggcccacccctacaacaacgcccgcgcctgaccagcggacaccacccatcctcgcccatgaacgcctcgacacgctggtgcgacgccaacccccacccacaacctcccgccggaggggcgcgcacaccccaaatgacgtggcccacaaacacaccccacgaagagacaattcaacccccccgccgccggacgaccacaatacaaaaccaccaccaacgaccgagcagcaaccaagacgacatccaacccccgcccgagcacgcacctacactcccgtccccctagcgaccagaagcaccattacccaccaacaacacacgaagagactacagccctaccacgacccacaacattctcacccccacacgccgcaccaccccacactcaccccc

SEQ ID NO: 623118 - DNA, 483 bp, Homo sapiens
ttaggatccccggggctgggaaccgtgggtgtcggcccaggtactgcccctgtgtcgggtgccaccctgcacgttactgtggctgggaagaggacaacggcctgatgggatggctctgtccaccgtgccttctgaagtcacaggaagcacgcaccatagggccggggctggccaggaatgcccagcagtgcactccttgcccttcgcaccctccatcctgccactgtggctcctgcttgcagaacctatgctgtgttccgtactgtggcccatgtaagcggaaccaaagctgacctctgcactgagcctgcctctgtggcagggtcactgcagcttggcaaccctcctaatgttaccatgctcagatgtcatacagggttcgtacagggtaccatggtgggaggagcggtggcgacgtaacctgagtgtcatctgaagctacttctgcactaaaccgttcctgcgatggaaatctctggtgtg

SEQ ID NO: 623119 - DNA, 110 bp, Homo sapiens
cagcatctcagtcgcatgcatggcagcaagcatgcaaagtgcagcagcatgcatgcactcatattgcatggtgcatgcaaaagcaacctgcatgcagcagcacacagcac

SEQ ID NO: 623120 - DNA, 629 bp, Homo sapiens
gccgggggcgaggcagggccagcagcaggcgggaggtagaagaagccggaaggcggcgaaggcggcggtcgccccggggctccggcggcgggtgagtgctgcgttgtacgttgcgcgcggcgggaggcccgcgcggggtggggaccgtgccccaggcctgccggagccccgcagggggagggagcaccgggcgggagggcgccgcggtgagggtgggggagggggcgcggggaatcccagattagccgagaggcctcgggctcggggcgtgtgtgtgcgcgcgcgcgcgtgtgtgtgtgtgtgtgtgtgtgtcggcggtggcagcgcctccattatgtggctcgagagccggggggagctgcagctgccgctgtagggggaggagccgcgggcgggcggcgggagggagcccggtcggcccgcggtggcgccgtcgcgctgcgtgcgcgcggtgcgggcacatgtctcggggggaggggagaggccccaggtcccggggcgggcgcgctttggcggctcctcgccgctgtattgtgcaaggagcgcaggggctcggcgtgacgtcacttccggcgggaggagccgggcggggcggggcggggggcggaagatcagtacaatgcggccgc

SEQ ID NO: 623121 - DNA, 1252 bp, Homo sapiens
  misc_feature (57)..(57): n is a, c, g, or t
  misc_feature (111)..(111): n is a, c, g, or t
  misc_feature (376)..(376): n is a, c, g, or t
  misc_feature (565)..(565): n is a, c, g, or t
  misc_feature (612)..(612): n is a, c, g, or t
  misc_feature (639)..(639): n is a, c, g, or t
agggcagccccgccacccgcccgggcctcgacgggcgcgccgcagggctggggaggngcggcgcggagggcgggggccgggcgcagggcagggcccggctgtgcctcgccngccgctcgggcagctcccgggccgcggcagccgaggatcagagcgcttgccccgggggtctgtcgcgtcgcaggcgccgccggagccctggccatgaggaccctgtggatggcgctgtgcgcgctgtcgcggctgtggcccggggcccaggccggctgcgccgaggccgggcgctgctgtcccggccgggaccccgcctgcttcgcccgcggctggaggctggacagggtctacgggacgtgtttctgcgaccaagcctgtcgcntcaccggggactgctgcttcgactacgacagggcgtgcccagctcgcccgtgcttcgtgggggaatggagcccctggagtggttgtgcagaccagtgcaagcctacaacccgtgtgcggaggcgctcggtgcagcaggagcctcagaacggcggggcgcccttgcccacccctggaagagagagctggntgcctggagtactccaacccgcaggggccaggactgcgggcacaccntatgttcctgcctttataactacctcntgcattcaacaaggagagaacacgacaagctacgtctccacactggtctacacacacagaggatgctggatactggtatggagtttacgacagagtccttgactccgtcactgtgctctgtgaaaacctgtgcccttgtactagatgggatgcagtatctccagagagggatacacgggtgtgtgtggattgtcagcctccagctatgaattctgtgagcgcgttctgtagttctggagatggcctggacgtcctgatggaaatgcagactctccattgggtaagcaattggtaatcctcggtgtcaaggatacttggtaagaagagttcggcgagtagaccagtgttctttgtccagctgtgcacagttgggattatgttgatatgagatggtgatataagatatttccaaagtgcatttgtaaactattctgaatattctcaagtcatgttcaaatgttttcctaaacgcttcaattttgggcaaagtcgccaaaaaatcattgcagatctgaagtagagaaaggaaaatataggggccaggttctcaaggaaaccaggtcttttatttttattttaactaagttgaagaccactcaaaaagtctgggggt

SEQ ID NO: 623122 - DNA, 304 bp, Homo sapiens
gttaattttaccaaggggtttgaattatttaaggggattcaggcagaaattctgaacctgaagattgattcagagtctcccttcagcagaattgatcaagcagaaggtagtattagtgagcttgaagacaggctgcttgaaaatacacagtcacaagagacaaaagataaggattaaaacatacctacaagatctagaaaataacttcaaaagggaaaatctaagttattgaccttaaaaaggaaatagagaaagagatagtggtaggaaatttactcaaagggataacagataacatcccaat

SEQ ID NO: 623123 - DNA, 1169 bp, Homo sapiens
ttttgtttctctctttttgctttcctcttttcgttgtgccgtctcacttctctgttgacccgtcttttcttctttttttttttctcctggtccaccactccttggttcctccgacgggcttttctcctgatgtttttgtgcctcctggccactcatccggtgtcctctcttcttgtggtgctcccaccagatcttccacacccgaatgtgttattggggaatcgtcgttgttctattctcgctatctgcactctgttcccttcccgcccttgttttggagaaaattttaaagcgctgtacctgttgggcccaacacattttgcttattcctgaccttgtgtcaccggtatcatgtgtatttatgacaccaggctagcccatattttaggaccagctgacaggataatgctggaaatcaaacaaaccagcccaactctggaccacctggaaggctcacccttcacaggcacttctctcttatgtttgagtgaataatattgtgttgttaagagcaaaattatttcacgattgatctcacggaaatgtattataactcgaaatttcccacgccaaaagaacccgctatatgcacatttctaaaaagaccacgagatgtattgagaacttaatattgacgtggcttagaacatggggctctaaagggcaagctgtctgtagaaatatcgagcccaaaggaatggaaagattaataattagatctagccacacccacctcgtgaaatagtgtttgccacacagttggtctcgtgtttttataatatgggaatttattacccacgctttgattcttctcattgagatagttcacgagccctctagaactttgcacggcctttgcacttttggtataatgggaaagaaaatatgagccattcctatggtatattcaagccactagacccctaagcccttaacgtttgaatgccacatcttaatttttataaatatggccttgtttttcagcttcactctgcacgtttctatgtgaaagattgagtaaatcacgtttttaacttgttttattaatataaaacgtaaatttggagtattcttgaggttgagtggttttgtgaatttagctgggtaaactattctttgtaacagataagattatttataaaaattaaaaaacttatattttaatgtga

SEQ ID NO: 623124 - DNA, 645 bp, Homo sapiens
gactcgacaatctcaggagagcagggagggcacccagcagtaacacatgcagaccagttccaggtgtgccaagctggcactgggtctgcaaggtctgtgtcatccaggagaaactgcagctgtaccagatctcctcctacctcaggcctgcaacagggggagaccacaattccagtacctacgtgctgaggcactttccacaattctgggctgtggagtccctactctgctccaagagcagggtgcatccaggtctcgtggcctgatggcaattgcctgtgcagtgggtatagtgcttgctaagtggtcactcaaattaatgtgcctggtgaacttggtaatggcacccctgtgatcacaaactgtggcattctcttgtcctacaagttccttgggttgtggcgcaacaattgccctggcaagctttttccccaaagtggttcttttatccctctaccaaaaggtctcccaaagccttcttcccccaaaggtcagctctgtgggcttggggggagaaacgcaaagtggcctcatccccttggggcctgtgggcttttctggacactcttggcaaggtggcgaaaaagcgcccaggttaacactgaagtgagagggcccctccgggctacccttctcacaattacg

SEQ ID NO: 623125 - DNA, 83 bp, Homo sapiens
atatcgtcgacccacgcgtccgctttaagcagagagaaaaacactgtagtcataagagctattaaatacagtacataatttta

SEQ ID NO: 623126 - DNA, 269 bp, Homo sapiens
  misc_feature (185)..(185): n is a, c, g, or t
gagaacctaataacgcatttagctataaccatccaatcccattatctcttttttccatgagggaaacctctataattccaggcaagagtggatttaatcttttaacaactttactgagatacaattcacatgccatgtcattcacccattaattaagtctacattcaatattgtttagtgtattncagagttgtgcaagcataccatggtctaattttatattttttggtatccctgaaaggaaacccatcagtaatcaccccaacctc

SEQ ID NO: 623127 - DNA, 216 bp, Homo sapiens
tcctcacgcttatactccttcaacgctttatacttctcaacgctttatacttcttggacaaatactgcatgttctcacttataagtgggagctaaatgataagagacacatggacaaatacaggtgaacaacagaaactgagacctacttgaggatggagggaagtataaagcgttgaggaagtatgaagcgttgagggaagtataaagcgttgag

SEQ ID NO: 623128 - DNA, 303 bp, Homo sapiens
ggccctccaggtggcagccttaaggacccccccccccaacaaaagttagcaggggggtccccatgagtcccccccatgacctgccgacagtgttgccccccggaacttttgtggcccccaccgctcagcccttcccagcacttttccccctttgtcccgagcctccttttcccccagcagggggccaggcctggcccccccctcccttgtgtcctgagccaaagggacttttttatttgggggttttttgctaaaaatgccccttttatattaataaaaaatgatttggggttgggctcccca

SEQ ID NO: 623129 - DNA, 177 bp, Homo sapiens
ggactctagcaggcatcccctgggtgcatgttgcatgtgggctggtgtttgaccaatcccccctgcggtgcaagcaattcgggatctggctgcgctatgactcccgtgagcggcacccacaacatgtacctgggaataccgtggacctgaccaccgcatggcgctgtcacccagtgt

SEQ ID NO: 623130 - DNA, 312 bp, Homo sapiens
  misc_feature (43)..(44): n is a, c, g, or t
  misc_feature (107)..(107): n is a, c, g, or t
ggctcggccctgttcctggactgttcttccccttacatcatgnntctgtaccaacctctacttctggaaggctcccaggctgcaccctgtcatctgtaagggttttnagctcctggctcaccagcactttctccaaaatcactcctggttcagttcttggtgacttcaacttccatgtggatgatcctcccattaccttggcccctccattccttaaccctctcagccaacgccctctcctgaccccagccactccctcctaggtgtacactatggctgcactgacccattttcacttccgggattctatcc

SEQ ID NO: 623131 - DNA, 524 bp, Homo sapiens
  misc_feature (7)..(7): n is a, c, g, or t
  misc_feature (100)..(100): n is a, c, g, or t
gggaacngggctgacaaagagagggaagatggaccactgtctgaacgtgtctatctctagcctgctgggaagatggagccgcctgaatgtgtctagtccntagttcctgccgggaagatggaaccgccatcttgaacgtgtctagtccctattcctgccgggaagatggaccgccatcttgaacgtgtctagtccctattcctgcccggaagatggagccgcctcttgaacgtgtctagtcgttagttcctcccgggaagatggagccgcctcttgaacgtgtctagtcctaggtcctccgacattcacccgtacaagctcccagctggcttgtgtatgtctgcagctcgattgacaggctgttcattgttagaaaatgacttggggctgcttttcgttaaggagaaaagctgccgggcgcagtggctcacacctgtcatcccagcacttttggaggctgaggcgggtggatcattaggtcaggggttcgagacgagcctgaccagtgaaaccgcgtctctact

SEQ ID NO: 623132 - DNA, 151 bp, Homo sapiens
tggacccggaatggcagcgtgctggcaaatttattattagtagtagtagtagtatttttgagatggagtttccatcccaggctggagtgaagtgacatgatcttggctcactgcaacctccgcctcctgggttcaagtgattgttcccgct

SEQ ID NO: 623133 - DNA, 199 bp, Homo sapiens
gaatgatataatggactctgggacttggggggaagagtgggaggcagtggggataagagtacacattgggtgcagtgtactccttgagtgatgggtgcacaaatctcagaaatcactactaagacttacctatgtaaccaaacaccctacctgttcccaaaacaactgaatatgatacaaattttaaaagtgatgaaag

SEQ ID NO: 623134 - DNA, 458 bp, Homo sapiens
  misc_feature (332)..(332): n is a, c, g, or t
  misc_feature (370)..(370): n is a, c, g, or t
  misc_feature (422)..(422): n is a, c, g, or t
  misc_feature (437)..(437): n is a, c, g, or t
  misc_feature (449)..(449): n is a, c, g, or t
agagcagagcccaatagacaggccctgctaccccctccccttgcacctggtgacagtgggtggtttgtagctgagaagatttggtctaaagtttcatagtttatgtgagccactgcccaattagctgttcttgctgtgactaggatggcaggcaagtaaaaacgtgaaaccagctcatataaatgctgggttgacttggccctcatcacatatggaatttgagcttttgtctgtgacagtcaacaagaccaaatttctatatgaaattttaaatacaaactctacagttaggagaaacaagcataggccatagttagtactctgggaggtgnttggtcttataaagtatacatttgctttctatgggaanatgaagaaatttttttagcatgcatgaaactcctctgacagaattgagaaanaaataattataaganccctaaactaanggtcagtag

SEQ ID NO: 623135 - DNA, 101 bp, Homo sapiens
  misc_feature (33)..(33): n is a, c, g, or t
  misc_feature (69)..(69): n is a, c, g, or t
acgtcaactcacgcgcacaggggtaaggaccancccagggcaattttgcagaaatgatcatttgcacanaatgggtttccctcacaggggagaaacttgcc

SEQ ID NO: 623136 - DNA, 369 bp, Homo sapiens
ggggggggggggaggggaaaaaagatatttcacaagaaaggcatgggaaaagaaagaggtaaacgtgtgaaaacaaatttaaaactttatattacagagtgccaatagagaggtagcatggatggactggctttaatagagaaaaggaaattttaaaaaatatgtaaagaaagtatatacttaaagaaaaacagttaaagaaattatgaaggccacgtgttgaataatcaaaatccattttaaagcataaacaataaaactctctctctctctctctctctctctctctctctctctctgtgtctctctctctctctctctctctctctctctctctctctctctctctctcactctctctacacgtgc

SEQ ID NO: 623137 - DNA, 388 bp, Homo sapiens
  misc_feature (64)..(64): n is a, c, g, or t
cggctcgtacccttatggtccttatacactccatgtagctctctgtactgagcctgtgactcangctgcagtgctgacaaggcttgtcccaagtgtattgcccctagtaactgcctcctattgaaactgtcagtgaggtttaaatgactaaataggacttactgattaggaatcaaacaagtagtattttcctccacacttatgaacaataccctcttctcaggaatccctgaaggttgcaagtgactggagaggcagctgtttgtgagtgaaattgcctggacccaaaaaaggtctgactgtctgcctacttgagatgaacatttctggatagatgatggcaggtctctctctctctctctctctaggaggaaattagatcatagga

SEQ ID NO: 623138 - DNA, 1250 bp, Homo sapiens
tacatatgactcatacagtgaaatcgcagaaatctgggagtgctaaggtacgggaggatcaactaagaggacgtaagagtgtcgtagaacactacatgggagagaaatgtaactgaaggaacatgatattcaatagaatataaagttgatgttatgtagagtatggtggaatgtggtgatgtaagtagaagatggatttgagatgattcacagtggatagactggaagtgtattatgttctagatgacaggaagaaagcaggtcacgactttagagtcatgcgtagagctgcctaagagtactgagcggaaaaacctagtagtaagatgaaacaagggttagagattctgaaggtaaggtggaaagaatgattccatatgtaatgatgtcagagtgcgaaaaattcgcaatcgacaacgtgtactatccaaaggacagaagtcttccaaagaaatcaatagagcgttggagttcctatttggccacttataagtcatgagtaatctatatgggttacaagtgggaacgcagtgtaccctgtataaggaacaggaacttcgtaatccattgaattgcagatcaagagatggaagaagtgaaatacctactggacattaaggcctaaagtgcagatttttcgaatcatgaggcaggagaattacttgtgaaagtgtagagtgaaatggttctgaaaagaatctggaaagagggaacgctggagagcaaagataagagttgattggcgtgaactaactattcgacaagtggttttggtggaggaaactaggacttgattggtcaagaattaatttggtaacaactgattgtaagaaaaggcatggagttcgcaagcaatttctctggaaacttcaggttcgttcgagcaagcggcggaacaattgtatcccgcggaattcaataaaaggaccgcagtggcatacaatgttcttggaacagaacggaaaaggggtcacacattcgacctgtgaaagccacgtcaatttcatttggcagttgaacctccccatgaagcgcaaaaactgggttgtgctccacaccacaggttcgttcaagggtaagagatccgacagtttaattatgccccagcgaaaccaaagttacgacggcacaatggtcccaggggaatagcgccgagggacactggtctcacacacatcttaaaaagggtgctacttacatcggttaatcccgggggagacgcaacccacagaatacacctctttacaatg

SEQ ID NO: 623139 - DNA, 302 bp, Homo sapiens
ctcgttacagactgtcgacaggttgttgctaccctgatatgggtttgtgcgtcacccacccaaatttcatcttgaattgtagttcccataatccccatgtgtcgtgggagggactggtaggaggtaatcaaatcatgggagcaggtttttcccatactgttctcgtgatagtgaatacatctcactaaatctgatggttttataaaggggcagtttccctgcacgtgctctcttgcctgctgccatggaagacataccttttggctccttctttgccttccaccatgattctgaggcctctc

SEQ ID NO: 623140 - DNA, 414 bp, Homo sapiens
agcaagagtaacaaagtagcactgcagcctctcagctgtgtcaaaaacagcagggagacaccagtgctaagtgggtgaggatgcagagggaggctgtgtccagcctggtgtgataaaagtgtttaggcaccaggcgcggtcactcacgcctgtagtcccggcacttcgggaggccgaggcaggcggatcatttaaggtcgggagtttgagatcagcctggccaacatgccaaaaccccgtctctactaaaagtacaaaaaaattagctggacatggtggcacatgcctgtaatcccagctactcaggaggctgaggcaggagaattgcttgcacccaggaggctgaggttgctgtgagctgagatagcgcctccgcactccagcatgggaaacagagtgagcctctgtctcaaa

SEQ ID NO: 623141 - DNA, 777 bp, Homo sapiens
tgggtttaaactttttattaaaaggcttaggatacagatggacttccttccgtaaatgacggtttaactttccctgaagtaggacatatatgcactctgataaaacagaatgagaagtcataatccaggggaatccctatacaagggtgctgactccgtggtgttgggagctgagctcctcacagcagcttctttcagctatcttataggaataggtgtcccggtggggcaagaaactacatgggtctctaacggtgatttacaactcccctttctccaggggaataaaccactttcacaaagagcgtgccctagttgtataacccacagatttctagctggcaacaagtgtgacaggggacaatctagggggaacaaacaaacctattaagagaaacatcctaccactggaagtaatcatacttcctcatggtctcccgaaccagagacccgttctgggcgggccctttacccaagggaatcttcacaacacatcgcaagttaatataacctagtccatccactggtacgctacattcggtccactcaagggtcataacacccttttgcaaaaccacaccaattttgggtcttaaaacccagcaaatgtggggccactcaaccagatctggttggcccttcccccacatttatttactccactggagcctcggcatccagtacccgggcccgtgacgaacgtatggctttccccacaagtcccgactgggaagtacaattggggacctccactatagaaatggctcctaacccaga

SEQ ID NO: 623142 - DNA, 552 bp, Homo sapiens
  misc_feature (380)..(381): n is a, c, g, or t
ctactatgttaggagtctgagctcagagcttccgagctgatgatgggctacagtacaggaactcaaggacttccgctcttgctgctacaactggcagccaaagtgaagaggttggttctaggtcgggcctagctctaatgtgtctgcaggctgaggcagcagagtgccttccagttaggacaggggtgcaagagcacacttgtcacctgggatctgtgactctggggcatgaaggacaaggcctcggtggaagagaagctatgtcccctcccatcctgtcctcagtcttggctccccatcctctggcctgtttgtggacagatgctgggacagcatcaagaacagctaccttagaaactatttattcatcagaagccccnnggcttgcaatcctggaaagatattttcaacttgctgcttgtgcgggatgtacaaaggaatgaatggtattttattgctgtaatattgtataatactgtaactataccttaatgttgttacttactgtaaatgtgctatggttttatcaacaataaacactcattaacattg

SEQ ID NO: 623143 - DNA, 211 bp, Homo sapiens
tgacgactggtggtgaaggtggtggacgactgttttgccgacgactggtggctgtggggttacgtgactggtacttggtggtgctggtggtgactggacgtactggccgtgaccggtgactggtgggtgtggcccgtggtggtgctgttggtgactggtctcgggacttggtggtggtggtggtggtgtctgtgtggacggtggtgctggc

SEQ ID NO: 623144 - DNA, 200 bp, Homo sapiens
agtgacgacttgtctgtctttcatgttgctgtagcatccttagatactggggtgggaggtcttgttcgagtgcgaagggtcatctctagggcctggtgctatcagttcctttgtgtgtactcctgaagcctgcgttggtccagagcggaggctgtgtgcctcggggagttttcctctatacatctctccccgggatacag

SEQ ID NO: 623145 - DNA, 515 bp, Homo sapiens
  misc_feature (178)..(179): n is a, c, g, or t
  misc_feature (414)..(414): n is a, c, g, or t
  misc_feature (427)..(427): n is a, c, g, or t
  misc_feature (480)..(480): n is a, c, g, or t
  misc_feature (487)..(487): n is a, c, g, or t
  misc_feature (507)..(507): n is a, c, g, or t
taccagacaactgataaaagggtttttaactttcatataaagttttgctttgctgatctgttttctcctttttcctagcatgactatgatatgagggtcgatgatttccttcgccgcacgcaagctgtggtcagtggtcggagaagtagacctcgagaaagagatcgggagcgagacnngaccgccccagagataacagaagagatagagagcgagacagaggtcgtgatcgagaaagagagagagaaagaatatgtgatccgggacagagacccgaggggagagaaggtcgttatccgaagataattgtgcttttggaagcactgactgaagataaagaaaatattgtatttttttttgtgtgtgtttacaaggtaggtaaaatttaattttcagctggtcgacttaaagccncattggtgtaganggatttattatccccttttgttcccagcatgccggtaggaataagacctgggnaaactcngttccgcccaaaaaaatgcncggttgac

SEQ ID NO: 623146 - DNA, 1065 bp, Homo sapiens
ccaggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcactatcggcaagacgttgaactgaactgaacgacgcagacgcggcagaactcctaacggacgcgagacttggacaggcctggactccccattgcttttctacacaatcttgcgacacctttgctccttcactccgaactctacgacactgtccaccgttctaactctctcctcgcaaccacgccctgctaactcggcctgaacgcagagacacgggcctccaacggaacccaagagcacgtggaacaactgcaaaacaagattcgctaaacttgttctcacagcaccacagtgaccttatcaaccaactggcggaggttgacaccgccccaaattatctctcgtccaaacctgctaagggcgcacagccctccccagacacttccgtacccccatattctgcaccaccaacaacagggcacctcacaaagcacgccatatccccttcacccatgcacaatctcgcgcacaccaacctttgcgctcgccccacacccacaccacgcccaactcacatccagcaccaaaaaccttatcacccctgctgacaccaccttttaaccccgatccccctcaacaagcacaccatacccctcccgcccaaaacgccacacctctccacacacggcgcacccttcggcgccattggcactcaatctcggggcaacagcgctggccccagaacgaagaccgcagacgcgccaccgctactccaacgactatgaggcaccacgtagcagaagtaaacgaccccgacaggatggaaaaccccagacacgcgcccaagcaccgccaaaaagccctgggacgcccgccgagcaccgtacagcagacgcaacaccccccgtgcgcaaaagacaccagcaccactagagccacccccccaccaccccgcaccaaa

SEQ ID NO: 623147 - DNA, 763 bp, Homo sapiens
ctcatccatgtatgatgaggctgatctgatctggtgtcgtacgaggctcctatacgtaatgctggttcaaatcagagatgtctgatgcacagctgacagagcaaagcgtggaaagagccactgaggactatatgatggaatgtcgtgtgtgatactgccatacatactcttatggaggctgattgctgctaatggctgactgtgttggtacgccagacgtgcatatcatatgtggtggactgcgtaacacatacctctaaacgttctgaaggatcggctgcccttcagttccccaatgaataatagcacagtgggctactgctcactccagtagaagacgatatcactagtgcctgcacttgcctcagctgcacatattattatctgccaacctgatcccttcacgctcaacgatatttctaccgatcgtgtaagtctattctctcttaggggtatcactcctgaggtaccactgccacaagctccggggatgttcacatttttagtgcccaattgacacttcaacagtgtaagacgccagaactgctctagcccactgtagaagccatgctcttctatcatagatgctattgcctttagtgctgaatcgttggtgtaacagcgtcgtggcatgttgcacactgcttttgatggttaacataatctaccaggtccatgacccctcgtgtgatccatgagatgaactctacttacattggactgtctaagggtctgtttggctggcgtgcatcattcattgctc

SEQ ID NO: 623148 - DNA, 299 bp, Homo sapiens
ttcttagtaccaagtactctccaaagactagaattctccaactggaggtgctcctgttttagatgtgaatgaggtgattcagacgcagaatccacatattatatgtaactcgtttactggtcaatcattgctacatcatatgtttactactgtcgagtggttttctggtcagggtactttttctgggatgcttctcaatttcctatgcaaatgcattgttttggtcaatgtgatgtgcactcagggtccagaaacggaaactccattagcactcagggtagctgaattccccataataa

SEQ ID NO: 623149 - DNA, 99 bp, Homo sapiens
ggcagggttcagaaagattttgcaaaatactagtaggcgtattaattattatcctatatgtatatcccacatctcaaaaggatcgcaggcaagactatc

SEQ ID NO: 623150 - DNA, 328 bp, Homo sapiens
agggccccctggaaaaaaatagttttttcattagtatttctcgggaggacccaaaagttaaggtcagcttgttccctgtaatttttggaaaaagttcccccagcccttcctgaattcagatcatctcaaaagtttggagggaaatctggcgaacccttcgtttgagggactaatgtaagtgtatgtccccccccctggtggcccccaaaaacttactcccttgtattaagggcccttcttgtatttctaaaaaaatgcctttcccaaaagtgaaatttgttatgttctggcttttaaaaggtaaaaaataaataaatttcatacctta

SEQ ID NO: 623151 - DNA, 889 bp, Homo sapiens
ggagagagagagggcagcaggagcctggagactcgcggagcgggaaccggacaaatgccacccgcttgcggatggaggagctgaactgagcagcaccacgtatgcgctgacggagtagactcagcagacaaacaagccatggtccacatgtgatctggtcacaacagtcattgcgtgattctcattgagacaaacgtctcttagtgagctataaacctggggagtcattcaccagaagagctcgacgtcttgagaggggtcaaggcgtcattatggagacagaccataatgagaaagactgaactgaataacatttgggttctgaagaaccattctaatgcaggcgtaatcctcctagtgtgatggtccctagcaaaaagtccgtgaggataaatgcttaagatcacgagaacccggtgaagaattgggtaggacgcaagtgttgagttttgactcatgcatcaggaagtgaacggggcggaacgttaatccatagaacagtagccaggacgttgaaactttcttatctaatatcgagagaagcgtatggctcttttcagcactcccatacaacgacaagaaaagacgtgggtattcttgggactactacatgtctaaggagcgcacaaacactgcttagtaccatgcatcctaggcttgacactcttgggggacgacatgtagtgggggaagctctcaatcgcaaaagaaagggggccgttctggtaacccaaggaacaatgggtatcatgactccggcgataccttgtgaatgggggaggtcagaacgttgatgcgaatgcatggaccctagtgccatcgttgaagggccaagaagacctgctggattgggtgccattcccgtttactctaaacttggccccaatgc

SEQ ID NO: 623152 - DNA, 146 bp, Homo sapiens
gtgcgtagcatgatgagatctagagtatccttccgaaatcagtcttttgacatggattccgatgtgctaaagacattctccggcaaatcctatcaaggtctcatttggtactcgccgggccgactttaatcggggtggtggcaatg

SEQ ID NO: 623153 - DNA, 156 bp, Homo sapiens
acgacttatattatctagatacctccaagcaagatgctatagtagctgtgtcttgtgtaacagtaacaatgcaaaaaaatctataaaatatatttcttagaataaataaatatccaactctttacatctattgtctttctttctctcttttttttt

SEQ ID NO: 623154 - DNA, 426 bp, Homo sapiens
  misc_feature (2)..(2): n is a, c, g, or t
  misc_feature (26)..(26): n is a, c, g, or t
  misc_feature (29)..(30): n is a, c, g, or t
  misc_feature (387)..(387): n is a, c, g, or t
  misc_feature (390)..(390): n is a, c, g, or t
anaagtgtcctttgagcttgtcaccntgnngtctttcctcactgcttaaggggctggctttttaaccattaagggctaattgcccggccattccgaattggaaaaactcttttttaggggttttttccccaccctgtggggaaaaaaccccgccggggttttcccggggagaaattttttttttttttatttcccccccccctttcttaaatggcccccaaagggggggcgcccccccccccccccccttagagggggggtttttaaaaaaaaaatttttttttgtttttccacccgggggggtgtttttttttggggggggggggtttttaaaaccccccacaaaaaacaaaaggggggtttttttttttttgggggggggccccnttncccccccccccccaaaaaaaaaacaccccctccccc

SEQ ID NO: 623155 - DNA, 349 bp, Homo sapiens
ttgtagccccattcctcagaacactggtcatgtattgatcagttgagtagctatcaaagcggtattacactgctgtttaattttcatttctctggttactagtgggttgaggatctcagtccatttgttgtcatgtgatccttcacttcgcctatcatgcctttgtctacttttctgtcgagttactctcatttacctgttgccttgcaaaactttcttgtatccttgcaaaactttcttgttgccttgcaaaagcctaggtggaaggatggcttgagccgagaaggttgaggctgctgtgagccaggatcatgtcactgtactccagcctgggtgacagaatgagacc

SEQ ID NO: 623156 - DNA, 140 bp, Homo sapiens
tcccattgatccaatgaatcccaaatggaatcaatggaatcccaatggaatcccaatggaatcccaaatggaatcccaaatggaatcccaaatggaatcccaaatggaatcctctccattggtttctctccttccacaag

SEQ ID NO: 623157 - DNA, 312 bp, Homo sapiens
gcttggtacaccccccgccaatcactgagacaatgcagggaagaaggctctaatcaggtgctgcagctcaggaaatggaagatcggcctcaaatccatctccctgaccaactaaaatcagggctttatatagcagggaagaaatgtaactacatgcaggaaaacaggaactagggaggcgtaagaaagaagagttgggcaacagggagcaggcgaccacttgggcgatcatgacagataaggggtctggtgtctcattgtccagatgctatgatccgctacgctttagttccatgatactgactgacagtcc

SEQ ID NO: 623158 - DNA, 269 bp, Homo sapiens
tctagaggatccctttggctccatcatgtgcatcatgtggtagggacaggcgggcggctcagtagcaggtgccgtccacctccgccatgacaacagacacattggacttggttgtgttttacccgccaagcggtcgatggtcttctgtgtgaaggccagcggcagtgcctcgtggcccaccatgcaggagaggggtgtccccctttcttccagttcctcgggttgccacgcgcagttatgctggtcacagcgtaaggtggtggtgccct

SEQ ID NO: 623159 - DNA, 137 bp, Homo sapiens
ccattattagccgcgaggttagtatcactacctcctggaccggaacctctcctgcaggtggtgggggtccctaccaaggcaatgccagggctttgttcattctccccagtgagggaaagatgcagcaggtgaaatgg

SEQ ID NO: 623160 - DNA, 105 bp, Homo sapiens
gcgataatatttggtggtcctcggaccacaccctgaaaaacctaattctcttgtatcttttttctaaatccagagttttctgacaggcccctggcttccccaggg

SEQ ID NO: 623161 - DNA, 180 bp, Homo sapiens
cagccaggagtttccatgctgttttgaagaagcagattcctcacccacccttcaactccttcccaggaggtaatcctcctccaaatttttggaaaaaatacccctccttttttttgataaaggctggggggtgatgcccctcccccagtttcccaataaagctatgcaaggcaggagcca

SEQ ID NO: 623162 - DNA, 88 bp, Homo sapiens
gggggggtaagaacattataaagccctttgtcggatttggatagcattgtgcgaaatcaattcatgcgttggggggttcaccaccaac

SEQ ID NO: 623163 - DNA, 189 bp, Homo sapiens
cggcacgaggattttgtatacaaagacctgaggacttgaaatattgtaataattggagcttgtctctgctttaagggcaccactcgcccctgatccatcttggtttcccgcacaaggcagcaggattgcccatgaatgaacatgggtgaaatcgttggatacaggtagtaaatacattctatttcctga

SEQ ID NO: 623164 - DNA, 161 bp, Homo sapiens
gctccttgcgtgtactgggtcttagtcagacttgctttctttctaggctctcattgacttctgccatgcagatgtgagtcagatgcatttgttctctctggctcgtagcgcgctcagtagcttactccaacttcaggctgtagcccagtgcggcgcaggct

SEQ ID NO: 623165 - DNA, 892 bp, Homo sapiens
  misc_feature (334)..(334): n is a, c, g, or t
tgatatggtggacagtgagagagtgagagggaggggggctagcggcacgacttcttatctaccagcgctcacctggtccattctgatggcaaagatgatccattgtagatctaaagacagtatatttgtgaagatcttacagaaactttggaaagatgcatttagctcagcgagtgctgacgcggaggtgaaagacctgctacaagcgggtcaactatggatgcttatagcccaatcctgatttcgagttggaggagtaaacaattttttgttatcatggcgttgggaccgatcttatcatttggctggaatggacctgtgaccatgagaagcnaattacgaggcgttttgcggcgggttcggggcgtttatacgagtgtagtgacccccttttctggtagcatcggcggttggttctactcagccgcgtgatgtggtatttggtggagggctttgcgtgtggtgtttggcaacgatgactcgagtcctgagaatcgttgtcgacgtcgtaacgactgtgcgcggcatattagtaaggggcgtatttagtatgcgctcggacgtatagttctccgtttctcactcgcatttttcgcccgcgttccgcgctatttatgatctcgcgcgatatcaggctgtaatctcacgtcgaccccgataatgcgatcgtgaatcatcctctgtgtcgcccgggtgatagttgtggcgacggccgttgtttttcattccgcgttatgcaccgccgtctgcgtcgcttcgttctgggatttcgcccccgcggctgggcgttggcggtgttagcgttcgcgcgcccccgcccccggttttttctccgcttattctccgagcggcctccgccgcgcgtgagtacgtctatggtccctccccgatt

SEQ ID NO: 623166 - DNA, 470 bp, Homo sapiens
  misc_feature (272)..(272): n is a, c, g, or t
  misc_feature (275)..(275): n is a, c, g, or t
  misc_feature (290)..(290): n is a, c, g, or t
tgcttgagcccgggaggtggaggttgcaatgagctgagattgcgccagtgcactgcagccttgagcggacagagggagaccctgtctcaaaaacaaaaaacagaactacacaaaaaaagaaaaactcaaaacttagcttgagttacaaggtcctatagcaccacactcttcttctgccgggcccactcacgaaggtgtccgcgccaggccggacctacacctccacgtgcggcgccggctctttcggctggagaggccgcgcggggaggctngtntgcgcgggtccgacncacgggcatcctatcctcccgggccgcgggctcgggcttgggcgccctctagtggcggaagaacgtccccaggccgcggtccggacagcgcaccccgtggtgggacagagagaccccgaagtggcaccgaggctgcctgtggggtgtcctgtgttcccttttcgagcacagcgcggtcgc

SEQ ID NO: 623167 - DNA, 284 bp, Homo sapiens
gtgcacggcatttagcagactgctgggttcagttcccaagcccagcactggctgtgagaagcattcgacttctttatgccttgatctccctacctgtaagatggggataataggattgttgtggccatttatgagttcttatatgtaaagcacttggcacaacaataagtgttaaataagtgtatggtattattgttgttgacttccttccattcactcgtaggcgtttcagcaacagggtcacctctcctgggaagtcctccctgactacccacaatcacctg

SEQ ID NO: 623168 - DNA, 997 bp, Homo sapiens
tgtggtgtgttttttttgattggttgtttcgttctgtgttgtgtatgtcgggggtgatgttggcgctgctcgttggtgttgcgtcttcttttgtggttttgtggttgatggggggtgtttctgttgggtgccggtgagtgtatggtttgcgcggggtgggtgggtcgtgttcggcggtgtcccttgatggctttgttatgcctctcgggtctttgggtttgttgtttctctgtgctcgctgtgatttgtcggtcttgtgtgggggtgggtgcgctgctgtgtttgttgtctgtgtgtttgtgagggtgtgtcgtgggtggccgcggcgtggttggtgtagcaaatctctcttgttcgtgggattatgggcgccgcgctcccggggggtcgcgcgcacttggggagcgccccgcgagtgttgtcggagcgcttctctcgggggtatttcgctggtttccgcgcggtgtgcgccacggcgcagtatgtgttggctcctataggggctggggtggtcgagtgtgttgtgcgccgtgctcttcgggagagtcccctgtctgcctgtgtgcttcttccacagggtagccgcgctccgtgtatcctcgccgcgaggggtaggtaggggggttaagaggagagtaggggagaagataggtaggcccgggggaggagaggaaggaaaaggtggtcgcgcggaagaaagaaagaagaagggaagggaaggaaaaaggaaaggaaactggcgcttggcctcgtcgcctcccgcgcacctcgtataagaatttctggcacaccccgggtcccggcccccttctcctcggggcccaacgtgtccggtgttcccgaatgccacggctgcacgagaaaaatgaggcagcacctgaaacacacgtggagctagcaccactaaataaaggttattacctccctcttttattttttgcaccacctaattaattaactactgccacgggaaaagagaaagccggccagaatgcca

SEQ ID NO: 623169 - DNA, 628 bp, Homo sapiens
  misc_feature (589)..(589): n is a, c, g, or t
cgttttgatgtgagagaagatctctcgtcgtttcctcaacgattcgcaggcgttcaacgaagcctttgcccgtgcctggttcaaactgacgcacagggatatggggccgaaatctcgctacatcgggccggaagtgccgaaagaagatctgatctggcaagatccgctgccgcagccgatctacaacccgaccgagcaggacattatcgatctgaaattcgcgattgcggattctggtctgtctgttagtgagctggtatcggtggcctgggcatctgcttctaccttccgtggtggcgacaaacgcggtggtgccaacggtgcgcgtctggcattaatgccgcagcgcgactgggatgtgaacgccgcagccgttcgtgctctgcctgttctggagaaaatccagaaagagtctggtaaagcctcgctggcggatatcatagtgctggctggtggggttggtgttgagaaagccgcaagcgccgcaggtttgagcattcatgtaccgtttgcgcccggtcgcgttgatgcgcgtcaagatcaaaactgcaattgggatgtttgagctctggaggcaattgtgagcgtntccgaaatattggcgctggttggacggttcccaccggtg

SEQ ID NO: 623170 - DNA, 203 bp, Homo sapiens
cgcctccccttccctgcagttgggattcctcggatccgatttagggtaatctgcagcttccgtcttcccggcccattaagctttcaaggaagcaacttgaaagttacaactcaaggcattcttggtacctccaaacttttacttccccactcccaccccaagctcaaaagggagctgggagagactctttaggaaaacaaaac

SEQ ID NO: 623171 - DNA, 211 bp, Homo sapiens
cacgaagaaaatgaatagggacgttacatgcaattgatcgctgttcgatgggtttcggcgacatttcgcagcctgttatcctccctgacctgctcgtgaatcatggattccctgcatgctccccagcctgcccctgctgctggccctgccgttcctgatggcagcggctgttgcggccttcccccgtagttcgcgctcgactgctgcctgg

SEQ ID NO: 623172 - DNA, 877 bp, Homo sapiens
ttttggctataattggtttatctgcgtgtaaaattggaaagtaggggtaatggtatcgctctgcaatgtcggtaggcgctccttggggttagatacataccttatccccggtaccttagtgtcgtagatctcattcttctgtggccgtctatctcacgacctcatgcccaatccgccgcgtcaagcgccgtgccccgcaatacctccaggccgtatgccctgtcgtctggcttttgacggctcggtaagactcttcaaatgggttacgagttctcaccatgaagcctgtttcgctttaggtatgacagatctcgatgaatatctatttccggccgcaatacgtctgggaacatataggtagcagataaaaccagactggggtaagcttcaccttgtgattttttaagacagaatatacacgcacagagtaaataggttatcatcctttcttgtcccccaaagagtaagcacgcgctacgatacgtacgcttattgctgtcttattggcctagtgccgaggtggaatgacgctgcttttgggggactggcacggaagggagactgggttacacctgtggtgctttgttgtaaacaggcagacctggccctttgcctagactgaggagacacacgaatggacgccctgggttctgcaagcccactcttcgctgtacctttgccacatggtactgttatgcttgccagctagaaggagggtcagggattttttacagtctgagcatgagtgtctgtgagtgaggcggtatccacattctcgaccttcgaagtcatcgcagtttctgtttcccagaattaacgccggggagatgtgcatttcataaattaccccgaggctgtctactacgccttctttccg

SEQ ID NO: 623173 - DNA, 295 bp, Homo sapiens
  misc_feature (286)..(286): n is a, c, g, or t
tcgacgacctttctattttgaaataatttcatacattaagaaaagtttgcgcctgtaatcctagcactttgggaggccgaggcatgagccaggggtttgagaccagcctgggcaacatggcaaaaccctgtctttacctaaaatacaaaaattagctgggcgtggtggtgtgcccttgtagtcccagctacttgggaggctgaggtacgagaattgcttgagcctgggaggccaaggctgcagtgagccgagatctcaccattgcactcctgcctgggtgacagantaagaccct

SEQ ID NO: 623174 - DNA, 400 bp, Homo sapiens
aggcatgagccaccacacctggccaagaaaatccttttaaatcctttattacccaacattagccatgccaagcagccaatatttctggcttctgaactttaccaaaggtaacctcccaggtgttcagagaaaggaaaatttaaggtggttcatgaaggggaagagaatcaacaaatgataaaggtcacaaagatatcaagccagaaaggactcattccctaagccaggattgaacccgggctgccactgtaaaatggcagaagctaaaacaaagcactgccatgtggttacaggtcacgcttccaaggacgtaaaaccagatggaggcctgcagcaaagtttgccactggccagtttgctgggcttgattcaaacagcaggcctatggagtcctagaccc

SEQ ID NO: 623175 - DNA, 167 bp, Homo sapiens
cgcagtagtcgtggtgttggctttgctaggatggaatcaacagaaaaatgtgaagctgttattggtcgtgtaaatggaaaatttattaagacaccaccaggagtttctgcccccacagaacctttattgtgtaagtttgctgatggaggacagaaaaagagacagaa

SEQ ID NO: 623176 - DNA, 147 bp, Homo sapiens
  misc_feature (110)..(110): n is a, c, g, or t
  misc_feature (126)..(126): n is a, c, g, or t
  misc_feature (143)..(143): n is a, c, g, or t
gaaaacccagtgattattcaagtccttttgtcatacagaccactcaagggctgaagtgttggtaaccttcatttcggtgtccaaagcctcacctgctgtgaggatttggntcgaaatgaaggtgangccacccctgagatgcntttt

SEQ ID NO: 623177 - DNA, 1835 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaagaaaaaaaagaaaaagagaaaagaagagagaaaaaaaaagaaacaggaaagacaacaatgaaaaaaaggaaaaaaaaggccgtaaaaaacaaaagaggaagacgaggacacacaccataacaaacaggacacaacagaaaacaaaacgacccagaacacaaaaagaagaagcagaaacaacaaagacagcaggagaaggggacagacaagcgatcaaagacagacgcaagcaaccaagacaaaccagaaagaacgaccagaagacaagacgaagaacagacagacacgaaacagcatcagaagtgagacgagacgcaacacacagaagaagagacacacaccaaaggacaggaagtcaaagagacgaaaagaaagaaaatgagaacataagagagaaaaaggaagagagcgagcgaagaaaagcgacgggacaaggaaaaaagaagaaagcgacacgcaagaagagaagagagaaggacaaagaaagggcagaaacagcgccagcagcagatcagcaaaaaacgacaaacgacaaagggcgggcgacca

SEQ ID NO: 623178 - DNA, 1012 bp, Homo sapiens
  misc_feature (281)..(281): n is a, c, g, or t
  misc_feature (761)..(761): n is a, c, g, or t
gcggtcctcggagacacgcggcggtgtcctgtgttggccatggtctgactacctgattagccgggggcacgtcctacgtgccagacgacggactcacagtcgacaggcagctcgttcaactgctggcagacggaccatctaccttacgaactgacgtttctcgattctcgcctgggttacaatcacagcgttcgacgtgctagcaccaggatggacctgaacgttcgtgcgtctgaccgatagaaaatcactcgttaagaccaccactggtttacctactnccctataggacagcatgtcgacgaggatggcttgggatcggccataacgcaaattgggcgcttgacatggctggtatttggcttcatgcgcaaccacaagctgtacatccttgacatttccatggcccacatcgacacgttccggaaaagtgacagaatatcatgaactagggtatttcatcaacaggaatcccttgtggggtcctcaggcacccagacggatcgcagttgcgtgggatgttaatttgagggccaaagagcctcggccatgcgtttcttgccggtactcccgaatcactagacacatggccggagtggcgcgagccgcattggctgggcatcactcgtcctccagggggacatttgcattattctcaaagagcgaggaacagtgacttgctgatcgttggaagaagaatagtgagaaagagggaacgcaattgtgcgggtaagcccctggccgaggcattcaccacgtgnacggcaggcgaactgaaagttctgccagtgcatgcatcgaaccgggaaaagctcgtaccatcttctaacagttcacggattgagtgacggcttgggtggtccattcattggacccggaagagaccctggaagaacgaagtcggagacttgaactgaatagcgctccaacagtatgccgaaggaaaacagggtggtggtgttgcggacagccattgggacacttcaattcaagggaatgaccatgtattagg

SEQ ID NO: 623179 - DNA, 151 bp, Homo sapiens
ccccggtatgctaggctaacgactctcaggtaaatataaaatagaatgagaaaacctttatgcagaaaaattttaagataagaacatataaaaaatggaaagaatgacttaatagcattgagaatgtcgactctccccagaatgaaaattt

SEQ ID NO: 623180 - DNA, 1603 bp, Homo sapiens
  misc_feature (1363)..(1363): n is a, c, g, or t
  misc_feature (1391)..(1391): n is a, c, g, or t
  misc_feature (1443)..(1443): n is a, c, g, or t
  misc_feature (1491)..(1491): n is a, c, g, or t
  misc_feature (1514)..(1514): n is a, c, g, or t
  misc_feature (1525)..(1525): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcattcactgtctccgtcccctttgtcccctaagcatcacctgccccagctgtgatgggctgtaacctaggttaggactcanagatggggtcggggtcagggtaccccanacacaacccaccgcctgggccaccacctgggaacccaggtcagggttgttgntgggaggccattggtggagttaggcaaagggcaggcttctgatgccangggctcccaaggtgctgtcccangtgggtcacanatgaacagtctcaagcctccaagcgtgggcagatgtggatgcctctcagaggagcagtcccagccggaccctccctcc

SEQ ID NO: 623181 - DNA, 755 bp, Homo sapiens
atttttgttttgtttttaagaccttaaaagggcagggtattttggaggtgcgtctaatggtaaagagaaactatggttttatgaaggggctcatgtgggtatatatatgatgggtgtgctagtgcggctagctattccagggtcttcatcagtataccacatggccgggaaatccactccaacatcgcaaccagggcttgggagatctgagctgactgctgaaggagtgaacgtaatcatctgctgtaccatgaataaggaggtactcaatctggttaaaaattttgcagttcctgctccatgcactggttggacattctctgtgtaatggtgtacaaggctggtctctctgggagtggggagacccatgtacacgttctggtgtacactgagtcatagtactcccaccgggatacaggcgccacgggtattccacacttgaacacgccatttcccgatcccaggaccatgtggaggttacgtaccctccatatgaccagccccaaatggcaattcgttggttgtcccaaaatcccattttggaaaatggtctggctggcttcaatgtgatccttcaacttcaaatgtccccagtcttctcgttgattgcactgaatgaatcttatctccttggtaaccacttcctctgccatcaaagctagccaccaaaaaggtcccgtgctgcacaggcatgtgccacgtccactatgaaaacggtccgcactttgggaacatggccgagaacactttatgag

SEQ ID NO: 623182 - DNA, 1364 bp, Homo sapiens
agagcggcccgggggcggggcttcgtccaggcgcgcagggaccagcggtgcctcgccctcccgcgccgctttccgattggcagccgcccgcgtgggcattgtgggccgatccagcgctgcccgttcccgtcggcctgccgccgctcgctcgctagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623183 - DNA, 262 bp, Homo sapiens
gagagagagcttgagacagctacgtgtggagagcttagcccctggagacagcacacggaggatgtgatatgtgggggagcgagcactgagctgggagccgcgtcctgggttccaatttgcgttctgctgcgtgactctgggccagttactcttcctctctgggcatgtcctgctcaaatgggcaagattattatagaggtcactgaagactgtgattacatgcacctgccttagatggtaggattttcttccgagggacctt

SEQ ID NO: 623184 - DNA, 149 bp, Homo sapiens
attatggtatagggttctttctgtggtgataggaatgtctggagttaatagaggtgatggttgcacaacattataaatatgcaataaagcactgtatcatatacttttaaatgctaatggtttctggagtttccggtcatcggtgcagt

SEQ ID NO: 623185 - DNA, 516 bp, Homo sapiens
cagtgcacagaccgcagttactagcagtcctacttatagtggagagttaagcaaaataaacagttgcgagctgggtgcggtggctcacgcctatatcccaacatttggggaggccaaggcgagtggatcacctgaggtcaggagtccaagaccagcctggccaacacggtgaaaccccgtctctactaaaaatacaaaaattagccgggcgtggtggcacgtgcctgtaattccagctacttgggaggcagagacaggagaattgcttgaaccgggaggcggaggtcgcagtgagccgagatagcgccactgcactccagcctgggcgaaagagcaagactctgtctcaaaaaaaataacaataaaaataaaagtggctaagaaataatcagtactcattaattgattttaaatgtcaagaacatgatggtatgggtcttctcaaaatgtggcctatggaccaccgacatcagaatcaccggcagattcctgatttccaccttgccagggtaccga

SEQ ID NO: 623186 - DNA, 1170 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcactgacacggcctcactgacacggccagggatcct

SEQ ID NO: 623187 - DNA, 659 bp, Homo sapiens
aagactatattttgagggataatttctatagtgtgtttctcgaggagtatatctgaacgtgtagaacgctggaaaccgcgagagggagaatgtgttctctcacgagtgggatagcagcgtttggtgttgcgttattgtaactgctgtttgctgttgatgatcgttcttctctagagaaggcagtctgagtagttctgggtttttttttttttcaggtgttaatagtagtgggtttcctaaggtttttaattttggggtatagggtaatgccaaatgtgggtttggggagatgcgttgggaaaatatgcaaatatttaacttaagaattgtccaaggggcttttgggccatttgcaaaatggccaataatggcattttacaaaaaagaccgttgctttcacagcattacccgataataatgccctcggatttatcccttacagctttggacaattggaaaaaaacctttgcggccctcttgccccaagttgaattaaactgggccagggtttgaatcctcccgaatttgggtcacttgccaagtgcccttagcagagtgattcacatcaaggccgcgtttaacaggctagcattggaaaacctctggattccatacgcccttgaatcccttttttcaatgtcgttatcctcggcccccct

SEQ ID NO: 623188 - DNA, 1193 bp, Homo sapiens
  misc_feature (934)..(934): n is a, c, g, or t
  misc_feature (966)..(966): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaagggggccaggccntggcctggaaaaatcccctggtgagaaggttnccggggtgccaccggcccactggtggggaaaccctgcagggacggcaattggcataggccagaagaggaggtgatgaaagacgactgagagagagagaaggatcgagggggacaaaagttgcgaggaggatacaagagggataaatgagtaaaggaagggagacagagttagaccataactaacaaaaggggataagacatatgtatagcaacactatcgttttggt

SEQ ID NO: 623189 - DNA, 193 bp, Homo sapiens
agattggcccagggccacattgaatggcagacgggcagatgtaattgttaattctgtaaaccccacatgatattaccgttggacctgtggccaagtcaattctaccaccagccaggaattgaaatggaattcggaattttcttggccacaaaagggctaaacagtttccatcgggtccccgacttaaactttg

SEQ ID NO: 623190 - DNA, 655 bp, Homo sapiens
cattgtgagtatattttaggttcagaagtacatgtgcagtgttcgttatacaggtaaactcctgtcaccatgggtgatgtacagattacgttgtaacccagtgtacgaagcctatgaacccaataggttattttttcttgatcctctccctcattcccacctctccacccatcaatgtactgccctacatgtcaggttgttccctatctattgtgtccaatgtgttctcatggggtgtagctcccacttataagtgagaacattcggtacttggtattatgttcccgcattcgtttgctgaggataatggcctccagctcccaaccacgttcttgcaaaagacaggaggatctcattctttcttacagttacatcgtaccccatgatataaatgtaccaaattttctttatccaatctgccactgacaggcatttcagtggattccatgtctttgctattgtgaatagtgctgcagtgaacacacatgtgtacatatctttatggtagaacaatttatattcctttgagtatatataaccagtaatgggattgctgggtcaaatggtagttctatttttagctgaggaatcacatattgctttcacaatggttgactagtttcactccacaacagtgataagattcctttctcat

SEQ ID NO: 623191 - DNA, 1630 bp, Homo sapiens
  misc_feature (1019)..(1019): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcgtgaggccccactgcccagctgtggctcctgctcgggcaaggcagcactgccgtgcacgctgccctgtgggtgatccctcccacctgtgggncgagctcatcttgggagacatgagggtgaagtagacctcaacggagggcttggctttcctaacacatctcactcaagtcatcagccaaggctctgtgggctgaaccccacttccagcgtgagccttgctggggccaaggcctggccctggtgggagatgcttgggtgcagcagttcaggccctgagcccaaggggccaaggtgggcagggacatggagcaggcatggaaggctggttcttgtcccccagccggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623192 - DNA, 1087 bp, Homo sapiens
  misc_feature (258)..(258): n is a, c, g, or t
  misc_feature (798)..(798): n is a, c, g, or t
  misc_feature (811)..(811): n is a, c, g, or t
tcctcgatgatgtgaaagcaggcgatgagtcgagacgcgagtgtccgtggggacgacagctatgaagaggatactgtggatcgtgtcttacggcgactacccaatgcgtccactcttgtgtgtagactctttgtgtattctgcttgggcccgtctcgcgtggctcgaagcgtgcttcggggacgtactatcgccaatggagtcgaagcgcctgcgagtgccttgaataggcagtgcttgacgtgctgcaggcggggcntcacccgtcgtcgcatccagacgtagtgcgagcgctcgactcgtgtcggagcgatgggccggggaggggccggtacgtttgctcgtggggtaccgactgcggtagcgtctgggggaccaactgacccaggcgcaggccacgcaatgagaaccgaaggggaaattcatagcaaaccagtgaaggaaccgatgagaaagatttcccaagctagtgcgcagagactaaccaaacattatctcgcccttgtcgtacaacaatggttaagtgcgagacccaattaccgattgaacttatccaaggtatgtttcctgttgaagaccacagtgtcatcgatcgcaagcaccggaaatgtacctttcacaacacccgcgactaggtgtgatctccgttgctaacccaaggttaggtcccagataagagtcgagaggtttgactcgaattaattacggagaacataaggcagtatatagctacaacaacacccagatagctccatcaagaccaacggagatcgaaccgcgctaacgaaattaccatacntgcacttcgaaantgggtaggctataaagcgataataggggccaagatggacttcggtctgtctaattggcctaggtagacaccattgttagaccatatccaaatgtgcggaggagatactgtgagtagggaatagaaaaataggggccattggaaggcgcaattacaacaggcgagaatataggtttaccaataaattaaggtaacggaggcagggaggttcaccttgtgagggggcaccttatttttccatttggaggaaaccagtggtcgatgtggaataacgtat

SEQ ID NO: 623193 - DNA, 1231 bp, Homo sapiens
  misc_feature (6)..(7): n is a, c, g, or t
aaggcnnggtagcgaggctgggtgggctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623194 - DNA, 554 bp, Homo sapiens
  misc_feature (2)..(2): n is a, c, g, or t
  misc_feature (61)..(61): n is a, c, g, or t
  misc_feature (70)..(72): n is a, c, g, or t
  misc_feature (85)..(85): n is a, c, g, or t
  misc_feature (93)..(97): n is a, c, g, or t
  misc_feature (100)..(100): n is a, c, g, or t
  misc_feature (103)..(103): n is a, c, g, or t
  misc_feature (105)..(105): n is a, c, g, or t
  misc_feature (108)..(108): n is a, c, g, or t
  misc_feature (112)..(112): n is a, c, g, or t
  misc_feature (114)..(114): n is a, c, g, or t
  misc_feature (116)..(117): n is a, c, g, or t
  misc_feature (119)..(119): n is a, c, g, or t
  misc_feature (123)..(123): n is a, c, g, or t
  misc_feature (131)..(131): n is a, c, g, or t
  misc_feature (140)..(140): n is a, c, g, or t
  misc_feature (162)..(162): n is a, c, g, or t
  misc_feature (168)..(168): n is a, c, g, or t
  misc_feature (189)..(189): n is a, c, g, or t
  misc_feature (252)..(252): n is a, c, g, or t
  misc_feature (338)..(338): n is a, c, g, or t
  misc_feature (343)..(343): n is a, c, g, or t
  misc_feature (353)..(353): n is a, c, g, or t
  misc_feature (380)..(380): n is a, c, g, or t
  misc_feature (386)..(386): n is a, c, g, or t
  misc_feature (449)..(449): n is a, c, g, or t
  misc_feature (452)..(452): n is a, c, g, or t
  misc_feature (469)..(469): n is a, c, g, or t
  misc_feature (488)..(488): n is a, c, g, or t
  misc_feature (552)..(552): n is a, c, g, or t
cntattaaagtcaaaacttttaaaattttacagcaaaaagggtaatatttattcatatttncagaatttnnngggattttggggntattttgnnnnnganggncngcnatcnantnncntacngtcccccnccagcgggngcggggctgcagtacagcgggngccggnatataatacagcatctgtacncctcaagctctacactccaggaagtgtcactgtcacattttcacaaattccagtctctaacgnggagcctctgctgctgagccagaatccttttcgggttcaacggatgaggtagcctccgcaggtaactcttcagaaaggctttaggnctgcngcctcagacnacccccttctcaagttctgaagcagtntctacntttcccccttggctaatggggggttcaacggttttgttaccccctgccctgtctgtcacctcnggnttttcctttcctcgggnttcttccttctctctacgngactctcctatctctggaatctctctctctgtctcggatgcccaaatagagcgtctatttctcnct

SEQ ID NO: 623195 - DNA, 996 bp, Homo sapiens
  misc_feature (842)..(842): n is a, c, g, or t
  misc_feature (848)..(848): n is a, c, g, or t
  misc_feature (869)..(869): n is a, c, g, or t
  misc_feature (871)..(871): n is a, c, g, or t
  misc_feature (873)..(873): n is a, c, g, or t
  misc_feature (876)..(878): n is a, c, g, or t
  misc_feature (883)..(883): n is a, c, g, or t
  misc_feature (889)..(889): n is a, c, g, or t
  misc_feature (893)..(893): n is a, c, g, or t
  misc_feature (906)..(906): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggcggtgtgantctcancatttaccaagtctgggaacngngnggnnnggcantgggcngtgnccagcaggggcancagggctggaaaccccggggaacccctgttggaccagaacagtgggcaccccggcccaggccgaatacagccggaaaacaagacaacccc

SEQ ID NO: 623196 - DNA, 351 bp, Homo sapiens
agtactcagcggcatgagccgacgtcgccaggtcataaagtcaaaacgcatcctgagagcctggtggcacggtcccctgcagcactagatctgcagtcccacaccctgctttggccgtgggaaaacattaaacatggagacgtaacccaacataaggtgtacacgcgggacagcaagacttcccaaaaagtttaaaatctctctgggtcttcgagtggaacctggaagccccgcggtggcagtggattgatgtccagttcttgtcagaggagccttgtgaaaaataactgcgcctttgcctgaataccacgttccctagaatcagaggggccacagcccttctcctccatg

SEQ ID NO: 623197 - DNA, 1491 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttcctagagatggggtttcaccgtgttggccaggatggtctggatctcctgacctcgtgatctgcccgcctcggcctcctaaagtgctgggattacaggcaccagccaccgcgcccggccgtctacttgcttttctaattgtgggtcctaagaccctcatttcaaaaggggtcccatcacataccctggaggaaggaatgttgcacggaggacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623198 - DNA, 1452 bp, Homo sapiens
cttttggggtctttgctctccttgtggtggtacggcagtgggatgcacattttcctttgaccagcgttctcccagctgtcgcaccgctcactcccatgctgttacaggtcacctcttgcaggggcatatttgatcgctgggcacttagtgtttgttgttccatcattatgcaaacagccgcctcttgatgaaccttcagtgacccagaagaaggtgtgagaagtgtggctggaccccgctttcggaaatgctctggactcccctaacgtcctggggaattacagggttccttcacatgtttccagttggaagcaagtactccacttactttggcttttgaaaactatttccctacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623199 - DNA, 316 bp, Homo sapiens
ctgatctagaggaccccggtttcgcatgtttcccacttacaaaacattggaaatggcggggtggctcatgctggaatcccagcacttccggagccaaggtggatggatcacctgaggtcaggagttcgagaccagcctggtaacatggcgaaatacgtctctacaaaaatagaaaaattagtcagttgtggtggcaggcatttgtaatcccagctgctaaggaggctgaggcacaagaatcgcttgcaccagggaggcagaggttgcagtgagctgagatcacgccactgaattccagcctgaacgacagagcgag

SEQ ID NO: 623200 - DNA, 116 bp, Homo sapiens
attgcaggtggtagaagctcgtgaccaggtgacagacagacacagaacacatcaacagaattatcccggggagcaagtaacagcttcagaattcatcaggaccaagaaaggataag

SEQ ID NO: 623201 - DNA, 136 bp, Homo sapiens
  misc_feature (46)..(46): n is a, c, g, or t
tcgatcgggggcacttatgcacgcttactatcttaacaagcttgangtgcagagatgaagagttcaaatctgaccaagatgttggtgttggataagagaattctctgctccccacctctaagttgcccgccaatcg

SEQ ID NO: 623202 - DNA, 812 bp, Homo sapiens
gaggcttttccagttttcagttttgtatttattgctgtgtcgacctttttggcgattaaatgctttttatgtatttcagacttttcccttaggatagtctctcatgtgccaaagtttgtcataatcattctgctatttcgcttatgcttcctggctctcttgctgccttagggggtagtcatactgctcatcatagaagtatacatgcagtactgtgtttgttacaatgttactgaattagcaacctgatggtaataggtgaaagtggtaacctgtttttaactttgaatttctctgccgggcgcggttggctcacgcctgtaatcccagcactttgggatggctgaggcgggtggatcaacgaggtcaggagttcaataaccagcctggcctagatggtgaaatcccgtctctacttaaaagtagacgattatattagccgggctgttggtgtcgggcgcctgtaatcccagctacttgtggagatctgaggcagagaattgcttgaacccgggagtacggagattgcagtgagccaagatcgcgcctactgcatctccagcctgggtgacagagtgagactcagtctcaaataaacacaaaacaaaaaaacttaaattctttgcttggtagtgaccttgatcatggttctctttgtacgatagattgggcatctgtaatttccacattgtgtgaatttgccatttaaatttttgttatgggtttcaccttataaaataatcagacataattatctttatcctgtgagataagttttaattcatttactcttttcgctgttaacacacaac

SEQ ID NO: 623203 - DNA, 239 bp, Homo sapiens
  misc_feature (202)..(202): n is a, c, g, or t
acaggtctacaaggatctcagtttgtacggtctttataaatgcatgagcaaggactgtggctttccatgcccccatttcatctcaagggcatcttcagcagatcccacatagctctccctctggtgcgcatgaaataacttgaggccaggctctctcagctttaaagccttggaatcctattcattgttctgtgtgtttatntgcggtttgaggggtagcttctctagggtaccgagct

SEQ ID NO: 623204 - DNA, 522 bp, Homo sapiens
taatcagctcctacccttagaggtgcagtgcagagaatggattgaacccgggaggcagaggttgcagtgagccgagatggcaccattgcactccagcctgggcaacagaacaagactccatcaaaaaaaaaaaaaaaaaaaaaaaaaaaaaaaaaatttacccgggtgtggttgcttgcccctgtattcccagcacttggggaggccagggcaggaggatcattcagggccaggagatggagactgcagagggaaacccggttctctaaaaacagggtctccagctaaaatcggggctccagctccaccacaagcgcagctccaggggcgtgtggagttttggccttctaccattcccaagttagtctcgtgctccagaaccaagttcccaccattcgtggcagctcatgtcagtccaaccacagctcatatcagggccactctccagttcattcgagttgcccctttgaggaaggctggaggaagaggccaagtgactttggcacgggccagcctcccggg

SEQ ID NO: 623205 - DNA, 80 bp, Homo sapiens
  misc_feature (75)..(75): n is a, c, g, or t
attcagctcgccccactttatccctttaaacacttttaaaatactgtggaataataatgatacccatgtgtgtgnatcct

SEQ ID NO: 623206 - DNA, 126 bp, Homo sapiens
  misc_feature (54)..(54): n is a, c, g, or t
aaccaacccatcagtttccagctccgtcaacatgcttcatccatggcatcatanttcaggtccatcgttcaacgtgcaccgggctcagttcacttgtgcgcggggttattccagctgcacagcagc

SEQ ID NO: 623207 - DNA, 504 bp, Homo sapiens
gaagctgctacttggtgaacgtcagattataacggctctgtgtacatggctttaacaaaatgaaaaaaaaaaaaaaaaaaaaaaaaaaaaaatttttgggcggccgggagcccggggaaagagcttttttaagaaccagtgcgggtgtggggcggcgggggccccggtgagaggataaggtggaaaccgtgggccaatagcggtggttcaccagaggagagaaccgcgggacaacgagaacaagggggccggggggaattcttctcccaataataaaaaaaaaagcgcgccgggggggggggacaacaaccggagagggcgtggtttgtgagcaaaaaatatctccaaagaaagggggagagagtaccagaggaaaggggctcaacataacagcggggagcactctatatctcacaagacgggggggggcccacaaagagagagaacgcaccgaatatattctacagagatttataagccccggggaaccctggtgggagacga

SEQ ID NO: 623208 - DNA, 776 bp, Homo sapiens
cactccgaccttactagcagacaaccttaggcaaagcatgtacccaaataaagtataggcgatagaaatgaaacctggcgcaatagatatagtaccgaagggaaaggatgaaaaattatagccaagcataatatagcaaggacgtaacccctataccgttctgcataatgaattaatagaaataattggcaagggagagccaaagctaagaccccgaaacagaggagctacctaagaacagtaaaagagcacacccgtctatgtagcaaaatagtgggaagattataggtagaggcgacaaagctacgagcctggtagatagctggtttgtccaagatagaatcttagttcaacctttaaaatttgccacagaagcctctaaatcccctgtgttaatttaaccttgtagtccaaagaggaacaggttctttggacactaggaaaaaaaccttgtagagagagtaaaaatttagccacccatagtaggctaaaagcaggcaccaacttaagaaagcgttcaagctcaagagccagtactaaaaaatcgcaaagatataagtgaatcgtcagacccaattgaacaatctatcacgctatagaaagaattaggtggataagtacatgaaagattgtctcgcataagcgggtagataaaaatgagtgaccattaagccaatttagatcacaaaaggatatgcttatggaacagagggggctaggaggtaaagagggagggattaccgggtcaaaagtttttacagaaggggtgggatgag

SEQ ID NO: 623209 - DNA, 138 bp, Homo sapiens
gatataccaccacagagtggaacccagagagagagagaaatctggaaaggtatagaaactcgagagcacaggccaggcgcggtggctcacaccgtgtaatgccagcactttggtgaggccgcaggtgagtggatcaca

SEQ ID NO: 623210 - DNA, 263 bp, Homo sapiens
gcatttctttctttcttattttttttttttggatacagagtctcactctgtggtccaggctgaagtacaggggcttaatctaggctcagtgcaacctctgccacctggtttaaagtaactctaatgcctaaagcctcccaaatagttgggattacgggtgcccaccaccaggcttggttaattttggtattttaagaagagagggggtttccccattaaggggcaggctggtctcgaactctgggcctcaagtcatccatttg

SEQ ID NO: 623211 - DNA, 218 bp, Homo sapiens
agacgccattcttgcatacaaaagaaactaaacacaaaaaccaggctggggtggctcagacaattgtacagggtgagttctagcaaacatgcaaagaacgtataatggcacggttacagaaattcttctggagacaagaaaataagacacatcacccaaccaatttcataataacaaggtcaaggtataataacagaaaaagtggatctcaaacttat

SEQ ID NO: 623212 - DNA, 285 bp, Homo sapiens
aatatcaaggcttgactagcgcgcggtggcttacacctgtaatcccagcactttgggaggccgaggtaggtggatcacctgaggtcaggagcttgagatcagcctggccactatggtgaaaacctgtctctactaaaaatacaaaaattagccggcatggtggtatgcgcctgtgatcccagccactcaggagtctaaggcaggagaatcgcttgaatccgggaggcagagattgcagtgagcccagatcgtgccatggatgacagagtttcgctctgtcagtcg

SEQ ID NO: 623213 - DNA, 344 bp, Homo sapiens
tatttcgggttacttagataataaccatgtacttgggtgtgaagtagtatctcatagtggtattgatttgcattttcccaatcatatagttgacattttacccaataatatagttgactttttgcgtatagtaaaatgcacataacataaaatttaccattttaacggtttttaagtgtacggtgcagttgtactacgcgtatcaacattgctatgcggccatcacaaccattcattttcagatctcttcatcttgcaaagttgaaactctgtactcattaaacaataactcaccattcaccctccctgcagaccctggcaaacaccattctacctcctctctc

SEQ ID NO: 623214 - DNA, 216 bp, Homo sapiens
aaggggctttggaaaagcttttttagccctttattaaaggagggcagcagcttagacttattaaaggagggcagcctggtttgttttttcagggccccccccccccctttcccctaccctagccccccctagggccttttcccagcgggaggggtttaagaccagggctggtttttttaaaattccttttgtaataaaagccttttttagtggtga

SEQ ID NO: 623215 - DNA, 552 bp, Homo sapiens
atactcggttatcagtatgctgggaaatgttgtcactatcggattatcatttataccattcttgacatcgacatttccgtgagaagagccttgaccaactaaagatccatttcagctgaggagatctgtgactctctttagtggggcaccacctgttacacctatgattgttttgtcgactaattacttctcacgaaagattgtgtcttacttggctgtttttgctcctgatgtgtgtggcaaatgagaccatatacaacagagattttaattgtgcaaacctcttcagccatattatcttctgccaggaacccgcgggtgatctgaactagcacatgcaccgacttaagacagtgaagaatactacaatatggttatcactgcgttcctatctaaagagacgggggccacagcgttcagttgatgtggttgtatcctcggttctcctactgacactttcgattgctttcatttgttgtgctcaggttctccaaggacataaaactttcctgaatgatgcttataactgggagtccatgatcagggaaacag

SEQ ID NO: 623216 - DNA, 911 bp, Homo sapiens
gatcgaatggcggggaaataccgcggacgcggacggtatgttgctggtgggtattccgtgtactgatgctcgttagcattacgatgctgagagaatcgcggacattagcggttggcacggagtgcacgagctccggtccattcagttggctagtgagaatccggaagtgggcaggaggcatacaatgcatgcctgtcttcgcagagctgggaccagagtgctgctggctgttggccgcttcgagagactacggtggccggtaatctaacataccgagggggctctagcgctcagtgatacgcggggggggtcggtgttgtagggcacgacaggagccggtgctggcggacgtagtgtatcagaagaataacagcggtgtccctcgcacgtcggggattacgcatcctaccgagtacgcatacttagcgaggcaattccgagacaagacgaaaaggcacttcctggtaacagatgcctggggggcacctaaggatagaggggtttgaccgagaatacttgggacgccaggtgttcctacaaaacgtagagtgcaccctggacgtacactgggacacacttgcgcaaggatcaccccgtgagtagtctcacgtaggggaatcttggaaaagggggaacaaaagagatgctgcaaggtccacatcccgaacgagttacgttatgttgcgacgacgttgtccaccacttggacaggggcataagccccacgagaggaatacgggaccgccctgaggtgtaaacgttatacagacgtctgttgcgctgtataatgccactctggagttgcaagtgtgacttctgacttcaagagacgaaatggccggtggaaaaggaacaggcttgcctccataacccttgtccgcacgggaaggggaagggataccctcacgacg

SEQ ID NO: 623217 - DNA, 363 bp, Homo sapiens
ccggcgaggcagtctcgaactcatgacctcaagtgatccaccttccttggcctcccagagagctgggattacagagttgattttttatatatttatttaccccccaggaggatcttgctctgctgccaggctggagtacagtggctgtatcacagctcactagcctcaaactcttgggctcaagcgatcttactgcctcagcccctggagtagctgggactacaggtgcacgtgatcatacctaaatttttttttagagatgtggtcttgctgtgttgtccaggctggtctcccaactcctggcctcaagtgatccacccaccttggcctctcaaagtgttggaattacaggcatgagccacc

SEQ ID NO: 623218 - DNA, 241 bp, Homo sapiens
gtatcccccttgtaaccattatgcattggagggaacaaggaaaaacatggaacccaaagggaactgcagcgagagcaccaatgattctatgatactgcgacgcaaatggggtggaggggtgctctcctgcagctacagaagtgaatgatctgcgtggttaagcataaaacacaacgtcaaacattattctgagttgtcctactaagtcagcagatggtgatcttctttgctgggtcttgcc

SEQ ID NO: 623219 - DNA, 1023 bp, Homo sapiens
gctcgctccgaggtcccgtcgccagagacgcagccgcgctcccatccaccctacgacccaccgtcgccctcgttcgcctcttctccgggagccagtcctgcgccacgcggcggcgcgctcatgcccattcgccaccctccgtcagccatgtccaccaggtccgtgtcctcgatcctcctaccgcaggatgttcggcggccctgggcacgcagcgagcacggccgaggctcacaggccgtgcagctacgctgacgtactgtccacccgcacctacagcctgggcagcgcgctgcgccccagcaccagtccgcagcctctacgcctcgtccccgggcggcgtgtatgccacgcgctcctctgccgtgcgcctgcgcgcagcagagtgcccggggtgcggctcctgcaggactcgggtggacttctcgtctgggcgactgccatcacacaccgagtgcaagaacacccggactcaacgcagaaggtggagcctgcaggagcatgaatgaccgctttcgacccaactacatcgaacaaggtgccgcttcctggaagcaggacgaacaccgatcctgcccgcgcccgagctccagccagtctcaccgggccaaggcaagctccacgcctggggcgacatctaccgaggaccaccatgcggcgaactgcgcccgagcacctggaaccaagcaacccaacgatacaagccgcccccacgccgcagcgcgacaaacatggccggaggaacatcacgcccccaccgcgcaacaattagcacgcaccgccaatcgcccaacacacaggacacacgaaaaacacccgaaaacatacaacaaggcagccccaacgcgacacggcccgcctgcaactacacgcccaccggcactcacgcaccacaccaagaccaaaagcacaaccacacaccaaaatccagacacacgcccacacaccgcaccacagtacaacgagagaaaatagaccaccaaaacaacgcacaaaccccaccaacaacacgcccacagaccacac

SEQ ID NO: 623220 - DNA, 314 bp, Homo sapiens
acgtgcagtctgaacaggaccaccaggtttttctgccagctcattttctcagccattgcccagtccctggtgcctggcactgcatggcaacattgtttttctccctgtgccatttcaccttccactttcccatcctgccttctcacaccttggatgcaatggctttggtaattctagctgttgtctttggtgcattagtcaatttagtagtttttctgtgcaaacacatacttggctctgggcaggtcacggcgtgtcccagttgctcctggtcactccctttctcagccattcctgtcttgtttcttgtaact

SEQ ID NO: 623221 - DNA, 190 bp, Homo sapiens
agtgtaggaacagtgtaggaacagctaaataggttgttgttgatttggttaaaaaatagtagagggatgatgctaataattaggctgtcggggcgtatggctttcacaaacagagaaaagaacaaaaaaaatttagccgggtgtgttgccacgtgcctattagttccagactactcaggaaggctaaacg

SEQ ID NO: 623222 - DNA, 850 bp, Homo sapiens
gtcagatagaactatggatacctgagtcgtagaagccttgtgtcccggtatggtagtgtggacccgtatgtgtccaagtgagtgccagtggtgacattgttgatgtctgagatggaactgacaaccatcatcggagatcaccatctacctaccgaggacatcataagacacataaatgggtaaaggaagaaggcgccgtcgttcgtcattccaagaatccgagcgtcaattgcgtactcgtgtggttgtcgaaggggttgatgtattgctgcatttgctacatagtctactagattcttggtgtatttggtgcaataagcgtgggccactagttatggcccatatgtatattcctgaagacgatgattgaatttcgatctagtgagccacagccgaggtcctatggttctctagtactcctagcttcgtacgagattgcatcgatacagagtactggagagggtgactggctactggtgatggtatacgagggttcgtcctcctggcacagccctgtgtcggggggctgcatggtgtgtgctagaggtgcctaaagctgtggatgagatcttcacacacatcatcgtgggtaccctgtgggccgctgcatgtaggattatcgcttaacgcgtcagagtaactggttcttccctaattatatcaatgatgttgtgtgctgggcatgatgctgacgacacgtgaggctggtgcctccaaggtacagaactatgagttctcctgtgtgttcaacgaaaagccagggaagtatggatgtcagccgcacggcttctgacttggcttgtttgacaacaattctagggagccaccggattcttgcacaggcactggc

SEQ ID NO: 623223 - DNA, 150 bp, Homo sapiens
ttgattgctgcggtgctatcgcggctcccctgggtggggccgcgggctggggcaggcaccgccccggctccggcgctcgtggcgcgccggcccgtacggacgactggccccttcccgaccgtgggccgctgtggcggtgccttcgtggac

SEQ ID NO: 623224 - DNA, 328 bp, Homo sapiens
taaaagcttttttttcctccatcaaatgatagaatcatgtggctttgggttttgttttgtttttgagaaacggtctcactctgttgcccaggctggagtgtagtggcacgatcgcggctcaccgcagccttgacctcctgggctcaagcaattctcccaccttagcctacagctgggactacaggcatgcacaaccatgtcatgctaatttttgtattttttgtagagaaggggattcaccatgttgcccaggctggtcttgaactcctgggctcaagcaatccagctgttttgggaggctgaggtgggaggatcactttagaccagc

SEQ ID NO: 623225 - DNA, 987 bp, Homo sapiens
  misc_feature (182)..(182): n is a, c, g, or t
  misc_feature (668)..(668): n is a, c, g, or t
  misc_feature (987)..(987): n is a, c, g, or t
gggaggggcgaggctggctcccagcccacgcaccaatgtcgacgctcgaagtctcagcaggtaaaagcgacgtgagcctagggcgcgcggacggcagtcctgggtggaccccggcaggctcaggagggaaagtcagggctcagagggcatcggtgggcccctgggtcatgggtgtcctaccntgggggtcaggagcagcttggtcttgactgtgttgagttgattgcatagagatggagctgtggtctgagcctcccaggcgttggagcgtcctgggacgttcttgtgcgggtgaggctgggcgagcttcctgggtaggtccgggcaccaagcaggccctgatgttggacatgagtacccatcagagggtagctgatggaagaattggtaccctgtaatgtacagtctactaggttcaagaagctgcctgtgctcgaagcactcagcgccgtggagctcagagccaatccgcagaggccccggcttttaaggggccagagagatgcaggttgaacaaattattaggcggacgtctctgcgtgtatgaaattgacctgtccacagcattacgtacccgcaggggctgcaatgggggtgctatcgcgagggccacgtggcagcgtcgggatgcccggacttgcagcgatggtcggttgggcacagtaagncgtgggagggtgcacgttggggtggtggcagcaccttggggcggttcacgaacgggtcctagatgggcacaacgggacggcaaggacgggttgaacccccaagaaggcatgtgcgagggggtaccggtgtaggggccacaagggcaaaaccccaagacgggaatttccatgcagccaggacccctccgtgggcccttggtggaaccccaaggaggagggttaggatggcaatgtagtactaaataccaaaaacccactatggagcaatacaccatggaagaccacaaatcaccagggcacgcacaataggagtcaaggn

SEQ ID NO: 623226 - DNA, 1032 bp, Homo sapiens
tagggaacgcgcccgcgtcgctaccgggcggggggggcgtgccaggccggaagcgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623227 - DNA, 1828 bp, Homo sapiens
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623228 - DNA, 2112 bp, Homo sapiens
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggtgagtgtcccccccatccccggcgcccgcgggatctgccccccgagcctttctcgctccgaagccacggccccttcgctgctgtgggtgcctttctctgcccaggctcccgaggcccggggaggccccgacagctgcccaggtcacgcggcctgcggagggcccaccctgccagccaagctctgctccccaccagcctctcacactagccgcttcccggggcgtggggctagtgccacgtcccctgaagaagcgccagcagggaatccgcccttccaggccaggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623229 - DNA, 1098 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623230 - DNA, 125 bp, Homo sapiens
gtctgacatccaagacacgttgtttcgtatttctgaaggaaggaactcaagctccgggaagtgaatggcctggggatggggcgggcaaccttgggggacccagtttaccatccaaggctaaaggt

SEQ ID NO: 623231 - DNA, 1408 bp, Homo sapiens
  misc_feature (3)..(5): n is a, c, g, or t
  misc_feature (18)..(19): n is a, c, g, or t
agnnngtgggccgtccgnncgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttcctagagatggggtttcaccgtgttggccaggatggtctggatctcctgacctcgtgatctgcccgcctcggcctcctaaagtgctgggattacaggcaccagccaccgcgcccggccgtctacttgcttttctaattgtgggtcctaagaccctcatttcaaaaggggtcccatcacataccctggaggaaggaatgttgcacggaggacgccatcgacgagtacaagccccaggatgctaccaccaacccgtccctgatcctggccgcagcacagatgcccgcttaccaggagctggtggaggaggcgattgcctatggccggaagctgggcggaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623232 - DNA, 1204 bp, Homo sapiens
ggacgcgtgggtcgacccacgcgtccggtcccgtcgccgctgcgccgccgcagaccccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcggaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623233 - DNA, 2223 bp, Homo sapiens
  misc_feature (637)..(638): n is a, c, g, or t
  misc_feature (893)..(893): n is a, c, g, or t
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgagtgtcggagcagacgccatcggagcagacgccttccttgacaccagcccggnnggcacagcagagggcgtggaaagctggcttgagaagggcatagggttgggggcccaagctgatccacccaggtggtttgcatgtggtgtttcaggagcaggccaggaggccctcaccgtactgggcagagagggggtgtctgggccaggtggggagggtctggaggctacgggtcaatggcctgcagaagcccccggctcttcttgctccaagaagcttctgttacctgggtgggatctcctaaggggcagcttnagaaagatgcctggggagtcccatgaagagtcaggggtgagaagccctgtcctgggcagctctgaccaacaccccatcctcaggtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623234 - DNA, 1903 bp, Homo sapiens
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccaggtgagtgggggtccagctgcccgggctgggaggcggaggctgagacctgaaaggtgctgaccggcctccccccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623235 - DNA, 111 bp, Homo sapiens
ttagctcttctgttagaaatagtatcttgttttcctttgctgtctcgatcccctactcttcaccaaagagcccctaaaacccgccacatctaccatcaccttctacatcac

SEQ ID NO: 623236 - DNA, 154 bp, Homo sapiens
aattcttctactcttcgtgctgtttcttcctcgatgagtctttcttctatttcttgctgtcgaatttttcgctgccgctcgaactccgctttcttctcctcctcctctcgctttctgcttctcgtccaggctgctgcgcttgctcaccgtgcgc

SEQ ID NO: 623237 - DNA, 564 bp, Homo sapiens
tgttatgatgtctgtgtggaaagcggctggcagacattcaaatgttattattatgtcttacaagcaaacaaaaacaaaaacaaaacaaaaaaacaacacattgttctgggcccgcccgcgggccccttagaaagggccccccggaaaactttttcaaacccctccggttggggcgcgccgcgggcccccatagggataggggcacacgtgggcccatgacggtgtcccagagggaacactcggggtccacgagaaacgagaggctgcaggcagttccccaacgcctatcaactacaacgagcccgcggggcgaacacacggacgcggtatccgcgaaacacatctcccgaaaggggactccccggagacgcaccactaagagcgggattcctcaacaaaccggaggagcttccccccaggagacgactgcgtatattccacattaaagagcgccccgcgcagcgaggatcagcaccacgacaccgatcgaaacgacaccaagtcgacccacacaacagatactacaacaacgcacgacgacgtcatccaccatctccacatccg

SEQ ID NO: 623238 - DNA, 217 bp, Homo sapiens
gctgttctgaggatcccgaaacctaattacgcctccctaatttcagaaagagtacttatcgatattggattttatgaatttggagtttagtaccctgcttccagccccagccccgtagaaagagagtgttccacaggacagtggcctcagtgtctccagatgctgtaataaaatccaaaggtcactgctgtctcactgtattttccccgtaattagg

SEQ ID NO: 623239 - DNA, 2311 bp, Homo sapiens
  misc_feature (637)..(638): n is a, c, g, or t
  misc_feature (893)..(893): n is a, c, g, or t
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgagtgtcggagcagacgccatcggagcagacgccttccttgacaccagcccggnnggcacagcagagggcgtggaaagctggcttgagaagggcatagggttgggggcccaagctgatccacccaggtggtttgcatgtggtgtttcaggagcaggccaggaggccctcaccgtactgggcagagagggggtgtctgggccaggtggggagggtctggaggctacgggtcaatggcctgcagaagcccccggctcttcttgctccaagaagcttctgttacctgggtgggatctcctaaggggcagcttnagaaagatgcctggggagtcccatgaagagtcaggggtgagaagccctgtcctgggcagctctgaccaacaccccatcctcaggtgaccacggtcaagttctggtttgctactggtggggccgggttctgcctcagcagaggccttgccctcaagatgagcccatgggccaggtgagtgggggtccagctgcccgggctgggaggcggaggctgagacctgaaaggtgctgaccggcctccccccagcttgggtctgctttcatgacgcccgttgacgcggtgcggctgccgtgatgactgcccactcctgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623240 - DNA, 154 bp, Homo sapiens
ggctattgcccaccttgagcaggcgcagcaccctgcctataacggatcgtgatgaaacctgtgaaccggaaacatactccactcgatatcccgcacgagcgagcccaagtgcagccttgaatggctcggggtgaagaccggcgtcaccactacg

SEQ ID NO: 623241 - DNA, 715 bp, Homo sapiens
caccatgatgaggaatcatttattagccctatcatggtgccatagctgtggatacggtactgttatataggaccctagggatgccttccgtcatattttaccacaacagctggttatatgcctccctgcacacaccactaccatgtgtgtgatcgtcacaagtgatagcttagatactgccaaggataagctaattgaatccctgaaagtattatcccctggtccagatggtccacttttttcagtattatttatagttggcacttgattccgttctgtgaggcttgagccttcatacacctcacctgccttggccagcctattttagtgatatggccgcccggatattaccctatgccttaaagcactttttgtaataagtttaatatcctaaaaggaatgcccattaagttttgttaactgtgtcatccacttatcctagtacctccgtgttcattcctgttacctgcatatcttcttaaaagaaatagctgttattaatgcccttttgttttcccttgagtgtacactactgaataagtgtaggagttttatgtttaccatgtgagtcctgcaaccctaaagatattttgaatatcagtcatgatggccatttctgtataaagagcctttaatggaaccttgttttgagatccaactcccccccctcaccaaaatggccccgttgccataaaaattgtggcatattaccaga

SEQ ID NO: 623242 - DNA, 1513 bp, Homo sapiens
  misc_feature (108)..(108): n is a, c, g, or t
ttctcggaaggcatacgtgtgtcatgctgccgatgtgaatgctgcaggctctatctgcttctagagaagcttctgttacctgggtgggatctcctaaggggcagcttnagaaagatgcctggggagtcccatgaagagtcaggggtgagaagccctgtcctgggcagctctgaccaacaccccatcctcaggtgaccacggtcaagttctggtttgctactggtggggccgggttctgcctcagcagaggccttgccctcaagatgagcccatgggccaggtgagtgggggtccagctgcccgggctgggaggcggaggctgagacctgaaaggtgctgaccggcctccccccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623243 - DNA, 283 bp, Homo sapiens
  misc_feature (17)..(17): n is a, c, g, or t
  misc_feature (57)..(59): n is a, c, g, or t
  misc_feature (62)..(62): n is a, c, g, or t
  misc_feature (67)..(67): n is a, c, g, or t
  misc_feature (86)..(86): n is a, c, g, or t
  misc_feature (195)..(195): n is a, c, g, or t
  misc_feature (197)..(200): n is a, c, g, or t
  misc_feature (224)..(225): n is a, c, g, or t
  misc_feature (228)..(228): n is a, c, g, or t
  misc_feature (270)..(270): n is a, c, g, or t
  misc_feature (282)..(282): n is a, c, g, or t
gcggcacgaggagaganagagagagagagagagagagagagagagagagagagagannnggnaccgnagcacctgcgccgggcgtnttactcccgctgcttgttctgtcccctccctcggaccaaacagtgctcatgcttcaggaccttgtttgtcgaagatgttggtttccctttctctgttatttatataaanannnnttttttaaaagggtattttaaaanngtnagtctgtcttgaaacttgtttaccttaaaattattaagaatntcagtgtttgang

SEQ ID NO: 623244 - DNA, 116 bp, Homo sapiens
ctaatatccattaagagggaagacaattatgatcctatagtgacaattgctggaataatatccgagtggtgattccgttctctaagaagtcttgtgattcatattggaaccaacga

SEQ ID NO: 623245 - DNA, 314 bp, Homo sapiens
catctcttcggcgtcttactccccgccagcagtcgtgcttcctgctggctcccaccctgtgcctcagccgacgggccctcgggctcagcctcagagactgtgctggcagatgggcgagagtcttcactcaggccagactcggcactcagccgcttctcctcctctgcaggcaagggcgacccagagtctggctggcaagggcaggcctcgctccgccgcccctcgatgctcctcttcatcaccttgagctcgctggggtgaggtgtggcccggcgctgtaggccccgcttctcagctgcagcttcctcagcgtc

SEQ ID NO: 623246 - DNA, 162 bp, Homo sapiens
gaaacttcctagggaactagggaacctatgtgttcctcagtgtggtttccgaagccagtgatatggggttaggataggagaactttctcggtattataagaggatctcttgtttcctccacctctgttgtaaagtaaactacgtatacaggacatatgtaac

SEQ ID NO: 623247 - DNA, 137 bp, Homo sapiens
agcattaattatatgtttgaagacgcttaaaattttgtgttggacgtgcaatacaaagccactggcctgcgggttggacaagcttgatctaaagcttttcccaagttcctcacagtattagtttcctagggttgatg

SEQ ID NO: 623248 - DNA, 1066 bp, Homo sapiens
agcggctctctctcctcttctctctctctctctctctctctctctctctctctctctctctctgtctctctcctttcttccctctccccaaccacccggatagacgcgcgagtgctacccgggaagggcgctcactccgaagttgcgaggggaggtaattatcactcaaaacaagaggccggccgtgccgtgtaggaatgtataatatagtgagaccttcacgcgcagcgtcgtctatcagtatctgaacatctgccgcgaggaaaggaagttgctcagaagatcttaagcattgcaacgaagcgcgacctccgggcaggagaagcatcagctaccacagtatcctcgtcgcgggaggccccgccacccaattcgtcattctcctaccagtccagtctcatcccgtcatcagatacataaccacacaccatatatgtcacacatcgtccatagcacatgcattctagaacacataccgtcacgatcgcgtctatatcatgtatgcatgtccgtataacagtacatcccgttatagtaaacttctcagtcgccttccgtacgatctatcttgtactaattacatataacgatacacaatcgttattgacatcacttttacattgtcatatctataccttgccccatacactacacacctacttacacataccacccaagcaaatcacattacgctggctacacccaggaatggaaatgatgataaaatataagtagaggagagagaacatgcctggaaaaggccaggatcaaacaaacaaaacgacaaacagaaaggcggaaaaagacaaaaacggaagggccgagcaggaccatgcaaggagtgaggaacacacaagacaggcggtatggaacggcccgcacccgagcagccatcgaaacagattggaccagaggccgcggacaagaaaatagaacagacacacacaaacacaacgaacccagggacgagcttgtccggatcaatcccccaacaaggtttcagtcaagaaaggcaccaccacaggaaaagaactggctgccaacgcacgacaaagcaacaaggaga

SEQ ID NO: 623249 - DNA, 239 bp, Homo sapiens
tcgtggtgcgtggctcagcgctgcgatcccagtcactgtggaaggctgaggtgggatggatcacttgagccccggagtacaagaccagcctggacaacatatagggagaccctgtctctatttaaaaaaaaaaaaaggaaagacagaaaatattgtgggccttgcgggcaatattggtctctgttatagactcatttactacaagtatggctgctcaagctttgaaaagcaggctttag

SEQ ID NO: 623250 - DNA, 324 bp, Homo sapiens
  misc_feature (168)..(168): n is a, c, g, or t
  misc_feature (171)..(171): n is a, c, g, or t
agcacgaaagtagaacaaaaaacaccagaataaaccaaagaaaggtagacggaaagtaaagataagatattaatgacctaaaagacatataccacaagggataaacacaacctacatccaaatttgttaaaagacaagttcgatctctggcaaaaatgattcctgaanaanggacagtataagtaggcaatattaagaattaaagggggtcaaaaactacagctaaaatggagactttgaaaaatcatgtaagaattctattgagttgtacaatttagattcgtgctcttattgatttcatatgtattttatgcctcgacatat

SEQ ID NO: 623251 - DNA, 244 bp, Homo sapiens
gagctttggagctgtgcatcaggcgccttccactgcataacctgcccatctatttaagagtgaaacccgtatcacttaccacctgtccatttcttcatggtacttatcccctgaattattttatctgacctgctaggatgcaacccccttttttattttgctggcaagtatagcctagttgtctaaactgccacatagtatgtactttataaacagctgaataaaccagtaattcatccaaaaa

SEQ ID NO: 623252 - DNA, 235 bp, Homo sapiens
aattcacatgctaaattttcatcagaaatattttatctgtatttaaatttcctaaaatgtacagttgaaaaaagaggttcacatacccaggttgttctagcatgcctaaaaaatcttgtaactggatcaagtatcagtttttaaattaggtaaaattaaataaaatttaaaatttagttcccagtcacactagccatatttcaagacttgaaggccacaaatggcttgggctacc

SEQ ID NO: 623253 - DNA, 541 bp, Homo sapiens
ctcgtatgttatcccaacacaagcatagatctctgagatgaacggatatcagaggctgagagcgagattgacaatgtaagaaacagtgcgcaatctgcagaacgcattgcgatgcgagcagggtgcggagctggccctcaaaggatgccaggaaacaagctgggcgagctggaggaggccctgcagaagggcaagcaggacattggccggctgctgcgtgaggtaccaggagctcatgaacaccaagcttgtccctggacgtggagaatcgccactttaccgcaagctgctggagggcgaggaattgcagactcagtggagaaaggagttggaccaagtcaacatctctgttggtcacaaagcagtgtttcctctggatatggcagtggcagtggcttattgggggtggcctccggtggaggtcttgcgggcggcctcggtggaggtcttgccggaggttgcagtggaagctactactccagcagcaggtgggggtgtcggcctaagtggtgggctcagggttgggggtgtgggcgatacg

SEQ ID NO: 623254 - DNA, 207 bp, Homo sapiens
gtctctctcgagcatttcttaatgtcctcgataatgctgctaagtggagtccagagaacggcacagtaacaatgacgatgcagcaaattgatgatgatcgagttgagattaccgtcgacgatgaaggaccaggtattccagctgatgaacgcgaactcgtttttgaacgtttctgtaggtctgtagagtcgcgcgcaatgccaggat

SEQ ID NO: 623255 - DNA, 116 bp, Homo sapiens
gttcggggctcaaccccgtgattgcacctgatactgataaactagagtgttggagaggtaagtggaattcctagtgtagcggtggaatgcgtagatattaggatacagtagggaga

SEQ ID NO: 623256 - DNA, 82 bp, Homo sapiens
  misc_feature (13)..(13): n is a, c, g, or t
aacctaaagggcnataattaagaaaatcagtttttacttaaccaagcttttaaaattatctctacctgcacgacaacacata

SEQ ID NO: 623257 - DNA, 260 bp, Homo sapiens
agggggttgaaattccccttttggccagaccactatgccagggggaacccactgaccccggccaaattgggttaattttaataaaaaaaaatgggattttttttgaaccagggaacctttggttaattaaaacctgcctttttattttttaagggaaacctttgcctataaccaggaagggttcaaaaaaattgaaaggacctgccaaaaagaaagtttttagaaatttgtttggaaaaaaaataattaaaaggcccccc

SEQ ID NO: 623258 - DNA, 320 bp, Homo sapiens
  misc_feature (37)..(38): n is a, c, g, or t
  misc_feature (40)..(40): n is a, c, g, or t
  misc_feature (44)..(44): n is a, c, g, or t
  misc_feature (47)..(47): n is a, c, g, or t
  misc_feature (51)..(51): n is a, c, g, or t
  misc_feature (57)..(57): n is a, c, g, or t
  misc_feature (105)..(105): n is a, c, g, or t
  misc_feature (111)..(111): n is a, c, g, or t
  misc_feature (114)..(115): n is a, c, g, or t
  misc_feature (121)..(121): n is a, c, g, or t
  misc_feature (132)..(132): n is a, c, g, or t
  misc_feature (140)..(140): n is a, c, g, or t
  misc_feature (144)..(144): n is a, c, g, or t
  misc_feature (151)..(152): n is a, c, g, or t
  misc_feature (160)..(161): n is a, c, g, or t
  misc_feature (163)..(163): n is a, c, g, or t
  misc_feature (168)..(168): n is a, c, g, or t
  misc_feature (177)..(177): n is a, c, g, or t
  misc_feature (188)..(188): n is a, c, g, or t
  misc_feature (206)..(206): n is a, c, g, or t
  misc_feature (209)..(210): n is a, c, g, or t
  misc_feature (213)..(214): n is a, c, g, or t
  misc_feature (217)..(217): n is a, c, g, or t
  misc_feature (222)..(222): n is a, c, g, or t
  misc_feature (225)..(225): n is a, c, g, or t
  misc_feature (230)..(230): n is a, c, g, or t
  misc_feature (233)..(233): n is a, c, g, or t
  misc_feature (257)..(257): n is a, c, g, or t
  misc_feature (259)..(259): n is a, c, g, or t
  misc_feature (265)..(266): n is a, c, g, or t
  misc_feature (268)..(269): n is a, c, g, or t
  misc_feature (278)..(278): n is a, c, g, or t
  misc_feature (292)..(292): n is a, c, g, or t
  misc_feature (302)..(302): n is a, c, g, or t
  misc_feature (312)..(312): n is a, c, g, or t
tcggccgccgccatggccgcggtggacctggagaagnngngggngtngggngcgggnaaggcgcatcggcgtcctgaccagcggcggcgacgcgcaaggcatgancgcggnggnncgggcngtgacgcgcangggcattnatgnggcgggnnaaaggctnncncatcnacgagggcnaggagggccgnggggagggaggggggagnagnnagnnggncaacnggnggagnggngcgcaacagcatccagcggggcgncnctaccnntnncagcgcccnccgccaggcctctnccaccagggnggggcgccgngcagcggc

SEQ ID NO: 623259 - DNA, 555 bp, Homo sapiens
gatatcagagatgctcgtggagggtgtatagtatacctgccagtaacatgcatgtctgaatagagtattcttggcttgatgttggttccctacatatcacctcaaggtatagattagtgaaggaataagcatgatggaaataatatgtctggaaaggagatagtggtagtatataatcaggaggaagaggaaggaaggacgttacccattgtagatatcttgctgtctgtggccagttgtcgttatcatcatagggaaatcatgacccacctgatccatgttggcatcgctaaggaacgtgctgttcgtaagcggctcatcaagagatgaacttcacataccctctgctagggaatatggaaaagggaagaaagcctacaggactgcccatccagtcttgggaagatatgggatgattctgcgacaagcaaaaatgagtgaagttgatgtatagacacaccgcgtacaatccatcttcagatgactgaatgttgtatgatagcccttctccaaagcagaggtagaatgttcaggtatcggcatggattttgtact

SEQ ID NO: 623260 - DNA, 133 bp, Homo sapiens
atgcccccgcggctgcatgctcggcaatatgcaaggcgaaccgacgcccatcgcggtctgagtcgatcacgccacgctgccgcgcctcaccgaacagccgtgccgaaatcgcgggatcgatgccgtaagcgcg

SEQ ID NO: 623261 - DNA, 87 bp, Homo sapiens
gcatggtcctgtcggttgattcagaggagtcagaatgactcgactgtccttcaactgtgataataaatgtctcagccaaaaaccttc

SEQ ID NO: 623262 - DNA, 719 bp, Homo sapiens
gtagctgttggtttcaacaggagctaagagtgatgtcttccttgtggtctgtggctattcagtattccagtgcgaattgccaattcagttggaagaaacatagtctagaatgtaatgtcatttttttttttttttttttttttacagagcaaaactttgttggcttaaaaaccagggagtgggccgggggtgtgggggctcatggcctggtaatcccagcacttggggaggctgaggtggggccaatcactggtcgggagatcaaggccatccggggctaacatgggtgaaaccctggtctctactaaaaatacaaaggatggggtgggcgcggtgggggcacacgcccatatgtcccagctactgggagaggctagagcgcgggagaatcacttgaacccaggaggcggagtgttggcagtggagccgggatcacgtcactggcgaccccagccggggcgacagagcgagactctggtctcaaaaaaacaacaaaaaaaaacacccacgacgggcgagtaaagagtggcggggcgggggcgaaaaaaagaggcgatcagtgaacgcgacgcccagttagcccaatagcggtggtcccggtgcaccccagtttctttgtgccaccaggggggaaactcgcgcgggacccccaatatggggagggccgaataaattcggaaaagccgaggcacccgggatagagccgggcaaggcaagat

SEQ ID NO: 623263 - DNA, 116 bp, Homo sapiens
ttaaaaaggttgccaaagtctttttttttttaaaactggaaaaaaaaaaattttgttgggtttcaaacagggcttaggatgtttttcccaaagcttattaaaaaaatgaaacctga

SEQ ID NO: 623264 - DNA, 222 bp, Homo sapiens
tcagctcggtaccggcacgagcgcccaagtagctgggactgcaggcgctgccaccacgcccagctaatatttgtatttttagtagagacagggtttcaccattttagccgggatggtctccatctcctgacctcgtgatctccacctcggctcccaaagtgctgggattacagatgtgagccaccatgcctggcctgcatagggaccttttatcagacttcc

SEQ ID NO: 623265 - DNA, 246 bp, Homo sapiens
ggtttctgtcacaatcagatattcttccattgcattccaaaagattctgcagatgatttgtccttacagcagaatacttctcgttgatgaaatactaaactatgcctatttcctttcacagcaaatctatatatcctcgcagctgtgtgatacccctaggtggtggtgcgccagaactgccaaccattacaggaccctagggagtagttaggatatagtcttatcatttgagtctaaatgcaatca

SEQ ID NO: 623266 - DNA, 1298 bp, Homo sapiens
gacttacggctggtgcgggctgggtttgaatcggccgagggtcgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaaccagctgtcagtcaacctggcgaaacgtgcaattcagcgctggaataggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623267 - DNA, 298 bp, Homo sapiens
agggcaatcgtgtcgctaatagaatatgtagtagaggaacacgattgtagagataaattgctctgtacttgccaaatgaaaaacgcaagggaaccacagtggatatgctagcatgatagctgtgcaaagggagtgtagtgtgggaaaagtgtatccattctgggaaaagcccaaaccgaactacgggtcagcagtcaactccagggtttgggcttgatatcctgttgaataatagttgtgagcattctttgtggttaagataaattcttaaatctgcctaagaaaaaaaaaggaatag

SEQ ID NO: 623268 - DNA, 1700 bp, Homo sapiens
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgacctgggcagcttcatgagcacagctgagcaggtgcggctgccggatgactgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 623269 - DNA, 289 bp, Homo sapiens
tggtttgaaacctgatgttcctccgcacagtgagcacagagtgtatttctaaaatggttttactattaccagacgccaaacatctgtaacagcatttgccttttaatagaaacccgttcccactgtgaatcccggatcgaagtattttcctattccctcgatacttcaaagcctcgtatccccatcatgtccttacactccggacttccttcacctaagccacctccactgctacacttctaaactcatcctagagagatttaaaatacctaaagtgactgaactttca

SEQ ID NO: 623270 - DNA, 1859 bp, Homo sapiens
  misc_feature (1834)..(1834): n is a, c, g, or t
gcggccgcattagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacagaacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccgcaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttcaaaaaanctaaaaactcgagactagttctctc

SEQ ID NO: 623271 - DNA, 671 bp, Homo sapiens
ggctgagtgtgcggactgggctttaatcgtgccgaggtcccatttgcttgtgctcatctgttttggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623272 - DNA, 616 bp, Homo sapiens
  misc_feature (591)..(591): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagccgtcatctcccctctgcctcctgctttgctgttgccgagcacgagtaaagcttttgttcttacttcaaaaaanctaaaaactcgagactagttctctc

SEQ ID NO: 623273 - DNA, 800 bp, Homo sapiens
cttgggccggcccccgccctaacccgtccccgccctcaaatatgccccgccctcacctgtccccgccccgcggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgattcctcacatctacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623274 - DNA, 580 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 623275 - DNA, 1443 bp, Homo sapiens
gatcgtcccacgttcgcttcactcccgcatgttctctcttctcctggagtatcgcgaccggccgttctgctgatcgatggcaggcatccaggcaccggcaacgttcgcagttctcttatcgggcattactgagcgcgcttactaagtctcaacttctcattaggcagacgggacagacttgcatgtgagcagacaatgccccagtggatgacaccattcatctctgagcagctgcagactgagcggtgcgtcactagcgactcggactgcggtcgtcaatgacatttacttcgcgaggacttatcgtccgtgctgcactgtgatgttcattcgcggtcgccatcgtctcgttgacgcccgtcgagtcgtactttccttcactagacttcatgagtattcgcgttaggatgcactcgaaggttcgtaggagcacaccatcggatactctgagactcgaggtagactctgcgcatactaaggcacaaccgaccttcagatggtcctagtcccgcgacgtcgagtggagcaaaggctgcgaagccttcccgagggaaccttccaaaatggaatccggaatttcagccaagtcttcaatcggagcctgcagattgcacgacgcgtggcgaagcaaagcaaaggaagcaagggtcccttggacagcccagaaagctagcatggagtagcatagcagccacgaaaggccacaatcctgaagtccaattccccgcttttcccgaggcagcctagtacgaaggcagtgaagaatccctgcagaacactggccagcccttgtgacggctcgagaaactgattgccaacccaaaacggaaggacaggccagggcgacgtcacgaggagggcacgaagctgccgaacaagggggctggcgcacgtgaagaacccctttgccagccaaacacttagcaaagagccgcagccctacattccgcacacgcacagaggaacggggtcgccctccgacgccccggccggagggggaacgaccccgcacggcgacccgggggcttggaactagcgaacaacgcagagcagacacaaagaggcccgcccacaccgaacgcgaccgggccgaccatcagcctcagacagcccgaagaccttccgaacaaaccacggccctacgaaccacgccctggacatatggcacgcaaaaatcctcctcacacgtcggcacgaaaaacggatgccccccaacagaaggcaacaactcgacccgacacctgccagtgcgccaagaaatcccaagaacagcgacagcaatctaccagaggaaaaatgaggaaagctaacacaaagcccgaaactattacgaccacgcgcccaacagcacatccagcaaagccagacaacacaaagccggaccgacaagacacagcgccaaaacgcgagagacatggtcacaacgacctcacagggaccaaa

SEQ ID NO: 623276 - DNA, 212 bp, Homo sapiens
  misc_feature (161)..(161): n is a, c, g, or t
  misc_feature (195)..(195): n is a, c, g, or t
tgtctcagtttcgggacgggagtatatggcagtgtgtgttcccttgcgccaggacctgcagagcctgcacatcaaagaaatgtgtccaggagcgatgcgtggatggctgcagctggcctgagggacagctcctggatgaaggcctctgcgtggagagcacncgagtgttcctgctgtgcattccgggaaagcgcntaccctcccgtgcacct

SEQ ID NO: 623277 - DNA, 161 bp, Homo sapiens
ggccatctgtgaaattatcactcacagataatgacacttgagtgtgctgtgtgcgtttatatcctcttaatatgcttatagtaccatgagactagtgtgccaacgtgtctggctgccaacgtgtctatagctgagccaataagaattagtctctagagcct

SEQ ID NO: 623278 - DNA, 402 bp, Homo sapiens
  misc_feature (3)..(5): n is a, c, g, or t
  misc_feature (18)..(19): n is a, c, g, or t
agnnngtgggccgtccgnncgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgaaacttctacaactaggcctagttttagaagtttcatcagcactgcagatccacactaaggctcaggactgtaatagtgggc

SEQ ID NO: 623279 - DNA, 140 bp, Homo sapiens
acacaactcgtctgaactgcgagaactctacgataatagagcaggattaccataggcaacaacacatcatacagtagggtaacactcacctgtactcacgacgagtctaaccccagactcaagtaccctattagtgagat

SEQ ID NO: 623280 - DNA, 258 bp, Homo sapiens
tgtaccgaaagacacaggtgaggtactgaaaccttagtagttgaagtggtctgggaatagttactggggctgacttactctctttaatacttgaggtaattaacgaatccagtatcagatcacttatccagttggatgtatgaaagttggcacttctttctccatcccggttgtcagtgatgtgcgtgacgtgagtgcccagaaagtgatcctattgtttgtgtggaaggggcctttgtcgactgcgagggctagggg

SEQ ID NO: 623281 - DNA, 422 bp, Homo sapiens
  misc_feature (23)..(23): n is a, c, g, or t
  misc_feature (99)..(99): n is a, c, g, or t
  misc_feature (125)..(125): n is a, c, g, or t
  misc_feature (196)..(196): n is a, c, g, or t
  misc_feature (219)..(220): n is a, c, g, or t
  misc_feature (241)..(241): n is a, c, g, or t
  misc_feature (318)..(318): n is a, c, g, or t
  misc_feature (337)..(337): n is a, c, g, or t
  misc_feature (339)..(341): n is a, c, g, or t
ggggggggggggggggggggggngagggggggggggggggaggggggggggggggggggggggggggggggggggggggggggggggggggggggggcngaggggggggggaggggggggggggngggggggggggggggagggggggggggggggggggggggggaggggggggggggggggggggggggggggngggggcggggggggggggggggnnggggcgggggggggggcgggngggggccggggggggagggacgggggggggggggccgcggcggtggcggggctccccaggtcaggcagggaaaaaanaaaggggcgggggggacanannnaacccacccccatcctccccacactcatggcccttaccagggtactcctacctatctccccttttatactaataatcttat

SEQ ID NO: 623282 - DNA, 592 bp, Homo sapiens
gtcatgctccaccggcggctgtggaacaacttcgactgggagctggtgctacaacctcacgctgaacgacacctcagtacgtccacccagtgctctggcttctgctggggcatcctggtccctcaccactgccctgcgcgagagtagcgcactggcgcttgggcacaggcccgtgtgctgtcggagacctcgctggagactgcgccgaaggctcccagggaccccagcacgcaagaggccgtgacgctgcccccgaatcttcagcttgcagatcctgagcatccctggctggcgctacagttccaaccagacggagcaatctcagaatctccggaagggccatcgaggggaagcccaagtgctgacctccgccgtgtcctgctgcggtctaccacctgtaatgaagtgggcgaggacccgagtcctgtctcatgccacgtaccagtgaatctggaggctgttgcttgccaagccgcctggggtccgtggtgccgcgtggaggagcgcttcggtcacagggcacctgggatttggcggcatgctgctccgttggtgcttggcggacggggccttgtgggcacagagggtgacg

SEQ ID NO: 623283 - DNA, 229 bp, Homo sapiens
ccacacctggctaatatgttttgtatttttagtagagacagagtttcgccatgttggccaggctgatctcgaacttctgacttcaagtgatctgcctgcctcagcatcccaaagtgctgggattacaggtgtgagccaccgcgctcggccccagtttttctcttttttcggttatgagatttcctgctgtgcatgaaataatttctaagatcccttctgtcgtcttctc

SEQ ID NO: 623284 - DNA, 1576 bp, Homo sapiens
cgttccttgtggaatagtggcttgttgtgattgtctagtgtcgtagtctatcgctgtgcacccgtgtactttcgccggagcggagattctttggtgttgtactagtgccagtaaccccttggtgtggtgtttctgtttatggggccacatgatggtcggcagtgtcggaagagtggtgcggcgtttgtgttttcatgactcactcagtcacgtacattgacgactgattgctgatggatgtgtttttggacccgacttgggggtcctccaatatggagcctattgccgctaagactgtaggcgtgatagtgaggaccgccgtgtggctgggtgccacggacgggtcgtttgtcggtgccgatggggcgtccataagcgtgactgcgggttgcccgcaccgcctattgttcggcgcccatcactgggtgacagtgtgcgcgcagtgggtgttgccgtgtgtcacgtaagatgggccaccttggggcacgcgatttttggtccacccggcatgtctttccgattctctaaggacctctgttttggtgtaaaccgctccatgtggctaaggtcttactggccgcaagcccattacgttctaagcctaatgcagtgaccccatgggaccaagactgtcgagtctgcctctatggtcgaaaggtgcttctgttcttctggtagtgggcgcgagtagggagatcgacttggaactgtggcatgtgcccgactttgctggaatcgtctctccacggtctgcattcgagccaacgggatttagcccctgcaatgcctgatgagacctggactggttgcatctgcacgttagagctacgtgaatggttcacaaatgtaatgtgagtggttacgtagtgtaggcagcaagtggcatgtaatgcggtgtcacggatacctcagcatatgcacgcacgtgctaccctttgtgtgtgatatttggatttcccgccgtgagctgagtggtgcacaagatgcaggcccggtctgttgtatcaactctcgcagcacgtcagcttgggctctgcaaaggacctgtgcatgttcaccacgttgcaggttgcgcgtcacttagcaaccaggccaactgccagtgacgccttctgtcatatgcggcagtcatacggatgcatggtttcagctgcgcaatgtttaccgtcacggataggacacttgcacatcacaacttgagtatcagcacggccgtacgtgggcatgagtaccgatgattggtagtctcactcgatggagctgcaggagcaacattgatacgagcctcgtgctgctgagtaatacagcaagtatctcaaggaatgtcacaaccggcagaatgagcgaggacggattatcaggctgtaggtaggctcgaagagagaggtctctaatggcagatgccaccctatcagcctcaggattctcagttccgcttagacagatcttactcaactgcccctttcctctccctgcagaatttgtgtttggctgccatctatcttgtgttttgttttttcttcctggggggggatctagaacagaataccgccacatatagcagctgcaataactt

SEQ ID NO: 623285 - DNA, 205 bp, Homo sapiens
gcctcatagatcgagctggtacccagtttttccatacgtgcagatgcacaagtccatacaatgctgtatcttgtatgggcttgattggagtggttcgcctgcttgtaggcgacctcgtatccacagtgtagccgctccacgcccgggcgctgcgcgcaggcgagccggtcaagcgcgcttcttcaacagggttgacctccaatgg

SEQ ID NO: 623286 - DNA, 822 bp, Homo sapiens
ggaagatggtgagttattgtgcaggagggcatgtcctggaccatgaagaaaggcaagacagactcatagcctatctgctttctcttttgcttttcctcggtcccaccagcctgactttttttttttttttccctaattgggactccacagaagattataaaggagatacatttaatttttcttctggtaagatatatctgatggacacgggtagggaaaatttattggtcaattggagttctctttctttctcagattcatgggccacatatacttgtacttaactgatggggaacaaacaccggtaaaaactcatacacacccataatagggcctgaacctcggggctggtattggtccttcattatctagcctcagaattacccaaactttttaggaagcctggtctttctttcacagtgggagagaaaagcgtggatcgggtggggagggacgaatcagggcctagcattgggtctttggcgggtccatggacagttggcgttactcctccacttctggattatgagcaaatcatgggggggtgtcctcgggcataataaaggggccttttctaaaaaagcttaatcacagagaaaattcaggacttaataggagaggtatcttatctcaccaggaggtgggaatttccaagaaataggggtcggggggtacttacacataagtgcgcaatattggcggcagaggacttgggcggatgggttttgggtcccaaattttatatttttcttggaagagggattttttaattaaagcttgggacttttgggacttgaaggttaaggtttcaaggggtgttaa

SEQ ID NO: 623287 - DNA, 273 bp, Homo sapiens
  misc_feature (27)..(27): n is a, c, g, or t
  misc_feature (30)..(31): n is a, c, g, or t
  misc_feature (74)..(74): n is a, c, g, or t
ttcttactattaattagaatttaaaanaanntttgaccaaacaaagacaaactttactaagcaatgtgacacanagtgctggagctcacagcagccattctggaccaggaggtagccttgaatattgaagcccatgttgggatggtgaatccaaaagatgaggagcctgtatcccctgtgacaccagaactgccataccagccctgggttcctccatctatactgccttcatatggtaaagaaatattcttggatcttgctaggtgtctgccg

SEQ ID NO: 623288 - DNA, 979 bp, Homo sapiens
tgggacctggatgcgttaggcacagtgtgtgggttccgcccatatgtgagaggcccccggccaattcccgcgtgtcttgaatggtgagaagttgcggcaacccaagatttgcgtcccatgggtgaccggccccttcaccgcaccagcgggttaaggtcgccagcgttctcacctgttccccccgaaggagagcccccagtgttccccagcagaaagggagacgtctcgtcgccccgtgttacgcaccgagggtttcccaagaactgtgctcgtcttaaggcgctcttcttaggaaacaacacactgcgcaggcacaagaaccaaagcgaggtacgtacgaatgccccccgccccacttttgtataaagaaatacaacaagtctcctcttcaacacaccccggcaacctgtttgagcctattcctttgtggacccaccccaccctagttgttagacctcgctaaatttgatcccccggaaaagttttatttactggtcctccccaaataaacacacaaacacgcggatgttgttcctgtttatgaaacacaacacaatatgtcctctgcccccactctaagagatcaaatatcccgccgctttcttgccaataaaaccaccctctggcctcttgggacacgccatgaacagtaaaagactactcctccgtgtcaacggtttctgtattagctggttaacagattgctgtcatgagcccacatgcgcggcattaatgtgttatcccggtcacgctgcgtttccgtcacgcggaagttgcattacacttgataggcgcccccgtgtgatatccaaagtagtccatagaaagacagaaatgcaagatagctattaatgccttactttgaaatgggtgctcaccacacacactcatttttgcgtggcaggggcaagggagcggactagggatgccaccaaaaggaaaaacaataaaaaaaatcttttttacacccaaaaaaaca

SEQ ID NO: 623289 - DNA, 211 bp, Homo sapiens
gaaggagctcaggaaagtaacctcataaagttgttcatgaattcctgggttcacccctgaactgcacatctatgaagctgatcctaaacagcatttcaaagactgagaggggaggagctagaagacgacctcccagtccccagattgacccattggttcattgggacaaatgtattaattaagcatcaagggggtttggaaataggaatcc

SEQ ID NO: 623290 - DNA, 356 bp, Homo sapiens
  misc_feature (98)..(98): n is a, c, g, or t
  misc_feature (102)..(102): n is a, c, g, or t
  misc_feature (112)..(113): n is a, c, g, or t
  misc_feature (125)..(125): n is a, c, g, or t
  misc_feature (132)..(132): n is a, c, g, or t
  misc_feature (136)..(136): n is a, c, g, or t
  misc_feature (146)..(146): n is a, c, g, or t
  misc_feature (150)..(151): n is a, c, g, or t
  misc_feature (153)..(154): n is a, c, g, or t
  misc_feature (156)..(156): n is a, c, g, or t
  misc_feature (163)..(163): n is a, c, g, or t
  misc_feature (175)..(175): n is a, c, g, or t
  misc_feature (231)..(231): n is a, c, g, or t
  misc_feature (278)..(278): n is a, c, g, or t
  misc_feature (295)..(295): n is a, c, g, or t
  misc_feature (300)..(300): n is a, c, g, or t
  misc_feature (316)..(316): n is a, c, g, or t
  misc_feature (327)..(327): n is a, c, g, or t
  misc_feature (329)..(329): n is a, c, g, or t
  misc_feature (335)..(338): n is a, c, g, or t
  misc_feature (347)..(348): n is a, c, g, or t
cctggcttgctcaggtctcgggggtcaggtgtggtatcaggaataactgtgggaggatccacggcctgtccatgtctgaggagctaggatctggcatnactntaaggatccnnggtctgtccatntctgagnaggnaggatctggntctnncnntntctgagnaggtagatctgnagcatgagtatgaggatctcggtctgtccatatctgaggaggtaggatctggcgcnggtatgaggatctgggtctgtcaatatctgaggagggaggatctggntctgtcagtatctgagnaggtnggatctggcgctggtntgaggatctgntntgtcannnnctgaggagnnaggagacc

SEQ ID NO: 623291 - DNA, 427 bp, Homo sapiens
cggctacccagctttccggacgcaggcgtgcctgtgaaactggcttctacttttacttttactttttttctcctttttattttttaacgacgacacgcacggggacagaagcaagggccgaggcagacgccacagccgaggtgctggtgaccctgggcgtctgcgtggatgatgggggctgctgcgctcagaggcctgcctccctgccttccaatgcatataaccccagaccccagccaattgacagacgacgacggcagtgtgaacacagtcatttagcaacgcccccgaggacagtgtacaacaaaacgagaaagcatgacatggcgtgcctgaaacgacaagtgtgtcctgtacttggccccacctttagctgggccagcaatggcccggccatgcttctccccacctaggggtaccgagctcg

SEQ ID NO: 623292 - DNA, 801 bp, Homo sapiens
  misc_feature (98)..(98): n is a, c, g, or t
  misc_feature (102)..(102): n is a, c, g, or t
  misc_feature (112)..(113): n is a, c, g, or t
  misc_feature (125)..(125): n is a, c, g, or t
  misc_feature (132)..(132): n is a, c, g, or t
  misc_feature (136)..(136): n is a, c, g, or t
  misc_feature (146)..(146): n is a, c, g, or t
  misc_feature (150)..(151): n is a, c, g, or t
  misc_feature (153)..(154): n is a, c, g, or t
  misc_feature (156)..(156): n is a, c, g, or t
  misc_feature (163)..(163): n is a, c, g, or t
  misc_feature (175)..(175): n is a, c, g, or t
  misc_feature (231)..(231): n is a, c, g, or t
  misc_feature (278)..(278): n is a, c, g, or t
  misc_feature (552)..(552): n is a, c, g, or t
  misc_feature (723)..(723): n is a, c, g, or t
  misc_feature (740)..(740): n is a, c, g, or t
  misc_feature (745)..(745): n is a, c, g, or t
  misc_feature (761)..(761): n is a, c, g, or t
  misc_feature (772)..(772): n is a, c, g, or t
  misc_feature (774)..(774): n is a, c, g, or t
  misc_feature (780)..(783): n is a, c, g, or t
  misc_feature (792)..(793): n is a, c, g, or t
cctggcttgctcaggtctcgggggtcaggtgtggtatcaggaataactgtgggaggatccacggcctgtccatgtctgaggagctaggatctggcatnactntaaggatccnnggtctgtccatntctgagnaggnaggatctggntctnncnntntctgagnaggtagatctgnagcatgagtatgaggatctcggtctgtccatatctgaggaggtaggatctggcgcnggtatgaggatctgggtctgtcaatatctgaggaggtagaatctggnacaggtatgaggatctgggtctgtctatgtctgaggaggtaggatctggtacaggtgtgaagatctgggtctgtctgtatctgaggaggtaggaatctggtacaggtatgaggatctgggtctgtcagtgtctgaggaggtaggatctggccctggtatgaggatctgggtctgaccatgtctgagaaggtaggatctggccctggtatgaggcttatgaggatttgggtctgtcagtatctgaggaggtaggatctgggtgcgggtacaggtntgaggatctgttttgtcagtgtctgaggaggtaggatctggcccccgtatgaggctctgggttgctcatgtctcagacagtaggatctggccctgataggaggattatgaggatctgggactgtcagtatctgaggaggtaggatctgggtgccggtattgaggatctggntctgtcagtatctgagnaggtnggatctggcgctggtntgaggatctgntntgtcannnnctgaggagnnaggagacc

SEQ ID NO: 623293 - DNA, 441 bp, Homo sapiens
  misc_feature (2)..(2): n is a, c, g, or t
  misc_feature (12)..(13): n is a, c, g, or t
  misc_feature (26)..(26): n is a, c, g, or t
  misc_feature (41)..(41): n is a, c, g, or t
  misc_feature (53)..(53): n is a, c, g, or t
  misc_feature (57)..(57): n is a, c, g, or t
  misc_feature (76)..(76): n is a, c, g, or t
  misc_feature (85)..(85): n is a, c, g, or t
  misc_feature (91)..(91): n is a, c, g, or t
  misc_feature (100)..(100): n is a, c, g, or t
  misc_feature (107)..(107): n is a, c, g, or t
  misc_feature (367)..(367): n is a, c, g, or t
gnttgggggttnntaaagaaattttntctttaatcctcctntccttcctcccnttanataataaatcttaatcttnttaaccttnatcctnatccccttnttcgcantatcttctaatccttcctcctcttcatcatcatcatcatcttcttctccttctccttcttcatcatccatatcggggaaccaagtagtactgtaatgggtttggccaaatatcatctttgatgacctctcctaactcatcaagcacctgcatcagaatggtcagtaaaccaggtaaagaagctctctggttcctcatgctggctcttcctgcttggctttattctgcgttttgactcgaacgtttcggtcaaatcctttncaagaattccatttggatttccgggggactttcgaaaaatgggacaccactcttcaattcagatgaaaaatttt

SEQ ID NO: 623294 - DNA, 926 bp, Homo sapiens
cagttcggtcacttctgattgtgtagtggtcgttctggcttgccgttgcctgcgtcatgttctggcccgcttctggtctcggatcttcatttcgtctgtgtgaatgatagacgaagccccgtgtggcgatgccctcccctaatgccctacgcagctgttcccgtaacccgtgtcacgaactttgattcagggttccgacgtattcacgggcacgtatagcctagcatgcgtctgggtggtcacactgcccgtgtctgtgtgctaataacccggtccacagggattatttttgtgctgtgattttgccatttcggctataccacctacagcaaaacccagttctaccgggtcgctgagagttaccgggtgttgttggaatacttgccatatatgtgttaccaactatggtggtcacccaggatcaaacacatagggtctagcaatctatcggtcatggcaaattgaccaatcgcgtgttccgtgtctacgacgtttgtctcaaaccaagaattcagccgaaagtgagttttatgaacgtggaaatgaagtcgatgttctcttgctggcatgcagttgcccactctagatgaaatcatatttcaaaggaattatctatctcaaagaagctcttaattgataaattctatgatgcaggacattgaacgatgattgtaaaaacgagaaagtaaaggttcagaaaagatccacctcaactacgctatgaagaagactcagctactgaaggcaaaaggccatggctgaggacctcgggggatcaggacaaggccaaacaaatccaagatcaactgaatgagctggaggaactgggcagtggcctggaccgccagcggaccaagaacatatccgctatcaagttacatcaaccagcggaaccgggagtggtacatttgtagactcgagcatta

SEQ ID NO: 623295 - DNA, 776 bp, Homo sapiens
  misc_feature (98)..(98): n is a, c, g, or t
  misc_feature (102)..(102): n is a, c, g, or t
  misc_feature (112)..(113): n is a, c, g, or t
  misc_feature (125)..(125): n is a, c, g, or t
  misc_feature (132)..(132): n is a, c, g, or t
  misc_feature (136)..(136): n is a, c, g, or t
  misc_feature (146)..(146): n is a, c, g, or t
  misc_feature (150)..(151): n is a, c, g, or t
  misc_feature (153)..(154): n is a, c, g, or t
  misc_feature (156)..(156): n is a, c, g, or t
  misc_feature (163)..(163): n is a, c, g, or t
  misc_feature (175)..(175): n is a, c, g, or t
  misc_feature (231)..(231): n is a, c, g, or t
  misc_feature (278)..(278): n is a, c, g, or t
  misc_feature (698)..(698): n is a, c, g, or t
  misc_feature (715)..(715): n is a, c, g, or t
  misc_feature (720)..(720): n is a, c, g, or t
  misc_feature (736)..(736): n is a, c, g, or t
  misc_feature (747)..(747): n is a, c, g, or t
  misc_feature (749)..(749): n is a, c, g, or t
  misc_feature (755)..(758): n is a, c, g, or t
  misc_feature (767)..(768): n is a, c, g, or t
cctggcttgctcaggtctcgggggtcaggtgtggtatcaggaataactgtgggaggatccacggcctgtccatgtctgaggagctaggatctggcatnactntaaggatccnnggtctgtccatntctgagnaggnaggatctggntctnncnntntctgagnaggtagatctgnagcatgagtatgaggatctcggtctgtccatatctgaggaggtaggatctggcgcnggtatgaggatctgggtctgtcaatatctgaggaggtagaatctggnacaggtatgaggatctgggtctgtctatgtctgaggaggtaggatctggtacaggtgtgaagatctgggtctgtctgtatctgaggaggtaggaatctggtacaggtatgaggatctgggtctgtcagtgtctgaggaggtaggatctggccctggtatgaggatctgggtctgaccatgtctgagaaggtaggatctggccctggtatgaggcttatgaggatttgggtctgtcagtatctgaggaggtaggatctgggtgcgtcagtgtctgaggaggtaggatctggcccccgtatgaggctctgggttgctcatgtctcagacagtaggatctggccctgataggaggattatgaggatctgggactgtcagtatctgaggaggtaggatctgggtgccggtattgaggatctggntctgtcagtatctgagnaggtnggatctggcgctggtntgaggatctgntntgtcannnnctgaggagnnaggagacc

SEQ ID NO: 623296 - DNA, 838 bp, Homo sapiens
  misc_feature (98)..(98): n is a, c, g, or t
  misc_feature (102)..(102): n is a, c, g, or t
  misc_feature (112)..(113): n is a, c, g, or t
  misc_feature (125)..(125): n is a, c, g, or t
  misc_feature (132)..(132): n is a, c, g, or t
  misc_feature (136)..(136): n is a, c, g, or t
  misc_feature (146)..(146): n is a, c, g, or t
  misc_feature (150)..(151): n is a, c, g, or t
  misc_feature (153)..(154): n is a, c, g, or t
  misc_feature (156)..(156): n is a, c, g, or t
  misc_feature (163)..(163): n is a, c, g, or t
  misc_feature (175)..(175): n is a, c, g, or t
  misc_feature (231)..(231): n is a, c, g, or t
  misc_feature (278)..(278): n is a, c, g, or t
  misc_feature (589)..(589): n is a, c, g, or t
  misc_feature (760)..(760): n is a, c, g, or t
  misc_feature (777)..(777): n is a, c, g, or t
  misc_feature (782)..(782): n is a, c, g, or t
  misc_feature (798)..(798): n is a, c, g, or t
  misc_feature (809)..(809): n is a, c, g, or t
  misc_feature (811)..(811): n is a, c, g, or t
  misc_feature (817)..(820): n is a, c, g, or t
  misc_feature (829)..(830): n is a, c, g, or t
cctggcttgctcaggtctcgggggtcaggtgtggtatcaggaataactgtgggaggatccacggcctgtccatgtctgaggagctaggatctggcatnactntaaggatccnnggtctgtccatntctgagnaggnaggatctggntctnncnntntctgagnaggtagatctgnagcatgagtatgaggatctcggtctgtccatatctgaggaggtaggatctggcgcnggtatgaggatctgggtctgtcaatatctgaggaggtagaatctggnacaggtatgaggatctgggtctgtctatgtctgaggaggtaggatctggtacaggtgtgaagatctgggtctgtctgtatctgaggaggtaggaatctggtacaggtatgaggatctgggtctgtcagtgtctgaggaggtaggatctggccctggtatgaggatctgggtctgaccatgtctgagaaggtaggatctgggtctttcaatatctgagaaggtaggatctggccctggccctggtatgaggcttatgaggatttgggtctgtcagtatctgaggaggtaggatctgggtgcgggtacaggtntgaggatctgttttgtcagtgtctgaggaggtaggatctggcccccgtatgaggctctgggttgctcatgtctcagacagtaggatctggccctgataggaggattatgaggatctgggactgtcagtatctgaggaggtaggatctgggtgccggtattgaggatctggntctgtcagtatctgagnaggtnggatctggcgctggtntgaggatctgntntgtcannnnctgaggagnnaggagacc

SEQ ID NO: 623297 - DNA, 149 bp, Homo sapiens
aatgtactgtgatacttactagctagtcactaaagtagtagtttacaaaaatatcatcagatctgtgacactggaaattttctaaactcagatttggtgaaaaattacttagaaaagatatattatgaaacttctttcctctgggtccc

SEQ ID NO: 623298 - DNA, 390 bp, Homo sapiens
ggatacccgactatgctgcaccagtcaatgaaagggacactttattgaggcttttttgccacggggcctgggcaggaggctgccgcgtggaagtataagaacaaccttatttgaccttcttcttgggacgcaggttgttggtgtgaccacacttcttcttgcggcagttgacagcacgagggtgaaggcgagcatagcacttgcggcagatcatcttgtcgcagttgtatttctgggcaagctggcggagagaaggctcaataatgccacctcgcaggcgcaacaccaggtgcagggtggactctttctggatgttgtagtctgagagagtgcggccatcctccagctgtttgccggcaaatatcagacgcttgctgtgcaggcatacct

SEQ ID NO: 623299 - DNA, 266 bp, Homo sapiens
gagctggtaccgccagcttatgccgtgagggagcgcatgagcctcgcccgtcctactatgagttcatcggcgtaagcggctgccagtgatgtgttgcacctgtaccggctgctctggtgcctctgtcagttctgaacgtcctgggcctgttcctgggcatcatcaccgccgtgcgtccgtgggggccttaaagaacatggatgcctcgtgtcccggctggactatggtcccaggcgtcccatcttattctcccacccgacgggata

SEQ ID NO: 623300 - DNA, 742 bp, Homo sapiens
  misc_feature (10)..(10): n is a, c, g, or t
gccacccttntgttgggtgagtacacaccaaaattttctctagctgccggctgcgagcaaaaaaaaaaagaggggtccggggtgggttactcaaaaaaatcccctggttgggtggtttccggggcagggaggcaccatttcgttggtttctgggtggggaagtactcggggaaagcaactttcggggtgaccgggctggtctctggtctcgcactcctgtcattctgtcagagttggcttggttggtctttataatatatatatgatctgctcctttctctagtcgaagacaacagcaacaaaacacaccttgtctggctttgacagctgcctgtttcaggcggtaaaggtagagcgggcgggacatcaatggttcccttgtagaagtagagcagctgcggtcagagtccagccagttcaaggccagcggctggtagctcagtctggaataggagaactgagcaggacagccctatctgcccctccatagcagttccctcgtggtgtttgtgcaaagggcagttttccttctgggcactgtcatgtgatgcgtgctgtggaggttaggtcgggtgccgggagtggagcatacagaccgcagggtcctttggcaaagcttagagctgggtccaggtgccatagacagcttcagttgaccctcttgcagctggggtctaggatgacagaatcccactccacccacaacccatgatatgtaggagcagaaataaacttgtgtagc

SEQ ID NO: 623301 - DNA, 387 bp, Homo sapiens
  misc_feature (35)..(35): n is a, c, g, or t
  misc_feature (292)..(292): n is a, c, g, or t
  misc_feature (379)..(379): n is a, c, g, or t
  misc_feature (387)..(387): n is a, c, g, or t
aaaggaattaaagggctctggttgaacttgggtcnttggggaaatttgcataatacacttctgggtagatgtctcttcccctccctgctccccaaaagaaagggtctccctctgttgccccaggctggagtggagtacagtggcatgatcatggctcactgcagcctctaactcctgggctcaagtgatcctcccaccctagccttctgagtagctgggactacaggcgcaggcacctatgcctgggtaatttttatttttgtttttgtagagacagagtctcactgtgttnccaggctggtctccgaactcctggcttcaagtcatcctcctgcctctcttttctcctcttaaaaaatactgtcttaaaaaggaaaanaactatan

SEQ ID NO: 623302 - DNA, 837 bp, Homo sapiens
ggttcagatgcattagctttggcgggcaagggcagcttccatcagcgatatcgtttctgtgtggtgtgcggctgtggtgtggttgtgatgaaccgagtccttgatgctgcaggccgggaaaggcctgcaacttgagccaccgtggtctgagcggtggggtcatggattcagaagcccgctgcgtggtgtggcgtggatggactccatgccatggagctgttgtgggttgacgttgcacacgatactgtgcactgttgttgtctctaggcactccagagcaccatattgtactccatccctggtgccgacaacgtgagatgcctcagcgtccgtccgcggtgtcgaaccggagagtagacgtaggacagcgactcgtgcactgcacagtcagtccggtgagttctacagggactgaccctgctttggcgattgtacacatcactccttcgtaggatgctgctgtggaagacgttcctgtggcgctgcgacagcacctgttgcctcggtgcatcgaggatccgccaatggacgcaagtaaagcctcaggtcggtgatggagccaggtctatgggacgaacgctgtgagcaaggccgggtcgatgcgtgccccggggaagggtcgcgcacgggggtcccagggttcctgtgggtccgtcaattccattcctggccaaagataggcgtctcaagccctggggtcccggacggaacacgcgataaaccttgggcccgttcataacgagcatcctggggactcgttgaacaatcccctcgtggacacggcggttggctcgtgcgaggactgaggtcttgcgtgggagcagacgcattgaagta

SEQ ID NO: 623303 - DNA, 341 bp, Homo sapiens
  misc_feature (200)..(200): n is a, c, g, or t
  misc_feature (207)..(207): n is a, c, g, or t
  misc_feature (223)..(223): n is a, c, g, or t
  misc_feature (247)..(247): n is a, c, g, or t
  misc_feature (251)..(251): n is a, c, g, or t
cctcaaccccttagaaacaggcggcagctaaggtgtttgctagtttatttgttctaagcagacatgaggtgtgagaagttgtatagagacagaaaacggagcaactagattcacgaaacagcctaatctttgtctctttaaagacaaagctgttgcaaaagaataccttggtataaccaggtggtgtggagcaagttttnaaaaaanaatgtaagccttttgnaaataaaccagaacctcgtggttntaanaaattaaggaaaatcagttttcttggtttcagtgtggagagccttgtatagggttggacaccccctacttaacatccccctcccccccgc

SEQ ID NO: 623304 - DNA, 574 bp, Homo sapiens
  misc_feature (41)..(41): n is a, c, g, or t
  misc_feature (84)..(85): n is a, c, g, or t
  misc_feature (99)..(99): n is a, c, g, or t
  misc_feature (102)..(103): n is a, c, g, or t
  misc_feature (115)..(115): n is a, c, g, or t
  misc_feature (127)..(127): n is a, c, g, or t
  misc_feature (146)..(146): n is a, c, g, or t
  misc_feature (149)..(149): n is a, c, g, or t
  misc_feature (154)..(154): n is a, c, g, or t
  misc_feature (202)..(202): n is a, c, g, or t
  misc_feature (248)..(248): n is a, c, g, or t
  misc_feature (253)..(253): n is a, c, g, or t
  misc_feature (445)..(445): n is a, c, g, or t
  misc_feature (452)..(452): n is a, c, g, or t
  misc_feature (462)..(462): n is a, c, g, or t
  misc_feature (504)..(504): n is a, c, g, or t
  misc_feature (536)..(536): n is a, c, g, or t
tgctcgtgcccccttccttccccagaaagagctttggtggnccctgggaatcagactgcatggtttcttggtgggagaggaggnntggggtgaggaganggnntcagggactgtntcctccccttgngcaggagtggcagaagggntgntgtgnccagccatgggcaccccaggtagcaggggcaggtcggtgagggtgggntgcatctccatcctcagcaggtgctctgtcagggccgtctgtggcnggtgntccctgtgcctgctcagctcctgctcgcgagctcgcgttgaggaagcgctcgttctgacgcagaaatggggccactcaggctctggggaactcctcattcgcttgaaggcttcatccctcctcatccgaaatccagtcgctccaccacagggctgcccgtccaggtccaggagaagtggcagggcttctgtnaccagcncgcggtaccnatcctggttggtgcagctgtttccagacaggttgaggatganaaggctctgggggaactcatccagcttcaatntttctatcaggttctcagaaaggtccagaaactggagg

SEQ ID NO: 623305 - DNA, 560 bp, Homo sapiens
atcacacaggatggaggttcacaggctattgaaaatgcagtcactatggtgcacaacgatggcagtatgatcaccatcccacccactgaatctttgctggcatcagcggaggctcattcagttactgtagccacagaggatgggactgaaagacagatgactattatgatgcctgaattaacatctaggaacacacaggatggattatcagcacatcccatcacacttctggctacttctaatggcacacagattgctgttcagctcagtgaacagacttcgctggaagaagctttgagaatagcatcatcattacaggcagaagaagcggagctggctgattaaccaccttcaccttgagactggatttagtgcggatagtgatcacatcaactcgtggatcagcttttgtaattcccctgagtttcccctcaattgtacaaaggtcaagtcatgcactataatagcatttctaacagattttgatcaccctgatatagatctctaaatggcagaaccctgtttgcattttttaaataaactgatgatggtgatattta

SEQ ID NO: 623306 - DNA, 271 bp, Homo sapiens
ttgcatgttctgtggcagactgaacatgcacatgaaatgtaccgaactgggaagtgggattcagatccatcagggaccaaacaactgcattgatcacacggaaggcatcctgaagtatatgacaacgaagtctaccctgacacagcagatcacaaatgtggtagaagccacacaaccacgtgaacatccagaactggtgcacgacggaggccgcacgccgtgtcaagacccatccccaattcgtgattccctaccgatgcaaagtcggtga

SEQ ID NO: 623307 - DNA, 710 bp, Homo sapiens
gttggcggcgtgtaaagaagcgtagtactactagtgacagactggtagaatgcactccttaaaagcagcaggaatgcgagctttagcgcgtcacagcacttgatgagggcctcgtacattaccgcatccgcgtcccaggtagttctgtcctgggcatccttgattcctgtattagctgtctcatctgctatagccagtgtcttgctggggcattaacaccaagacagtgatgtttcatcgagcatgactgacttgttctggcataagatagttaccagcggtgactttgacaaacttgtcaatgaacttcttgctgcctcatcatcaacaaatgctttatcaccacaaatttttaaaactgtaatgtcgtgtctcctcttaaatttctgcaaatggcctgttgaatattcacagcttccttcaatttttagttcatcatgatagatctttgcttgtttcatgaccagtattaccattaagtgacatgagttcactccaatgctgatggatccactttttcaatacgtgatcgaaatcttcatttttagcttggtgcagggtatttctatctttcattaacttctgttcacgatttcagcacagaatttcaatagcttatcctttcgtttcttcaggtcatatacggtagccattccaacaccatactcttctgcaacacactgcacacttaacaacatgttcagtttctc

SEQ ID NO: 623308 - DNA, 731 bp, Homo sapiens
tactttttcctctcttcagcgtgtggcgcccacaaatttgctgcgctctcttactgctgctaccccagctctcggatacagcctgacaccatgggtttcggagacctgaaaagccctgccggccatccaggtgctcaacgattacctggctggacaagagctacatcagaggggtatgtgccatcatcaagcagatgtggcagtatttgaagccgtgtccagcaccaccgaactgccgaccttgtgtcatgccctacgttggttatactcaccatcaaagatacattaccaaatacggcaggagcatatttgcccaaagagtaacgaaacacatcctgactaagctgggacttagcagagcacgtaaccaactataaccctgctacaacaacgagacacagcaaaagccaggagcacagagaaaagacgaccaacatagagacaaagcataaatacgacacagcggcacacaaaacaacacacactgcaacatagacacagagagaaaacactaggaagcgggccaacagcaagagaggtacaacccacagaagcaacaagacagagaacagcacaaataggaatctcacaaagcgcaacatgcaaatcacaccagccagaagtacaagcaacaacaaccaccactcatgcaacacaaagacacaaaaaaagagcccagcgacaaacaccacgactcaaacggcgaaacaaccaacgaccatgaggaaaca

SEQ ID NO: 623309 - DNA, 301 bp, Homo sapiens
ttaagaaacttaagcagccgggcgatgcgtgtcacgcctgtaatcccagcactttgggaggccgaggcggatcataaggtcaggagatcaagaccatcctggctaacacggtgaaaccccgtctctactaaaagtacaagaaattagctgggtgtggtggtgggcgcctgtagtcccagctactcgggaggctgaggcaggagaatcgcttgaacctgagaggcggaggttgcggtgagccaaaattgcgccagtgcacactgcacgccgtgctgggggacagtctgagacgcggtcggga

SEQ ID NO: 623310 - DNA, 131 bp, Homo sapiens
gtgctgcggaagctggttctctttgtccttaagttgatcgctagcaggcaccagcggggtaagatgctttgtactttgcttgttacacagagggctgctaagccgctgtggcagtgtgacccttgttgtgc

SEQ ID NO: 623311 - DNA, 456 bp, Homo sapiens
tggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacagaaaattagctgggcatggtggcacatgcctgtagtcccagctactcgggaggctgaggcgggataatcacttgagccaggagaaaaaggttgcagtgagccgagattgtgccactgcactccagcctgggtgacagagcaagactctgtctcaaaaaaagaagcgggggagtgggggattgaggccacgtgcagtggctcactactgtaattccagcactttgggaggccgaggcaggaagattgcttgaactcaggagttcaagaccagtctgggcaacatggtgagaccctcgtctcta

SEQ ID NO: 623312 - DNA, 98 bp, Homo sapiens
gtctcccttaagactatacctgttagcagggctttccactttccttcctggaaatatctggttgtgtatcccttctgtcgtcttctaacagccgtata

SEQ ID NO: 623313 - DNA, 482 bp, Homo sapiens
ccctcacgattacctcaagttaaaagaaaatctacaagtacttaaaaatcaaatctaaaattattgatccccgagtggctacaatgcctctttaataaattccagtcttctttatgaaattggttaacccctttattaagccctctcttgcttatgtgtcttgtattgatatttggaccctgtatacacaatactataactcaaattgtttcttctcatctagaagcaatcaaactccaaatggtgctgtaaacagaaccacacgtagacacatcattcttctgaggacccttagattgaccccaggaggagccctagctgctcttccccattcgacgcccttttgcaacaagaagtagccagaaggagtcgtcgcccaaaactccctaacagcagttagtgtggcatctccacaggggggaatgttgtaggagttattaagaaattattttaggcagatagagaggaaaatgggtccttgg

SEQ ID NO: 623314 - DNA, 208 bp, Homo sapiens
ctggcgggattaaaatcgctgaccgggaggtggaggttgcagtgagcgagatgccagcctaggtacagagcgaggctccacctcaaaaaaaaaaaaaaattaaattaaaattaaaaatatacctcccttttctacaaattggatataattggccatggatttaaataggcatatgggggcatgtctggggagagacaagataccttgg

SEQ ID NO: 623315 - DNA, 1057 bp, Homo sapiens
  misc_feature (171)..(171): n is a, c, g, or t
gctggtaccgagtgtatttctcacttacttacttccccagaccccgggctcgcctccacaagaggagaagtagactgcgcctggcggtcctggttggcttattcttagcagtgtgtggcacgtgttgcccaggtgtgggaagttggtgttaaactgtctcctgagcgtccnagtttagtaacagtccgttctaagagaagagtttaaggaacataaagagccataacaccgtcctccaagtccgttcgtcctcaggttcttggtgtgaaactccagcttgagtgttaccacagtaacgatcagttaattgggcaagccctgatgtcagtggtgtgtaactgacctctggtcctgagctgcacagagaacgccctataatcacaggtcttgtgatggccccgaaatgggggtgcctgctagtcaggaggatgctgtgcacactgtgtgtgactgaatctcgcgcagaaaggctcctgaggtcccaggtttggcacttctccctgcaggcattgtacgaagatctgctggtccttgcaggcaaagctacagccagaatgtccgtttgaaactcctaactcatctgtcaccgagcttcatccgaatgtgccacggagcttggtctccaattcctccgtgcagtggcctgcacagccttcctcggacactttgaccctttgtaggattggaattagcaggactcggcgtatctaaagcacccagtctgggggtcgcttggggcctggtgaaccccttctccagagaagcagacagcccgggacaagacggacttcctctccttcgggactcacagcctttgcagagtcacggtccacttgaagggctcaactcaggtaaatattcctttcacaggcggtgtaaaattggtgcggcatggccgttttttggtggacaattataactggagccgtcacacaataatatcgtgtcacgcataaccacttgtcaacgactatgagatattcaaggggcgttgagcacaggcgacggggatggtctcccgcactatgacagcaatcctgcttgacttggtaatgcc

SEQ ID NO: 623316 - DNA, 228 bp, Homo sapiens
ttcattatcaaataaatactttggaaatacctccttgtcacttatcatatggatgtttatattttatattttatttacttataattgtgccaagcattattaatgtctacttaccgtgtcattctgaggaaagaaaaacttgtaaagtgtttaataaattagcatcaacttacataaattaaatgttaaaattttgtaaaatattaatcagaataaatactgactctt

SEQ ID NO: 623317 - DNA, 405 bp, Homo sapiens
tttgagagtgtttcactctgtgacccaggcttgagtgcagtgacaccaacatggctcaccacagcctcaacctctgaagctcaggcaatcctcccaccatagccttctgagtagcttgaactacaggtgcacatcaccacacccggctaatttttgtattttatgtagagacaggattttgccatgttgcccaggctggcctcaaactcctggtcgcaagtgatgcgtccgccttggcctcccaaagtgctagaattacaggtgtgagccatcctctctaaattctagagaaagaatttggaagggctaaatttctttctctcccttacctcctcccaattttaccctcttcttaacatccccctatattttccataacttcatctactcaatgggctgtcgaag

SEQ ID NO: 623318 - DNA, 2052 bp, Homo sapiens
  misc_feature (987)..(987): n is a, c, g, or t
  misc_feature (1374)..(1374): n is a, c, g, or t
ccccccccccccccccccccccccccccccccgcccccattggcgacacccatcatcaccccaacgccttgtttcaacacacacacgccacggcccctggctacccgcgctcccgcgcacacttccccgcgcgcacctactccgctcgcacccccacgccgcctcccgcctacctatgcgcctgcctccgcctgcacacacaccctatcactcccccttatacatacgtcccacacacgataatgcgcgaacacacgacgaacaaacacgaactactccatgtaactccatacccacctctgcctcggcctccacctctgccgcacctacccgccgtatgcacactctccgtcgcgcaccatacgcactccccatcgcctactctctacccctgcgcccccaccctcccctgcaaccctcactacctaccacatcgctgcccgcgcctgcgcctcacctccgcacccacacaccaccgcacaccccccacctctggcacaccacacaccttctcctgcaccgcacacgcggacgcgccctgcccctgcacccacttgcgcgcacacacgccgcgccctcccctctccacacgcccctacctgccccctgcgcgcctcctctgccgcactacacacccctgcacaccacgccctgcacgccgcctgtcacacccgctgcgccttacttccaacaccaccttgcacactagctcactccacctctgacactgtcgccacacaacttctctgcacgccaccccaccgcgccatacgcctaacccttactgcctgcaagccttacctccacctctgcatcttggccacctccctagggcgactaaccaccccaaggcaagacacccctcttctaactcagaaaaccagcactacccaactggcaactctaaccacgccgggcaaccaaatctttcccttccaacgtcgacacacttgaaaaaccttggcgtgaatccctagtcttcccccntgtacaatcttcctggccttctggacctctggcccccttgggcccttgtcctttttgagggagactggacaacaacctttgtttgagaacaacgggtccccttgtgggtgctaaactttctctcgccccaaacaagtgaaacaaccttggggggggcccaagaaaaagcccccccggagaaacggacaaggaccccaaacgttgtgacaccaccctttttcctttggggctcccttattaatcgaaacaaacccatgggggaggcgttgcctttgcagcaacaatccgaaaaaccccatataaaagacttttttgtgattcctggaggtatagattttaacaaacccgagaaataacaacatgtgggaattttttccccccaaccgnttgggaatgcgcctcctaatcccccctgtaaaccagagcccccaaggcaaaacgaaagagaaattacattggaaagggggaagaacaacctttttgggcttctgaaacacggggagaaaaatggctttcgaaggtggccacgcgttttatgaaccaagtatttttaaaaaaggagaataaacaagaatcttttggtgggccccatataatccaaaaattgacccccccggtaaacccaaacctaaagagcattaaggcaccaacatattttgtcttgagcccccaaaaaccttttctaccgttgggagctttgggggaaaccttggtgggttggatacacaaccaatttggccctttggggaaggcccccaaaaaaggtatggccttaaacacccaatttgtcccccttttgggtgtcttccaacacgggcggaacttggcggcaacacacagtttccaccgccggcgtaaagggggaacttgtgcgcaacttgtcccacgttgggtaaaaacccaacagcatggatgactatgtaagaggcctccttgtggaagctgggtgacttccctaaatccacccaaaaacctgagctccaaaccacccggccaccacaagccccccccttcatcgcccagtcccccctaccccccccgccagcgctccctaccccccccttg

SEQ ID NO: 623319 - DNA, 192 bp, Homo sapiens
tatccggttacgtcctgtgctgctttttgacctacactgacccgatcttgttgttcaggccgccctgtgcatgatttggtcccatgcagaatcacacagcccggttggtgactttgatggctgtcaggcactgctcgcgtctgcagccctgtctgcagagagcaccccgtggccctgcatgcacggctcccc

SEQ ID NO: 623320 - DNA, 152 bp, Homo sapiens
  misc_feature (125)..(125): n is a, c, g, or t
cggactgcgagctgggacaggataccagtatgcaggctgagagcaggctcagagcgggctgacaggcactgattcacaacctccaagaggtgggtgttctccagggcagctgccacccgctcctntctctgcaagttgcttgttccgctggt

SEQ ID NO: 623321 - DNA, 86 bp, Homo sapiens
ttccctttttttctttaattttaatttgggaggggggggtttttaattaaaactttttttttgaaatacccatagattccccccca

SEQ ID NO: 623322 - DNA, 196 bp, Homo sapiens
  misc_feature (88)..(88): n is a, c, g, or t
  misc_feature (133)..(133): n is a, c, g, or t
  misc_feature (172)..(172): n is a, c, g, or t
ggcgcacctgcaatcccagccactcgggaggctgagggaggagaatcgcctgatcctatggaggcgcggagagttgtagtagagccanagatggagccactgcagacgtttgggtgacagagtagagactccngtctcaacaaaataaacaaaaaagagacgaggtatcacntgtgttgcccagcaaggtctcaaa

SEQ ID NO: 623323 - DNA, 1148 bp, Homo sapiens
gcctcctactcctcattgtacccattctagatcgcaatggcattcctaagtgcttaccgaacgaaaaattctaggctatatagcaactcacgcgaaaggccccaacgctagtaggcccctacgggcgtactagcaagacgcttcgacgtgatcgccgagtaaagacacttcaaccgaaagagcaccctaaagaggccgcgcagatttacgcatcagcctctacatcaccgccccgatgcttagctctcagcatcgtgtctactagtatgaacccccgctccccagtacccaagccccctggtcaacctcgaagcctaaggactcctattgtagttctaagccacctcgtagacctacgccgtttactcaagtcctctgatcaggggtgatgcatcaaactcaaagctacgcacctgatctggtgcacgtgcgaaggcaagttaggtcgccataagccaatcgtccatatggaagagtcaacccgtagcgcagtcattcagtacgtagtcaaagcattaggtaatcaagtggcctcctgtgtacaccatctcacaacccgttatcgacgaacacgaagaagacaccgtcgtggaatgatcgtcgctggaccgaattcgaatgaacaccattggtgtcccattagactacttgaatttctagtcgtcgcagacaaatatggcaagaagaaccaaaagacgaaaacctcccatttcggagacctttggcccgaaggggggacgtcccgacaactaagttctcaaggcctttcagaaccaattcgcaattaacggcccggcaagggccccccttttcgacacgcataatgtccttcaactaagcccggaaagtaacacaaaaaccatttcattcattaaactaagaaacagcccctccaaccatactaacaaaattctttcgcataagagacaacaaaacaatacttgaacggcaacctccttccacaatgtaagcctgcataaccagcaaaaccattaattttatggatccacacaaaggaaacccttaacttttccttaagccatccccatgtttccctctactgaacatctcgaaacaggaatatcccccaagaatatcctgactaaagaacccaaacttcattaccaaccttccctattaacagaaat

SEQ ID NO: 623324 - DNA, 230 bp, Homo sapiens
accacagctccgatgaccacaactgcttttacagccaggccagcaacaatgcccacgatttggacggtggactgggaagatggctcccatctcatggtgaggttcttttttttcttattttatttttatttctatttttttttttttttttttttatttttttttttattttttttttttttttttttttttttcttttttttttttttttttgatttttttttattttt

SEQ ID NO: 623325 - DNA, 911 bp, Homo sapiens
  misc_feature (682)..(682): n is a, c, g, or t
agcgggggcatggcggcaccgcggaatatcccgcagccaggatagtgcgcctacaaagcccatgcttgctctagcagagtcgttgttcatccgcggacgccgttgtccaccggtgtctctcgcgtcacgagagctgcctggtctcgctcgtgagcaaggtcacccgtatgccgtctaagcaatgaatctgtgggagcagatctgcaaggagtatgaagctgagcaggctccctttccgagaaggatataaagtcaaagaggagcctgtgatcacgggttgcgccagtagaggaagatgctttttcactggcgttcagtggcagagcacgtattcttcgcggtttcccattgtcaccattgatctcactgtacaccctgatcctcgagataaactcgggaaacgaatcaaaccgaaaagcatgttctgccaatagaatattctggaagactttcatcttctcctgttgctgcttcccggaagtggcgtagcctgcgttcaccgagagcgaagaacgaacaaatgttgttgggaggaaaacgaagcagattcattgcctgtgattttctgactgagtggttatacaagcaaaatccaaagagggcaggggagccaattcacagaatttgtctccattccatttgtggaggagcggctaaagcaacaggccacggtcgccaatcncactactcgctccttgtgacagaatgagggaagcaagcctctacattcaatccttctggagagcctgtgtgggtcgctgggatccttgagattcaagaacctggtcagtggcagaagaaactttggaggcgagcacggtttacaagggaggtcaaagtttctgggcaaggaagaacaaaaagtgaaatgggcattgggggacgaatgggaacttgtgggacaaatgacg

SEQ ID NO: 623326 - DNA, 96 bp, Homo sapiens
catggatttgctggtgcagtacaactaggcttaatactcgaattccaagcttctaacgttagaagcttgaattcgagcagtagtagtagtaggcgg

SEQ ID NO: 623327 - DNA, 303 bp, Homo sapiens
  misc_feature (195)..(195): n is a, c, g, or t
taaaggttgcccagaggggccaggtggcacaaataagagaggggaagatggggacagacaggagaggaagtgtccattcctcgcccagacagagcgggcttctgtttggcctttcacgaggcctgtgagtgcctcagaaagaagttgggccctctgggaaggctgtgttcagttaaggaacatacagcgtgtatntgatgtccctcccctgcccccctgccccccccaccgccttccctttttccctgtgttccttaaagtttcactcctgaataaaacttcactttgccttaaaaaaaaaaa

SEQ ID NO: 623328 - DNA, 211 bp, Homo sapiens
accttgcgcacgtgtcagacggaacttgtacagcggagtcatgcaccgcattggtgaatacacgtcgaccaggctccagcttaacgatgtatcggaggtcagcacggagctcacgtgtcgacggaacttgtgcagtgacgcatgcaccgcatgtggtgaatacacgtctgatcctgtgaggcatgcatgcatagatctgtggtactggaga

SEQ ID NO: 623329 - DNA, 523 bp, Homo sapiens
ataacatataacaagatctatcaacattttagcaatatgatacaattttgggatgcatattaataacagatttatacaaatacaactcaaagaaaattaaacaacattttttatttgatcagcttcctgtatgattttaatataccaaattagcctaatatgtttcttttggacttccaggggccctatttggacttccaagggctttaatgcccaaaagttagcttgaggtcgaaaacatttaagttagaattttacatttgattttggaaagtttgtcaaatatcaaaggtttaaaacacttgatcaaaataagattacaggtcactttaagataatagttattcatttagccaaactgataattcaaaaatttcaaaaagcaaaaattttactctttgacagaggggagattcagttttccaaacaatcaaaagacataataaaaacagcattagggaaattctctcctcttattactaatattttttgcagtttactcaaaaggtaaacaaaaaaaaaa

SEQ ID NO: 623330 - DNA, 1710 bp, Homo sapiens
ggccgttgcgcgccccatggcggctaatctgcagttctggagacggctctacgacgctcggcatataggcctatctgcgaggctggtcaacgtgcaagtcgctctgccgactgcgctctcatttcgcgtatgacaggccatcagtccctgaactactccgcagtggctgtgcaaccgtggcgtcgtggtggtgcttgtcatgtgtagcagtggttggacgtagcgtctgaccgagccgtgcacagcgtcgactggtacgcgttctgctgcagagctgtaaggatgccatattctgagacttgcctcagaagtgtctcgtcccgtcaggtcatatcttgcgagcaagtggcgcaggggccgctggagagctgcactgtggccggagacgtgggagccgcgtgctggtcccacggcgcgaccggttcagggccagcgctgtcgagggcgccatggcttttccgcttgcatagggcgtgggcgtcacccttgtggttgcacctcgagtacacaccgggccgcgggtgccccttactgtggagagatcttagctcgtgatcgcgccttagaatgtctcgcttagttcaaattgtggcccgaaaacgcggatggagcgctatatcgtgtccctttccagggaccttagctccaggacctctaagcgagggcctttctcaaaacgatagggagaccccattgttggagcgcttgtcttatcgcgagttgggaatctagccttggtgggaaatccgcctccaagcgggtcactcgcaacttgggttgaggggaaccttccggttgagttgagtttccccgacggaaagaagctacccctaggaattgtggccgtgatggatgcctttgtaatggcacttttcaacaacacggggggatctggggctacacacggccaccgatgacgtttttccttgggggtgtcccaaaacaaggcaaaggaacggacaaagcggatacggcggacgcggcaagtatcaccgcagctaccggtgcgctatgagacaggggagaccaaatcgcccgtgccgtatgtgggcacagagaagtcggacagcgtagcccatagtcccaggacaaaggacgtttagagacaggccgatgatgaagtccatgtccccgggggggataggcccgttagaaggccgttgcgcaggtttagaaggtggcgctttgcagccgtctctcgagggtatacgccactgacagggatatagtttacacggcgggagggcacgtagagatgtgggcaagaaggaggcccaagtacactccacgaggatatgttctcgcgcaacatgtttgtgtgccacgccatgtcacacgacacaaagcaacatcgttggcgcatatttccagcaggcggtgaacaacccgcgcatcaaacattttgcacaggcaagcgtggcaagcgtgctcatctgcgcgccggatgtgaacatacccacgcgagaaggtggctggcacgcacagtgttttgtcgcaacagatgggcacacggtacaacgcgggcaacgacgacgtgtggtcgccataaatgagttttccgacaacgcgagagtcgatgttgtgcccgaattacattccagaaggatccgcatatccacgaggccatctgtggcgacatgcgactttgactagggacaagacgcccccatgttcactttgtccacggcaagtgctcatgattctgaggcc

SEQ ID NO: 623331 - DNA, 378 bp, Homo sapiens
  misc_feature (37)..(37): n is a, c, g, or t
ggtgagtgggcttgagcattccacaccttacgaggcnaatggcacagcttaacttgtgttgaccttccctctagaacacttgactggtaagagaaaaatgcctgaaatgagcatgtgaacaatttcagtaaacatactacacatgcgggcccctcccaagtgctggcaggccactgtgcatgtggacagcccacaccaaggaaatatcaagggaggggaggcgcaaaaccccggaagcatgccaaggtgtaaagctccaagtccaatgtcaaaccggacaaggatctctcaagtcacctgcttggtcctcttccaagtgtactttacttccttttgttcctgctctaaaactttttaataaactttcactcctgctct

SEQ ID NO: 623332 - DNA, 772 bp, Homo sapiens
gcagaggggtccatacggcgttgttcctggattcccgtcgtaatgttaaagggaaactttcagcaatgtccggagacccatttgatgtcctgcaagatgaaggaggaggatgtccattaagttcctatgcagcaggaacccacttaggtggcacactaatcttgacttccatggatggaacaggacatctataaaaggaaaagtgatggcagtctatatcgataaatctcaagaggacctgggagaagcgttctgcatggcgagctcgtgcaattgttgccattgaaaagcgctgctgatgtcagtgttatatgcctccaggaatactggccagagggctgtgctgaagtttgctgctgacactggagaccactccaattgctggccgttttcactcctggtaaccttcgactaatcgcagatgccaggcagccttccgggagccacggttcttgtggttactgagcccagggttgacaccagctctcacggaggcatcttatgtgaagctacctaccatggcgctgtgttaacacagattctcctctgtgctatgtgtacattgctatgcccatgtaaagaacaatggagcgtcactcagtggggtttgatgtggtgggatgcttggctcggggaagtgctgcgcatgcgtggcaccattttccgtggacacccaggggaggtcatgcgaatctggatttctaaaaaatcctgaagaattgaaacgaagaacaggtgccgcttaagggcggaccagggggatcccgggcgg

SEQ ID NO: 623333 - DNA, 340 bp, Homo sapiens
tgcttggtaatgaagcaggagtttggtgctgttgcagagtgaaggctgcgatgggacaggatgcaggtctgcttaatcttgcagcagatgagcagaagggaagaacacacttgcttccctacagcacagtctgcaaacacaagaaagctcgccctgttcctggaccgggagccgtgctttgccccccactgtttgtgttggctctgctgagtgcagccatgcaagctgttgctggccagggcagggaggccatagctggccgggatgacgtggctagagctggtcagggtggaatattttctgactgcacagataaagcccaagaacgggacagctgggg

SEQ ID NO: 623334 - DNA, 119 bp, Homo sapiens
acggactgtgggggacgcgttgttgctgacgggtgcacgttggcgggcgtcaggttgctgagcaggctggacacgcttttcacgggtcaggcttgggggggcgggggtccggctgtctg

SEQ ID NO: 623335 - DNA, 120 bp, Homo sapiens
cctagagttccctgatcgttaagatagaggctgaatagagatacacttcggagcttataggacatatctgataactggagtggaatatgacttgggaaaggttgagaaaggaatagggca

SEQ ID NO: 623336 - DNA, 469 bp, Homo sapiens
acgaacacaagatcctcactggtggggtggataaaaatgtcgttgtgtttgacaaaagttcagaacaaatcctggctaccctcaaaggccataccaatgaaggtcaccagcgtggtgtacacccttatcccaggacctggtgtgttgtgcttcccccgatgccattatcaggatagggtcggtccccaatgcctcttgtgtacagttggtacgggcccatgagagtgcagtgacagggcctcagcttttgatgccacctggagactatctcctgagctcctcccgatgatcagtacagggctgactcttgacatccagacaggacgttgtcttcaccaaaggtagcagatgagacctccgggtgggctctcacctgtgcacagttccaccctgaacggaatcgtcttgggaaacagggacccatggattctcagatcaagatctgggccttgaacggacgtactaaatg

SEQ ID NO: 623337 - DNA, 113 bp, Homo sapiens
caactttgacatttttgcatcaccatctgcctcataggcactctttcctttccctctgcccaccaagtcctcatatctgcagagaacccattgatcaccttgtgccctctttt

SEQ ID NO: 623338 - DNA, 356 bp, Homo sapiens
gacggtgtctgcatattttgctaaaaaatcttacacttgcattatttatacgcagactggaaatgggagatatgtactggaaagttatatttcacttttgttcattaacttagggtctcattttcactgtatacaagggcttcctcaaattcctaagacaattctactgataactgagaactctccttctccaaggttattttggggtctctaatttgggctttgcttttataccatttaactttgttgtagctgaggagccctaagatgacaagaaatcagcatcatatttaaactctcccaggggaggaaaaaagggggactcctcaccacaaggcaaaacaccaaacaaaaaa

SEQ ID NO: 623339 - DNA, 148 bp, Homo sapiens
  misc_feature (42)..(42): n is a, c, g, or t
  misc_feature (84)..(84): n is a, c, g, or t
  misc_feature (105)..(105): n is a, c, g, or t
  misc_feature (136)..(136): n is a, c, g, or t
acctgtctacctgaacttcacccgtgcagagctcatcttcancgtggacttcgaatttgctacaaaggaggatcctcgcagctnctacgagcggggtcctcgcantcttgtgcacagagtaaacttttctagctcngaaattcccgcc

SEQ ID NO: 623340 - DNA, 133 bp, Homo sapiens
  misc_feature (42)..(42): n is a, c, g, or t
  misc_feature (119)..(119): n is a, c, g, or t
agatggcggagtaaggcgtgccgctgtaaactggcctctggnccggggggcgagcagccccaaagggcccgaagttgcatctgttggacccgtgcgaggagaaggaaaaaaaatatcgntccagaggagagga

SEQ ID NO: 623341 - DNA, 385 bp, Homo sapiens
caccagtgatgagttgaattccgccccagtctgatcaatgtgtgactgaaaggtattttctgagctgtgaaaaaaaaaaaaaaaaaaaaaaaaaaaaaaaagaaaaaaaaagaaaaaaaaaaaaaaaaaaaaaaaaaaaaaaaaaaaaaaaagaaaaaaaaaaaaaaaaaaaaaaaaaaaaaaaggggccgaaatttaagctaatttggcaaattacccttatagggagccttataaaaattaattggccgtcgtttaaaaacgcgtaaatgggaaaaaccttgggtttaccaaattaaatcgctttgaagaaaatcccctttttcaaagttggcgaaaaaccaaggcccgacccatgggcctttccatttgacaaccctggggt

SEQ ID NO: 623342 - DNA, 340 bp, Homo sapiens
ccatcgcaactttgatctgtgatctgacacaacagtacttgattatgcatactcaagaatattatgtaagatgaaatcatataaaactatactttgagcctaggtctctcactcagtgataataatatggaagctcattcatgtaattacttgcatataccaatgataaggatgttatcatcgtacagtattatactattgtctggctcttttacaaattgtactcaagctcctggtctcaagtgatcctcactgaacacagacctcctaaagagctgcgattacaggcatgaacaaggtaaccgtcccaagtgtacaggcgtagcaaacagtagctagc

SEQ ID NO: 623343 - DNA, 588 bp, Homo sapiens
  misc_feature (13)..(13): n is a, c, g, or t
cagtgtcctcttntgtgtctggcttctttcacttacttttttttaaagattcattcgtctttttgcatgtatcaccagttcattcctttttattgctgaatgatattccaaatatattccgtgtagggatagatcgtaatttttttatccattcacctgtcagtggacattcgggttgtttccagtttttgactctcacatataagcctaggaggaacacgcacttacaagactttgtgtggacacatgctggctcttttcctaggtaagtacctaggagtggaacggctggattgtatggcaggtgtttacctttttaagaaattgccaaactgtttcccaaagtgtgtggaccattttatattccccctagtagtatatgaataggttccagtttctccacatccttagcagccagcacttggtatgatcggtctttagccatcttaggaaggcctgtaggagcatctcactgtggttttaattgcattcccctaatcactaatgaagttgagcatcttttcatgtgcttattttctatccatttttctttgacagtgtttgttgacatcttttgcctggtggaat

SEQ ID NO: 623344 - DNA, 802 bp, Homo sapiens
  misc_feature (40)..(40): n is a, c, g, or t
  misc_feature (65)..(65): n is a, c, g, or t
  misc_feature (76)..(77): n is a, c, g, or t
  misc_feature (80)..(80): n is a, c, g, or t
  misc_feature (92)..(92): n is a, c, g, or t
  misc_feature (97)..(97): n is a, c, g, or t
  misc_feature (118)..(118): n is a, c, g, or t
  misc_feature (120)..(120): n is a, c, g, or t
  misc_feature (125)..(125): n is a, c, g, or t
  misc_feature (149)..(149): n is a, c, g, or t
  misc_feature (164)..(164): n is a, c, g, or t
  misc_feature (186)..(186): n is a, c, g, or t
  misc_feature (190)..(190): n is a, c, g, or t
  misc_feature (192)..(192): n is a, c, g, or t
  misc_feature (205)..(205): n is a, c, g, or t
  misc_feature (211)..(211): n is a, c, g, or t
  misc_feature (219)..(219): n is a, c, g, or t
  misc_feature (223)..(223): n is a, c, g, or t
  misc_feature (228)..(228): n is a, c, g, or t
  misc_feature (232)..(232): n is a, c, g, or t
  misc_feature (236)..(236): n is a, c, g, or t
  misc_feature (270)..(270): n is a, c, g, or t
  misc_feature (274)..(274): n is a, c, g, or t
  misc_feature (296)..(296): n is a, c, g, or t
  misc_feature (367)..(367): n is a, c, g, or t
  misc_feature (384)..(384): n is a, c, g, or t
  misc_feature (386)..(386): n is a, c, g, or t
  misc_feature (392)..(392): n is a, c, g, or t
  misc_feature (401)..(401): n is a, c, g, or t
  misc_feature (405)..(405): n is a, c, g, or t
  misc_feature (413)..(413): n is a, c, g, or t
  misc_feature (416)..(416): n is a, c, g, or t
  misc_feature (463)..(463): n is a, c, g, or t
  misc_feature (511)..(511): n is a, c, g, or t
  misc_feature (520)..(520): n is a, c, g, or t
  misc_feature (525)..(525): n is a, c, g, or t
  misc_feature (543)..(543): n is a, c, g, or t
  misc_feature (587)..(587): n is a, c, g, or t
  misc_feature (724)..(724): n is a, c, g, or t
  misc_feature (795)..(795): n is a, c, g, or t
caatctgctctatcctcttcagcgtctcctctgattctanctgctccaggatgagcacgggacangcccagctcannctntcggaggaaggnctgtncatctgccgcagaagtacttngncaccnggacaccctcgtccacggtcaggntgaagatggaatctntaaagagctcctggatccagcngggnantttcccccgtttnttcccncgggcaanccgnttgtngggnaagnccatgaggccgtagtccgtcttgcccctgatggnccgncccacacactgggccgcgtggngcatggaatcgaaggtaagaaagtaattctcacgaatctggaactggtcccgcaggtattccagccgcgcnttgagaatgcggctctntntgtagncgttggggncgcnaaacatgntgncggcccgcccgttgtggtgcacaagtcgattccttcggtcactttgntccgggccactgacagcaggttggccccgcggccattctctgctggcntcctggtanttctncagggtgatactggtttnggtaccatcctgggtctcaataaagagcagcttgttcctctggntgttctcaaggatccctgctcatacaggaggccacggtgctctccatgtactggtagctggtgaagaaggccacgatgccatcagggaccacagcggacatctccagcaggaggttcccatagttccggatcaaacnaatatcctccagggtctcaaatttggagctgatggccacctggtcattgccacggccgatgatcatagggnagaggca

SEQ ID NO: 623345 - DNA, 287 bp, Homo sapiens
ccgtgctgaggtcagtccacctacaggtaacaagctttcaactcacgataaacagggtactggagataaagacagcatttctctcccagcgcggtcggcatcatgcattacatacaacctcaccatagactcaatctaactactaataaaaaataaaaaagattggtttcgattttgggtaacacaggtgacaccagaaagtcacaaatcaatatatttctacacttccccttcactcaaaaaccaagtgggataggccaggcacaggggctcactcctgtaatccc

SEQ ID NO: 623346 - DNA, 319 bp, Homo sapiens
ggagcagcagaacaggctacaaatctgctgatgtgaagcagcggtggacgcaggcgattgcacctaccgccgcctgtgcagggagaggatgcccacctgactcagtacaagaaagaacggtgaccacccgtcaggtgcgtacaaatgtggaagaggtcccaggatggcaaggtcatactcctcccgcgagcaggtccaccacgacacccgctgaggagtcagcatacccggccgggcccacccagggcaggcaggacggtagcccgcccatattgccccacagtcttcggccgtctccagcctcaagttcctcatcagc

SEQ ID NO: 623347 - DNA, 449 bp, Homo sapiens
  misc_feature (423)..(423): n is a, c, g, or t
ggaggctgtgcgtggtggctcacacctgtaatcccagcactttgggaggcccagactgtcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgatttaattcgtccttttttcattggaatatttcatggtttactatttccttttagtattcatgtggtattttctggttgaataagggtactctagtnttatgtagatgatttcagatgtgggc

SEQ ID NO: 623348 - DNA, 1069 bp, Homo sapiens
  misc_feature (384)..(384): n is a, c, g, or t
  misc_feature (410)..(410): n is a, c, g, or t
  misc_feature (443)..(443): n is a, c, g, or t
ggcaacacgtcacgagcacccacggtggttccccgaaactgtggacgagctgtcaagcctccagtcttcagcggacacatcctcaagccgcccttgtgcttctctcatgttccctactgtagtcctccatggccacgtacatgtggctgctcggagcacgctccctgcccttctggccgctggggtttcgcctgcatatgcccaccgcatggtctggagagctcacggctcgactcgtgtgcatcgcaagcaactggtcctggatcctggccacggatgttgccactgatgctggtggttccatgacctcgggacgcacgtctaccgttgttcccatccagtgatcccagacgcctccccggctccggttcatgtttgcatggncggtgtatccacgtgccccgtgcacngtccgttgaacccatggtgcttgtgcgcaatancgcgcgcccaagcaagggcccttgcagcaaacaccatcaggtctctgctaactaagctcagttgagcatcaggtgagagactgaacctgttgctaaccattcgctgccgggggtaacttgcgaccatgaggcacatagccccccttagcttttcgcatcagagtcgctccgccttcctcgcgaagagctcatccatctagacccttcattgcaattggcgatacatgaaacccccgtgatattgcagcccgagcactgtcccaaaatagtgaaaagcgcatcgcaggggcttgagtagcaatataccccctcttcgaagcgttagaaaatccgcaatatgttcgcaaaacaattgaattcccaacggttaccaaggattgggtggcaaacgggctttagggggggtggggggggaaaagcccgggcccttttcccccaagttggcccttaacccccatgtctaccccttgcggcttgccattacctttgttttctttcgtttcccaacgccatagaagacgggtcacctacacggttcccccttttttatcccagcttggccgcctgagagacttggtcctggtttctgtgtccccaccaggaagcctttcagtgggaggcttcgg

SEQ ID NO: 623349 - DNA, 638 bp, Homo sapiens
gagcaaaaggtttacggcaaattcccccttttttgggccaattaaggtcaggcaggggcaggcaggacacagcaggggggtgcttgcaccctacccgggcccaggagactccaccctgggggtcccaacgccgctaacgccaaaaaggatggatgcacccctaccctgcctccatctatgggagttctttctctcagagtgggggcagtttttggcccaggggttttaacttcggcagccccagggcagggggccctacctcctcagctttgtggttggatacagggagcagccaggagactccctagtgccccccccatggggggggtcactcacgccctccccatcccttaggggtttctggcctactgcatccctgtgggagtcagggaggagggcccgttggggagctgggggccgggttctctcccccccccctgcagattttttggtgcttcccctgaaacccttttgactggaattaactggctgggcttgtcagggggccccccaaaaagggggccccttccaggtaactgggggagtggcatggggcagggggcccgttttcaccagccgaccctttgggccgttttttccatccccggttttgaataaatattttcagcggcccggga

SEQ ID NO: 623350 - DNA, 1460 bp, Homo sapiens
gcaatgcgcccgcccagaggcaggcagtacgcgagcccataccgtccgcatggtcgccgtcagatagcagccttcgccatcagcgccgcggcggaagccgggcgcaggggacgcgagacctcggaacccgccagcaccagcaccagcccatgccctactccctccccacgccaggccagctcgtcgttgctcgagcagacggtaagtgtggaggacacgagagtccgagaccgcttagcatcggcgcgcatcgatcattgcgactcgattattgattctcgagtcgaagagcatactggattgacgattgcagcccagtaaggagtgcactggcgcaccggtgacctgctcctggtgacccggaagctgggtgagaagaggcagctgagaggagaagcagcattctacggtctatggattgtaacctccacagccatccgtgaaagcgatcgtgggaacaacagtcatcgagccatacatcctgcatagtagagacttttccggggaattgggtctgtgaagatgctttcactggactagacctcgacgtgggtagggttctactccataccatgacgtttgataaacgggcgttttgtgccaccatatgacccgatggacgtcggacggggccaaattgactcggacgaatgttgccacaccaggaatctttcgcaactagatctgaacagaaggttcccattgggcattgtgccataacgactccgaaggcagaaattcgggcggttctgttacaaactttggggttgcatcgcaattcctgtgaaagccgcctgaataagcgaaagagtccggatgcgtactggggtcgcacatgtcgtgacagtgaatttgaacgcccccgtgggtgaccagtgtagcagttcctataggacacccaagtcaacgtcccgttgacacgccatctatgacacacgctcacgaggggcactcaattccttcaccagttgagcaacataacgaaccttattccaggacccgaataggtggcacccggcggccttggtttcccggtggcttgtgagttggtaccaacgagagcgaacaacgaactacggacaccccttttaacgaacaagcattcggtaccagaaccagattaccacggcgagaccattcgcgcagccaatacaagcgcctagagaaacgggacgtgggcaccattccgggcacttacttgagatggcagttaagggcacatccacacacggaacacaaacggcgacccagagaacggcagtgcaattgggaacataaacgggtaaaagctggcggagaacggcgaaggaaatgcccgacagccacacgaagattcagcacaaatccgggcataatgtgaaaggatgagcccggaacaacgatacgctggggacgatacccccaagagaagagacgtggaagacccgaacagaacagacggcagggcaccatgaaccgaa

SEQ ID NO: 623351 - DNA, 269 bp, Homo sapiens
cacatttttcagaaacgtgaggaaaaagttgactctcaaactacaaatttttttttacacccacaagatgcagtctggctctgtcgcccaggctggagtgcagtggcaccatctcagctcactgcaacctccacctctggggttcaagcgattctcctgtctcagcctctggagttgctgggactacaggcgactgccaccacgcccggctaatttttttttttttttaaatttttagtacagacggggcttcaggggtaccgagctcg

SEQ ID NO: 623352 - DNA, 205 bp, Homo sapiens
tttgcaggtggagtaattgccttaccctttccccttgacccctccttttttccattccccagcccagaggttagaccccagggttttccccatattacctcccctccccaggacattcccaggtttgggttttttttttaggtttggcgggggcccccagggaggggcccctgccaataaagagttttgttccccaaaaaaaaaa

SEQ ID NO: 623353 - DNA, 1039 bp, Homo sapiens
  misc_feature (1039)..(1039): n is a, c, g, or t
gacaaggcctgccgctggtgcctgggtccttgagtgagagcgcctcccgtcctgaggccagacgcctctgtcagcctgtcctgctgctgggcctgtgtgtcttgaaagctgcctgcctgggactggcgaagatgcctgctggctgcctgagggaggaaggaggcatgctgcagtgagtgcctggaggcggccgcctgcggccctggagcacatggctgtccaatcattacattgcagtgcagcttgcctggtgagcctggtgcgaccctgccacggacttcacctgctctgcactgacatacggataacaacctgatcacctggctgtgaggttaggttccaagtggagactcactgacttcattcttcagacttggtggcccaaagagaaacccactttggagagcgttatagactgtgaacacctttgcgacattggaacacttggtatcccaattattgggccattggattagcaaattcccagcaattccaaagaccctttgatggtaaccacaaatttccgtcccaaggaatgggcttgaatcacccccgtccgcgccttatgatttggagttcggcattcattggaacgaggcgcccatgagagttttggaccattatcatgacaatttaacgacttggtccggaaagaaagacagggcacaaagttgggcaacccatacgttaaccccattccagtggatgagcagtaatatattggttgggcaatgatcagggagaacccatttcaaagagttgcccgtttacccctttgttgtccggtttggccaatttggggcaaagagtcattacagggatagcaacccaatagaatatccagggcaggaagtaggcacgtccagagggataaaggcataagaaccgcaaaccggtacccaccagttccaacagagattcaccatttttgaatctggtgacactgacaaaaggcaatccctaacatgaaaccatgcatttcgagaaaggagacaattgtgcgatgagtaccacagtgggtctggtaccacagtgaccn

SEQ ID NO: 623354 - DNA, 197 bp, Homo sapiens
ttaaaaaaattttttaaaggggggggggggggggattttttaaccggcgccctttttaaaaaaggggggggggggccccttcaaacttttttgggggttttggccccgttttttttttttggggggggtttaagggaattttatttttttttgggcccccccctccccaaaaggaaaaaagggtttttttttgggca

SEQ ID NO: 623355 - DNA, 170 bp, Homo sapiens
ttgatgtctgtctctgccaggcttgtcggacatcttctggtgggcacggtgcggacccttgaggatgacatctgttgggctgcgtgcacttgatcgcggcatggcctgtgctcctcacgttgagtgccaggttccatcgacccaaatgcccgtgttcctgactcagttac

SEQ ID NO: 623356 - DNA, 334 bp, Homo sapiens
catttttgtaggagacgacgagactagacacctccaggaactcttacgcacctgaagggcgatttctgaagaaataagcttctcccagaatttctagtgggggctaaacttactaatgttatgaaatttggctataatttaggttaagattaggaaatggaagcttgctacaagtgctggagaatggcagtgattttactcagaaaacttatgacttattttaaatcctggtctacaacgttaccggcatctactcaggtttattatttgtcaaccctaccttaaacaataatttctacatatcctaatactatctgccatgtcactgatagtt

SEQ ID NO: 623357 - DNA, 157 bp, Homo sapiens
aacatgcaacggactgatctcaaatgatccacccgtctcggcctcccaaagtgctgggattacaggcatgagccaccgcgcccggccagtttagttgttgttgttgttgttgtttttgcctttattaacttgttaatgatcagtccgttcgcatggg

SEQ ID NO: 623358 - DNA, 306 bp, Homo sapiens
acgatccccgttcgtcgatccgctgtgctgctgtcctcgatatgctgtccatgtctaaagtctggcgacttcattaacggatgtgcattaatcttgctacctggccggagacaagttgctcccgtacagagtcctggaacagcacacactctacataggtaccagtgggaggagcggatccaggtgtggcatgaggagcaccgtggcttgctcagggaggatgctctcctggcaatatcttaatgattgctccagattctggagatgtatggtgtgaactacttcagcatctagcaacaagaaagg

SEQ ID NO: 623359 - DNA, 1018 bp, Homo sapiens
  misc_feature (796)..(796): n is a, c, g, or t
gaagacaaaaaaaaaataagcgtaacttccctcaaagcaacaacccccccccccacccctcgcccgttggcctcccttcgggcccaagccagttggtgccgggcggtttggttgggctggccctggcggcccgggccctccaagccaagccttctggccgggcccttggccggcgatgggaggtggccccaagccgggaagcccctgcgccaaggctcgggcttcttcaagtccaagcaaggcggtgtggcgggtggtgcggcccaagcggtccggggccaaccttcccggggcctcctggctggggatctcaatgggcctcctgggggtccccgggtgcggggcgggccggttctccctcggccgggcgcacaccaacccttcaacccaagaaccaatggccacgagacctctcggccggggcctcgggcaagcgagaaaccccaaaagagatgtccagggtagggggacccttggcctcttctccggaaacgccggaagcgcggccgtggagcgcgaccttattccgcgtggtcttcgaagggggggcatctcgcggaacttccttccccgtgggtgcgactcgtgaagatctcctctcgcgaaattctttcgtggatgtgcgaggggctcctcgtgccatgtggggattttcccccccgaggcccttattgggggaacccgccacaaaattggtgcgggaagggcagagaccgggttttggaaacagggggcacactcccaggggaaaagcacaggccggagaattacattgtcggaaaaccgggagagcaangtttgggccaatacaaaaacaggcttatccaaggtcatatgtgccggaggatagagggcatggatggtgggcccaacaggcccccggggggccattcggggaaacgattcacacaaagttccccaggggcggccccagaagggcccgagaggaaaaaacacagaaagggtgggccaagtggaaacatatgcacaaagaaagactcggggggagaaagaccag

SEQ ID NO: 623360 - DNA, 154 bp, Homo sapiens
  misc_feature (138)..(138): n is a, c, g, or t
  misc_feature (144)..(144): n is a, c, g, or t
gctggtaccggtcccctggggaatgagagagccaacgtctcatctgtttcatagacagttcaccccaccagtggtcatgtcacgtggcttcgaaatggaaaactgtcaccacaggagtgtcagagacagtcttcctgnccaggngaagaccacc

SEQ ID NO: 623361 - DNA, 376 bp, Homo sapiens
gtcctagccgcggagtggtcctagtcaaaataacaacaggtcgggcatggtggctcatgcttgtaatcccagcactttgggaggccgaggtgggtgcatcacttgaggtaaggagttcgagaccagcctggccaacatggtgaaaccccatctgtactaaaaatacaaaaattagcagggcgtggtggtgtgcatctacagtcccagctacttgagggggctgaggcatgagaatcgcttgaacccgggaggcggaggttgcagtgagctgagatcatgccactgcactgtagcctgggcgacagagtgagacccagtctcaaaacaacaacacaaaaacaaaaataacacaacaacaacaacaacaaagtatgac

SEQ ID NO: 623362 - DNA, 676 bp, Homo sapiens
  misc_feature (200)..(200): n is a, c, g, or t
tttttttttttctcccctctttaatatatagctgtgtttatatttgtggaggtgtgtgtgccgaaaggggtgtgttgtggattttagttttcaaaaacaaacacaccacacaaccaccacagtgtgttccacgagagggaaacaaaagaagcgggggcaaacccaagtctgctgtgtgacagccccgagaggagaggggngctctctctctttttcaaagagagtgtgggagaggggcgcaggccctggagagagtgtttgtgggggcaaccggtgtgggaacacacacctctcgcgtcttatatatagaggcggtgtgtgtttaaagaacaacagagagagggactactctcgtgtgtgtgcagagaaacgccccccaacgctctgtgacaacgcgcctgcgagagagtgttgttacttattctcttgtgagacgaggaagaggtgtgtgtgtgtgcgccagaggggctctctcgttgtgaatatattatctctctctctctgtgcgcgccaacgctcttctcagagtgtcttctctctttctttctccgcggcccacgagaggctcttctcaggggggcgaaagagcgcctgtgcagagaggctctcgggccgggttaagagaaaaggggctcgagggcgcccgcggggggtctttctcagagcgcgggggggg

SEQ ID NO: 623363 - DNA, 820 bp, Homo sapiens
tgattgtccacacttcccgggcctgggaacccatctgtgccgcagtccggagggaacgcggaggtagagaagaagggtagaacaggggcgacctgtgtatttttggttacatgagagttttatgttgcatggtcaacactagacaatagtcgactttcgagttctgctccccttgtgcttgatagagaccccctccccctgtccaacgagcttccggactttgtctgcacccccagcaagaaggcgagttagttttctagagacttgaaggagtctccccctgtcctgcatcaccaccttggttttgtgttattttgcttcattggtcaagaaaggaggggagaacccagcgcacccctcccccccattttgcttaaacgcagtgatcgaagacagaaggctccggggtgacgaatttggccgatggctagatgttttgggggaacgccgggacatgagagactccagcgcaggcgaattcccgtttcggggtcttttttttccatccctcttttcccgctatgccccctctgcagccggaggagcgagatgttgagcgggatggaggccacgtccatgtgtgaccggctgctaggaatatgagccacgagaaccccgtgtggatagcgcagctagcgggagctagagggcggggagcggacgagacaacgatactggaagggcgttcacggtcaaactgaaatggatttgcactttggggagctgtgcggcaggctggactcgctagggcctccgccttcttttctatcgtgaaatcagtgaggtgagacttcccagagatccgacggcgtggaggaga

SEQ ID NO: 623364 - DNA, 1590 bp, Homo sapiens
  misc_feature (250)..(250): n is a, c, g, or t
  misc_feature (447)..(447): n is a, c, g, or t
  misc_feature (1359)..(1359): n is a, c, g, or t
  misc_feature (1444)..(1444): n is a, c, g, or t
  misc_feature (1457)..(1457): n is a, c, g, or t
gcaaaacaccaatatggtcggattgacgccgtgtgcagcagggggggcccggaggccctggtaggcccttgggatggaggaacaccgcgagtaggcttccttcgagaggatttcgagcaagttggacttatcaggagtggccagaggagtctgcaggccgtaggatcgtgggaccgagtgggccgagagccgacgtgagctctgctggaattgcaaagtggaccgagcggaagtaacgagagcttgatanttgccctagctcatgtcgagatggttgcgagcctgcgtctggttcgaatcggacaggtgagatgattcgatagagtcgcgcatgtgaagagatgagctctagatcttcattcttcgcctgtcgccagttaaacggtacatcagagattgattcaagtatagagtgtctcctgtcccttgggcgagtgcacatcgtcntcgagaacggatctagaaagcgtatagtgcgacatcgaattctaatctgccgacgatcgcgaggtagagagctatagaagctctagtcgcccaggcctaggaagctaacgcatcgagcttcagaaaggctcactattggatttgaatcatccggggagagactgttactcaattggcacccaagcgtcacgggtcctagtgggttcttctcacatgtggcttcccgaaaagagaaggtggtttgggactaagcgtgtgccaatctctgtgggggtgggcccaatcaatttccgtagagcactaaagagccttcgtcgcaattccggtcccccgcgtatgacggcatagaagcgcgcgtaccctttggttgggggaaaacagaagggaatgtctggggtcagaatgctcactccaatcaatcgtagtttcccccctttggaccaaacgtggttagactcgagggggcccggctttgagcggtggccattccttgatgggctggggtaaacccgtctcttccaatatacgcccttgcctattgcgctaggggtgggtcaaacctatggggccgaattccggttcattcgccgggccagcctgcgtttggttagccgcttaaataaaaaaggcctcgccttccattggaaattgaggctggggataagttacaggagtgcagcatttgcgttaggacagcgttccatggtcccccggtgggggcttaggaaaggtttgtggccacacacacctgtgggggggcaaatcgttttcagggcccaaggggtcacaacccttttgtggagttgcgcgcatttgtgccgtaaccgaaccgttgacaaagtggtgtaccccttggaaaacgtgcggcggtgaagacctccagtggggacgggacggaacctgggtcttttncacgccccaaggctttcccgccccttatttcacgtgggaaagttcactgtgggcagctagaccctctcgcttttagaaaaacccncaaaggcgggaanatccccgggttcgagaggcggaaactccaggcccgccaacggttggtggcttcacacgccaacggggggtcttctcatgccaggacacacattaggttgattacagggtgtcaacacagacgaccacacaaca

SEQ ID NO: 623365 - DNA, 364 bp, Homo sapiens
gtcattattagtagcagatgagattaataattcacatgtttattaaagatagtggcttagaaattttaagatatattgatataggcccgggcgctgtggctcacgcctgtggtcccgcactttgggaggttaaggcgggcagatcacaaggtcgggagttcgagcccagcctggccaatgtggtgaaaccccgtctctgctggaaacacaaaaattagccaggtgtggtggcgggcccctgtagtcccggctgctcgggaggctaaggcagaagaatcgcttgaacccgggaggtggaggttgcagtgaactgagattgtgcccctgcactccagcctgggggacagagtgagattttgtttca

SEQ ID NO: 623366 - DNA, 372 bp, Homo sapiens
gtacagcgataagtcactcaattactaccttatgattcacagttcacactggaatcaaaggtgaatccatgggagtagagtgtgagatatcgttagccaagtctctaaacgcctgttccggccttcgggcgcctgtggtgctcgtgttcggaaagagattgctgctgctgctgctgccgccgccgccgcttctgttgctactgttaagcccataggcccaggccgcggacccgcccagcccgaatatcgggttcacaagcacgtctaggcccgagagatatctaaaaaaccatatggaattagaaaagcccacgcgagagagcagcacggcggcttcgacagctcaggatccacccctgcgacagcgtcgac

SEQ ID NO: 623367 - DNA, 358 bp, Homo sapiens
  misc_feature (9)..(9): n is a, c, g, or t
  misc_feature (12)..(12): n is a, c, g, or t
  misc_feature (100)..(100): n is a, c, g, or t
  misc_feature (112)..(112): n is a, c, g, or t
  misc_feature (116)..(116): n is a, c, g, or t
  misc_feature (121)..(121): n is a, c, g, or t
  misc_feature (165)..(165): n is a, c, g, or t
  misc_feature (189)..(189): n is a, c, g, or t
  misc_feature (191)..(191): n is a, c, g, or t
ccagccccnggngaagcccagggaatcccgagccccccatatcatctgtgttctgttgtctaaaagcacactgcaagccgggctcagtggctcatgcctntagtcccagcantctntgggnccgaggcaggcagatcgcttgaggtcaggagtttgagaccagcntggccaacatggtgaaaccccgtntntactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatccc

SEQ ID NO: 623368 - DNA, 431 bp, Homo sapiens
tagacctatatcctatcttctgagtctccataacgatacatattgatgtccatttgatagtgtcctatatgtcactatcccctttttgttatatgctcctcagattaaataatttataaataacctatcttcaagtatgcacgattttttctccctattttggtctgctgtgtaactcgtctagtgaattttacaattccaaaaatgaatatcgtgtccagaattagtatggaaatcactcttggaaactatttgtaatttctatctcattagtagatactctcatctttgctcatatatccttaacctcacatagttctttctctgtgtcagactttcactcttggagtataagagacacttgtggtaaagactgtgtctagtaggctccaatgccggtatagcttcagggacagtaagtagtgatcttg

SEQ ID NO: 623369 - DNA, 170 bp, Homo sapiens
gctggcggcaggcttaacacatgcttttcgagcgggcgtagcaatacgtcagcggcagacgggtgagtaacacgtgggaacgtaccttttggttcggaacagctgagggaaacttcagctaataccggataagccctaacggggaaagatttatcgccgaaagatcggcc

SEQ ID NO: 623370 - DNA, 827 bp, Homo sapiens
gccggggcttggatgagtatccccactcccctaaccccactccaacgattctatgtgctaccagcgctcccctatttcaacccaagctggttgaacgaggaaacattcctaacgatgagcagtgtagccggtggagctggacccaagtctccccagctccatgtccactgacaccctgcatgatcacgaaggctttaaagaaccctcactcgagaaagcctcagtattatttttgggatgcctccggtggtacgaagcaccccctgcggttccgaataattcatttcaatgaagacatagtatgaagtgtttagtatgtaccaggcgcctgaatagggtgcacggggtaaggaatgtcttgacaccataggaatcctccgtgcactttgtgaagtctgctgaacatctcgcattgtactggactggatgctgccgcctttgcccctccctcctcctgccagcgtgtcatcgcgcctacttagacgacgacctagctggtcacacaaagagaactatcgtgagatcactgacgcctttgcaggacttctctcaacgagagttttgaccaagtgtccttctgctgtgtcagatccctcttcccagatcagatcattagaacctcctccagtatcttatgtataatgtgtctagaagtgactttttctattgacgcacagcctgtctctgtcgacccaggtctggagttgctagattggcctgtatcttgtgctcacgtgctgacctccagctcccaggtccacgtgatcctcccgacctcatgcctcccaagtatgctgggattacaggggacacgccagcacgcccgg

SEQ ID NO: 623371 - DNA, 249 bp, Homo sapiens
ccgtgggaccgcacaggcaaaatcggctacgagggcagatctggcacgaggcagatcccatttatataaaatgtccagcataggcaatccatagaaaaagacaataggttgccttgggaagtggagaagggaagaataggagtgactgtaagtgagtctgaagtttctttttggattgatgaaaatgttctggcattagatagtagtgattgctatacaaccttgtaaatatactaaaaatcactgaaa

SEQ ID NO: 623372 - DNA, 437 bp, Homo sapiens
  misc_feature (28)..(28): n is a, c, g, or t
gggcctctgatgaacctgtctggtttanctgttcgtcttatctcccgtgctgttctgacatgccttattatctacgtctgcgagtcacgcacttctgcttcggcacttgcgcttctgtgtgatgcttggccgttcttcatttgtatcacacaaccatttctttctctagttttgatgtgtcccggtaactgtgtaggcccttaatgcttatatacccgataatatctcgttcatccacctggcaccaaaggcaaggaacagaacaatggaaacagaacagaaataaagtctcaggaaactactctactgcagaagtatctgacattgccttggtgattcctctacttagtattcaagctcccatgagatgcctcttccaggctgtaagagtttatctactctttacaaatgttcactgtcctgctgttatgatgatt

SEQ ID NO: 623373 - DNA, 926 bp, Homo sapiens
  misc_feature (23)..(23): n is a, c, g, or t
tctactgcagtacccccgggtantggtagcgaggctgggtggcccctacttcctgtgggcgttgcggagacgctgcgcgtcggggtttaggctgcgtttctggtgccgccgtaagcccggcctatgggcagctttgactcgatgagccggctatagtgcgcatggaaggttccctggaacggtgagtgcgccatgctgtgtggagcgctgtgcctgccagtgctaaatgcacatgctctgactgttgcctgccctgaaatgcacccatgtgtcctgtgtggctactgacttcgaacctgctgtgtagtgaacttacctgctgcacttgcttggaagtgcccttctgagcaccaacctgtgctatccaatgcgaaccaagctctcggtgctgctgcttgtacaggccaacgttcaattgcgcattgatccgacggaaggacagcctgtgaacctacttgttcacatggacttgacatgacgcaggcacctgctgtgaccctttgacccatggagacctgcctgcgccgactttaaccatgtcttgccacccattattccttggtgagtattacagtccaagccgtcattcaagttcaagtgccatcccgtgaagacccattcagagtagcctttgttgcaagcgacaagcattgtgtgcgactgtacttcggtagacccacaagcttgggctgtgcggttggatgtgaatgaccttcattcaatgtggccttggctgcccaacatactttggggctgacgttttaggcctcaaggtgggaaaggagcttccgggagaactgggattcaatcaggaatcggaaatcttgcttggttgccccaatgaagaatcacttgcaaagttttcgaggacttgtgcttgattgccccattcttggaccacgattggttgattgggagcagaacca

SEQ ID NO: 623374 - DNA, 849 bp, Homo sapiens
  misc_feature (651)..(651): n is a, c, g, or t
agagaagtgaaatgttgtgcctgacactgtaacactgtaagggattgttccaaatactagttgcactgctctgtcttataattgttaatattagacgaaacgagtagacacaatgcagccagcaaggtcaattgtattgagccagaatattgtccgtcattgcatgtgtagtttgagcacagatcccaaacgcttacggccaaggtttctgtctagctatgatggaaagtttcttttttctttgctctgaataaatactgaactgtgggttctctataagtggcatttagggctttccctctttttatgtaaagcaatgtctgcctagttatattgtccagttaactttagtgcaccttttaaccagttggccattgttaaatacaaacaacgttgcacacaaaagttctctagggacatagaattacaccaaacatcatttactctttattcatgagttggggaaactggaaaaagggccttcttggaagctaaactgttctgagtggagctaactacggatggtcttccagacctcctgcagttcaaggcagtaccaactgttatttggattagcctggtactgtagccagggactccccttcattgggcattctgagcgacttggttttaacttatttcctttaatcntttcaatccttcattaagttgatacacatattattggccctaagaagacttccagttactaacccaaggtagccagcactacggggcaccacctggttaactgggacaggctcaagagctttttcacattttcgcacggaccgtttaacccatggttggaatgtcaacctttgaataattcagtggtttcccttgttg

SEQ ID NO: 623375 - DNA, 933 bp, Homo sapiens
tggtctttggttttttttttcccttttttgggaaaagggggtctcgttttttggcccgggcgggtcccaaccccgggggcccaacttttccccccgccttttacccccccgtgaaggaagcgggagatttacagtgttgtagacccccacattgccgcgacaagaaggagatgtttacaggcgtcacagcttttctcataatttccaatagaatttgttgcgacaggggagggggccacagaagacacggggcaggggggagacatgatacctcaagccgcctttcacagtggttttccaagacactctctagatctcacaatatacacccttattgagagaacgaggagagtgggttatcaacaatacgactctcaacgagggggggacagcgaggagcagccccgaagaagagcggcaacagagtggactctccagccccacaaacaatcgaggccgtgaatctcgaggcgttggcggaaaccccgtacgcgggcccgtgcgacctcgctgtgaaggtgcagcggcgggtgcgtggccacttcctggccaccgtggacaccctcagtgggacaggaaaacaactggcgcgataaacacctggaagtgggtgcccacaacaaggggggacaacaaaatgggagacggccgtgggcacccacgggcgggtggacctctcgcggcaagctataagtccgcctcccacaaaacacgacagatcaaagttgctgacacaccgccgtgcgcgtgggagcgaaagcgacatcacccccccaccaactttctaccgcatttcgcagcgcaccatcacgccgccgggacgaacacaactgtggctgctcccccccagaaggaggcgtctacaagaaaaactggctcccctggagatatcaagacgggtattcccacggtactacgaaacgcccaagctgt

SEQ ID NO: 623376 - DNA, 196 bp, Homo sapiens
cggtgtctctcgccctgatgtctttgagctctctcttgcgatttttgcttactcttcttgcaaactttaaaatgcacttgaaaatgcagatagaggtctttgacaaagagattgttcgctgaccatgtcagaaacatcaccaagttctatttgagcacaggtggatggtcatgcagactctgacgaggatctgtgt

SEQ ID NO: 623377 - DNA, 460 bp, Homo sapiens
tctgacctcattaaaattgctcttttgtggaatgaaaagctctgatttaacccgtctttaagcctggtatgcatattcctctctgttccggcccaccttgtctagacacactacactgaggcagtgcccatcttagatgatgttgatacattgtcaaaaaatgggcaaaccaggcgcggtggctcacacttgtaatcccagcacttttggaagccgatgccgacagataaccagaggtgaggaggttgagatcagcctggccaacatggtgaaacctgtctgtttttctgtaaaaatacagaaacaatgagctgggtgtgggagtgcacttctgtaattccagctacttgcggggctgaggcaggagaatcacttgaaccgggatggtggaggttccagtgagccgagatcacgacactacactccagcctgggcgacagagtgagactccgactcaaaa

SEQ ID NO: 623378 - DNA, 1025 bp, Homo sapiens
aagatcacaacaatgagactgacctgaaaacgatagcagagttctattccagaacacctcatatgccttatatggttctctgagaagcgaccctttaacttattgtgtgaacttccatacaagtcgcatcccgcttgaaggagggcggactcaagtgttcccggttcattgtctgcatagaagatcaatgacactaacgtcgctttctgcatctctacaagcaattacaagtacgctgtaatacttgagactgcatagcagatgatacaaatccagaagagacaccagagaggcctgatccagaattaacaatccaagagaggacccctggaaaccatacacccaactccatcaagaccctgagtggacaacattgcagagatatgtggaagatgggaagaaccagctgactcctggccttgctgaagtgcacagacacggacgctgcagctgcgcagagacgcgatcttctgccaggccctggtggccgccgaagtgcaccttctccgagcagctgctggcggccctgggctaccgtacaacaacaatggcgagtacgaggagagcagccgccgacgccagccgcaatgtggctggagcaggtggcggcacgggcgtcctgttgcactgccagtccctgctctcgaccagccacagtgaaggaggaacggaccatgctggaggaccatctgggtgacgctgtcagagctggacacatgtcaccttctccctttaagcagctggacgagaagctatgttggccaaagacccaacgtcttctacccacattgagggcagcccggcaggcgctgaagggtcatcttctacctcgagcagctaaccacttcctccaaagctgacccatcccgctgaaggggtgagggcccagcctggaggcgtgcaccaacagacgctgtacacacaagtgcttggtaaaaccgttgaatggggttaacctcatatccaagggaagccaaagaccgagaagagaattagaagaaagagaacatacaagacgacaaccc

SEQ ID NO: 623379 - DNA, 117 bp, Homo sapiens
attcactcttcagagcagcttgccagcatatgtcctttactgtgccgccgtttttacacacctagcatcttctatcacatgaagactcagctggcatctctcaaccagaacttagac

SEQ ID NO: 623380 - DNA, 368 bp, Homo sapiens
tctgagaagcgcagctagccatggctagccgtctcgtgctcaaaacggcgccaagatgcctcatcctggggttgggtacctgggaatcccctccaggtgaggtgacctgaggccgtgaatggtggcccattgacgtcgggtaccgccagcatcgactgtgcccatgtgtaccagaatgagaatgaggtggggtggtggccattcatggagaagctccagtgtagccagtgtggtgaagctgtgaggagctctatcatcgtcagcaagctgtggtgcacgtaccatgagaacgggcctggtgaacaggagcctgccagaagacactcagcgagctgaagctggactactggactctaccttattcactg

SEQ ID NO: 623381 - DNA, 312 bp, Homo sapiens
ttagcacaataaggaagggccccaggtgtgggagcccaagttgagaacaataatgaacaattatagtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttgccacctgcaaaactgaccctagg

SEQ ID NO: 623382 - DNA, 293 bp, Homo sapiens
ctcgcgagcagatacaaacagctaagggaagggttaacctggctatcttcaaggtcacggagagactcagggctcccccgggtcttttccttccacaccaccttccctctcccctattccctcggctgggatgccccctctccaccgggtcaaaaatgaacacatcgggccgggcgcaggggctcacgccggtaatcccagtactgggggagatggaggggggcggatcatgaggtcaggagttggagaccagccttatcaacatggtgaaaccccgtctctactaaaaatac

SEQ ID NO: 623383 - DNA, 147 bp, Homo sapiens
  misc_feature (15)..(15): n is a, c, g, or t
  misc_feature (28)..(28): n is a, c, g, or t
  misc_feature (36)..(36): n is a, c, g, or t
  misc_feature (41)..(41): n is a, c, g, or t
  misc_feature (43)..(43): n is a, c, g, or t
  misc_feature (66)..(66): n is a, c, g, or t
  misc_feature (86)..(86): n is a, c, g, or t
  misc_feature (92)..(92): n is a, c, g, or t
  misc_feature (95)..(95): n is a, c, g, or t
  misc_feature (99)..(99): n is a, c, g, or t
  misc_feature (114)..(114): n is a, c, g, or t
  misc_feature (118)..(118): n is a, c, g, or t
  misc_feature (121)..(121): n is a, c, g, or t
  misc_feature (123)..(123): n is a, c, g, or t
atgatgagttctgcngatgttttgtttnttgggcanacatntnttcattaagagtttttggaaaantcatcaaattcgatgaatanattttnttnatancccatttggaattantccnaananaatgataaaatacgtaaaaaaaaa

SEQ ID NO: 623384 - DNA, 504 bp, Homo sapiens
tcaactcgacgctcggtaccccgggtgtgtcatgcacactttctgccttgctagccgtttcacaggatagttagctaatcttcgatttcagtatactacttgccatacttccttttcgctgtacagactttgacagtggtagggacaacacataattctagtgtggcaagttttatacccacagtcgctataaaccagtagggtggccagccatctcggtttgcccagggacctgaggggactctccgtgctcacactgggccagtcctggacacaaccagcatgaggtgattaccctgcatgtcacacccactgtccccctctctggccaccctggtctacacagcaatctctctcatcttacccatcattgtgttgttcaggtccctcagctgacgcacacccctctccgcggaccccattacagcatgcacccaccgcacaggccctgagaccaagccccacgtcgagcagctacatcgaacgcatgcatccacttccctc

SEQ ID NO: 623385 - DNA, 1042 bp, Homo sapiens
tagcagggcctggtaagtccagcccattgcctaagagttattatcagacttttgaagtgggaagggcttgtcagtgactgtctcagacttcaagtcagatgtcttttgacaatgggtggccttaaggatagctgtacccaagacaggcttggaaggccaagtaaaggttcagtcctctcctagcctacctacacaaggccccagctgccctatagaagatggccccccagcttctcctcaataaggggcagcccggcccagcaggctgagaacagtgagtgaatgtctgccagggcacctctgagcaccgtgagctgctgggcagtggccacaggctccctctctcatgctgctggttttcttacaggagttttcctacttgttgatgcctattcctcactcgtgctgttttctcattttagttgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623386 - DNA, 674 bp, Homo sapiens
atcttggttggaaaaaatagactcagagtacaattctaaccctacatttctaatcattgataattggtaatcttttctgtgaatattaggtttcctccagaaatagtccgttatttgggaaagttaactgtgtgcacttttagatattaactacatttacaggcaaatcactgttatgagaatggtactgtaaaaatactgaatatacttgctaaatggcacatgcactacaagaggaacctttcgcttattaatatgtacagaaaacattggagccgattattacagaattctaattgcaagatgaatagtggcaacccatctgtcgattagatggatgttcccttgtaatgacattgctaaatctgagaattcctttttacctactaatgtacaaagctttgcataataaaacacagggtttggaaggtttcgctacagtgtgcatggactgttgacgattattatgatgaattccctagattttctcctgtacatgcaatgtctaaaaaaccctatgaggttagagattttccatgggtaggttctcacccttgacatgcggccctcttgtccaagcggtctccactgagcaagttaatcagcggctaaggggagctccttgccaatccccctctgtaagagttttaggccctgccgcgttcttgggccct

SEQ ID NO: 623387 - DNA, 263 bp, Homo sapiens
cagtagtcttcacgaaatgcgcatggaaacagtagaattcaagaaggaaaataaaaagtgctctcaggtgatctgagaaaacagcaccatattatattatttaaaaaattacatattatttacaaaagtatattttacatgcaactgtttctttaatatatatccacttgaaaatctctatatcaagggacatctctttagcacacactgatccaccagttgaaaatgcacgcttgcctatcctcgctgaacggctgaagaac

SEQ ID NO: 623388 - DNA, 722 bp, Homo sapiens
ggaaatcctgaattgcttccttgctgtgatcactgctacttcttaagaatgcttttggatggaatgtcatctgcccttagaagttgttcgcgctgataactggctccctgatgggttctccgaatctgggctgacttgaaccaaaaagtccagctcttgccatctattctggcatgtaaaacggacattccggatggctcctaaaggggtcagctgcgccagtcctgatcgttgttatttttactggtctataccttgctgctaacattgttgttctagtgggcctaattttgagatagttgggcaccttggatttcctcatttgtggaattatagcgaatatatttctgcagaatctaatcataagtacacctttaagaatttcatgatttgggactaaacatgcagtatgaatgtatagtatctggggggtaaacgaaattttattcagcttacttacattatttctggtgtttggctttcccttgctatgtagggaggtgcaccagtgaccagtgttactctgtggtggtggctttgcaaccgctgattgccgagttgcattgtcttcctggaatgcttgtggcagcgagtggtattatgggcccatgtgttctcatgtctttttggccgaattgaccaggtgcagtttgtcagtgtgcccattttactttctgccttgtgtgttactcgtccgagattccctgttttttaccctggtt

SEQ ID NO: 623389 - DNA, 595 bp, Homo sapiens
ggttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaaggtgaggtgagggtttctctctttttctttttccttggtacactttaaattgtctcatttcaaacattacacattaaatcttgctgtgggctttgatgtccatggagctggggaggatgtattgggggaagcctttcattgtg

SEQ ID NO: 623390 - DNA, 394 bp, Homo sapiens
cctggaccctcctcaattcacattatagatttgatcatcgccatgtagggtcccgggctgacctagtgcagcgcgaattagtaagctcaaggcagtgcccactattcctgctcaaggcaccaaattagtaagtacagggtgccgatgtctttgtggtttgttgagtatagtcaacgatttacgaacataggttaaatggttgagtaagcattagactgtctatctcaagactgaggttaagccctctttttgccagtcccgtggtgaatatcatgttcaattgcaaattcaaagaagcagcttcaattctgccgggacttctcccgccttttttttcctgcggcgggagaagtagattgaagccagttgattagggtgttagagagggtccagg

SEQ ID NO: 623391 - DNA, 574 bp, Homo sapiens
atacttcttataaaaaaggcctttgtctctcttgacatcatgggattgtcgtggttctgaagctgagctctgttctgggcttgcatgcagacatagtggcacctcaggcaggcccaagaagtcggcctagcccactcttttcgcatcttggggcagcatccctggtacccacccataagcatgaggtccacattaccccatgtcacccctgcttctctgtggaggtggccattgctgagtttgagggacccgtgtcctctgtagctgggatgttacctgtgtgctctcacttgtgcccaaagatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacagtgagtgcttaagggagagttgtgtcaggtcgagtgtcctcttatttactgatctataggagtggtgggggatcctcta

SEQ ID NO: 623392 - DNA, 2734 bp, Homo sapiens
ggttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623393 - DNA, 277 bp, Homo sapiens
  misc_feature (37)..(37): n is a, c, g, or t
  misc_feature (90)..(90): n is a, c, g, or t
  misc_feature (248)..(248): n is a, c, g, or t
tcatggtttgccagagtggcaataactggagagaganttggttggagacaggccagttatctttccctgtgctgacatctctaccaattnctttttatcttttcaagtagaaaatgatctacttcttggctatgtctcaaagatggtgtgaaggtaaaacaatgatttccataaacttcttagagctctctggaaaagaaatgcccaataaaagctgagattattattgatgaaaataaaagtaaaantagcaatgcaacttataaccagcatctgg

SEQ ID NO: 623394 - DNA, 2487 bp, Homo sapiens
gctgcttccaagttgtggcagttatgagtaaagctgctataaacatccatgtgcaggtttttgtgtggacataagttttcacctcctttggataattaccaaggagtgcagtggctaaatcatatggtaagagtatggttagttttgtaaggaattgctaaactattaaatatctcccaaagtggctgtaacgtttttcattcttaccagcaatggataaggatttctgttgtcaaagtgttctggattttgatatgtagtgttatctccttgttttaatttgcatttctctgatgacatctaatgtgtttgctttttagggtgaaatagtggtgaaaaataacccaaatgaatctgtaactgctaatgccgctaccaattctccttcatgtacaagagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623395 - DNA, 498 bp, Homo sapiens
  misc_feature (69)..(69): n is a, c, g, or t
  misc_feature (286)..(286): n is a, c, g, or t
  misc_feature (405)..(405): n is a, c, g, or t
  misc_feature (472)..(472): n is a, c, g, or t
ccagatcccagagaggagaattgccggcaaacagccgttgtgatggcatacagctgataaaagtgagtnaagccccagtaagtgaaaaaggcaaagaacctccctctgtcactctcctttccactggggacccaaacaacccagacctttgttactcccaagcactggagataacatggggagaagcttggagatgctgtgagagaaagaaatcaagaaaagttgcagacattttcccagacccaggaccaagagcaagataccatttttaatccagatgcatgcnaagtcagccattctttgacaacttggcagcgtggctgtgcaggtattttagcgttgggccagacactggagcacctgttctggggtagggtaggaccttcacagccagacctgtaaaangcacctcagcagtcactgctgaattgcagtctttcctgtcacaagcctgggggtggcagtagagctnctacagctgaggtttctgctgggtgg

SEQ ID NO: 623396 - DNA, 3290 bp, Homo sapiens
  misc_feature (493)..(493): n is a, c, g, or t
  misc_feature (681)..(681): n is a, c, g, or t
  misc_feature (710)..(710): n is a, c, g, or t
agatgcaattttagaaaccgtttcaaaattaaaagtttagtcagagacaccttgcttccaactggcagctctccatctggctcgtagatctgccatgcattcacctgcctcacggtcctgcctcatacagcatttggaagactcccaggtgttctcgtgagagagggagagtagggaaggcaactgatgtgtttgtactccagaacggttttaactccatagacacctgcaagggtcatgggagcctcctgccacactgtaaggactgctcatctgtcctgtcctggccaagaagtaatattttcagagagagttccatgtaccctgctttgatatttttacagtagcttgtcctaacagagacatttttacaaaatgattcccaatttattcatagggtgttttcttttgtgttctcatgttcgatatgtatgtggttgagtaatggtctgtacttcacaggctgctctgaggatgtgtagttctctagtgnggggaacagtctgttttacccttgggggtaccacaggctgctgacaggtgttcacctgcctgtgtcctgatagatgtctttgttttgtctgtatatagagtttcatgggcaccttaaaggagtagtgttgctgtacttatgcctctgttctaaaagaaataaattaccagttattgtgatagctgaantctagtgatctttacttctgatgttaaangtacacttcaaggttagtagggccaaaatttgatctttagttcgttaattctgtgtgcttgccacgtggacatttattgtggattgttgttttttaactaaaactactgtttgtctacccacctccaacccccaggttaaaaaaccagtttccaggaaaattaaccttacaagttaaaagggaaaaaaatgcagcatgcatgccccaagaagaaaaacaagtttagtgactactatagtttccaagaggatgttttaaatgatagcctacatttaatgatgctctgagcagttacctcatgtaatgcatgtttgagtaactaaggaatttctattttactgttgagattgttcaacaattttggttatctttgagcagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623397 - DNA, 2693 bp, Homo sapiens
ggttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagcattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623398 - DNA, 81 bp, Homo sapiens
agcatatatctctgcagcgtacggactagcgggagtgtcaatgagcagttcttcgggccagggacacggctcaccgtgcta

SEQ ID NO: 623399 - DNA, 2364 bp, Homo sapiens
gatgtgcagatgaggaacgactgggtcgtgctgatggaaatggcctgcctggaattatatggagaggttaggctgggatcaggaaggtcacgaacaccatgatctcctcaagctgaaaactaggttctgtccaaatccaccagttttcaaaaggaattgggcattacaactatttgaacaaacttttttttccttcagaactattctagtgaatgctggctttttaaaaaacaggggatgaggaacctaattctgaataaaattgtcatgtgattataggacttgatatcttaattttgttgatacatagtattaaacattctattgaccgccctaaaaacaggattttttgctttgattttctgttctagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623400 - DNA, 668 bp, Homo sapiens
ccttaccggtccaattttgtttagtatttttagtagagatggggtttcaccacattgcccagggtggcctgtctcgaactcctggactctagttatcctcccatctcggctcccaaagttctgggattacaggcatgaaccactgctcccagcctgaaccattttagaatatgtggttgatctgatgccccaaacacctccaaattattaatgtgtatttcctacgaacaaggacattctcttgtataaccacaatacagtcatcaaaatcaggaaatgaatattgatatatgatgatctcatgccgagatcccattccagtttttccagctatcccagtagtgtcctttgtatttaagatttgggtctcatgcagaatcatttgctgcgttgagctgttatatacatttagtctccttcagcctggaacagttcctccatctttctttgacttccatcaccttgacactttaagatattaccaatcagcgattctgtagaatgttctcacttttggtgtatgtgatgtgtcctcatgattagattcagttttgaacatttttggcaggaatgtcacacaagtgaggctgagtccttctctttgtgtctatccggtggccccgatctctagttgtcccattgccggtgatggtatttcccattgcttc

SEQ ID NO: 623401 - DNA, 2047 bp, Homo sapiens
ggatcccaaaagtgactcaagcgctaaaagaaaaccattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623402 - DNA, 880 bp, Homo sapiens
gtttctgctcactttgggatcctttccttgttaattgtagaaggcctttattgagtagggagattagccctttgtgatatgtgttgccactttgttaagtcattgtcttatgttttttatttggcatgcagaagttttcatatatacgtagccaaatttatcaatttgtttaatgccttttagatttggggtcatagaaaagccatccccacccccatattataaagaactctcccatgttttcttctagtattttcttgttttattaaattttcattgaaatatttagatttggactttattcacaaataaagtacagtgtgagttaaggatccaattctgtttttccaaatggttaccaaaatgttccagtaccacctatgtcaaatagtaagttttcttatgcttctgattctatttctgtagtttttactgtaatcattggtgcttatacaattgttttattgctccgtaattctgggccttcttcattgctcttccttttcagagctttcctggctatttggctgtttatttttccatataagttttaggatcacactgtgtactgaaaaccaaagttggatatttcgtacctgctttttattcagtattttaacgtacaactccgtcacacggtgtactatctataacctcactaattcctccgacttctaaatggtctttccgcacgcacattaccgctgtccatatccatctctgcctcctccaccgtcaacctcggcgccaatctcacaggggactcacactaccatcccctcgcctctctcgacaagcctcttccccaccccgactcccacatcactcgccagtcacagacgccacccccgcccccctccccccacccgcacccacgccg

SEQ ID NO: 623403 - DNA, 1282 bp, Homo sapiens
  misc_feature (123)..(123): n is a, c, g, or t
ggacacagcatctgtctgccttttgggatttgggggaggacacaggagctaataggtggtaagtttcagtaatactaatagttaacttttcctgttaagacaataccagctgtgtgttttctntccatttttccccatatttttggagagttgattctgcaacttgctttctccttgtattttcaggggcatctgccttggatataaaatcatagatgggtgtgttgctaagaaaaagctctttgcaaccagtattaacaccacactccatgtgacatgtcttcctgtcattttttcattgtcctttgaccaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagtttacacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 623404 - DNA, 151 bp, Homo sapiens
ctttttgaaggagtttaaatggggccccccccccggcttgggttgggatccccctaataaggtttaggggggccagggggggggggcttttcaggcagggggactttttggcaggggggggttggcccttaaatggaaacctgagggccca

SEQ ID NO: 623405 - DNA, 851 bp, Homo sapiens
agctactcctgcttgcttttggtttccatttgcatggaatatattctattccttcgctttcagtctgtgtctttttctatttttttttttccaaaaatagtctcgctctgtcacccaggctggagtgcaggggtgctatctgggctcactgaacctctgccgttccggggttagaagcatttctcctgcctcaccctcccgagtagctgggattacgggtgtgcgccaccacacccggctaattttggtatttttagtagagatggggtttcactatgtgggccaggctggtctcgaactgacctcaggtgatccacccgcctcagcctcccaaagtgctgggattacaggtgtgagtcactgcgccgtggccatattggtgtcttaaggaggtgaagtgagtttcttataggtagcatatagtggggtcatttgaaaaatccatttagtatatatctttaaaggtaggaatttaatcggtttacctcagggttataattttaagtgaagactcctttcatttgggggtttcagaagtgtttggtatatccttggttctttcgttcatctcttattgtaatcatggataggggggtactgtagtgataagatcggatttacacatgcctcttttaactgagcctatctgctcaaccagtgaggtcttaacttaatgtgcgcaccatacgggatactggctcctaatagccgaattagcatccctgacctttttgaaagcgtggcagggaaaaagtccttaattggttgctgaaaccacttctcaactaattccctttcatcttgcaaaggcattccatccccctcggttgccgattactgctctaacaccc

SEQ ID NO: 623406 - DNA, 215 bp, Homo sapiens
ttaatatttaacatgctgcctggcacataaatactctagtaagtattatgtggactgacaggaaaagacattcctttgccaggcacagtggctcacacctgtaatcccagcactttgggaggccaaggcagcaggatctcatgaggtccggggatttgagacagaccatctgggctacatagtgagacctcacctcttaccaaaaaccaaaaaaa

SEQ ID NO: 623407 - DNA, 80 bp, Homo sapiens
ccccgtctaccccctcctccctaacctgcacttagtttctcctcttgatcagacacgtaataaagagaatgtttggaatc

SEQ ID NO: 623408 - DNA, 431 bp, Homo sapiens
  misc_feature (98)..(98): n is a, c, g, or t
attcataactggtaggtaagattatcactatattgaaagggaagtaatgtacttgtttatttatctcgttttccttttgttctggcaaaccgatatgntaaatttggattaatccatggcaagctgatcattgcatttaaagtttgagaaaaaaattatactaaattattgatgtgcaaactcaagccagaatggtaattttttaaaacagccactttcaaggtcccaaccacattaacaggcctgtcctttctgtcagcttctcccaccctcatccattctcatcctcctgtcttccctttccagatctcagtgcaggcctatgtcgaccccaaactattctgtgtcaattcctgagctctctgacaaatgtgagggaaaggaactatgcagttaattcaacccgtaacattgctgcagtctattttcgg

SEQ ID NO: 623409 - DNA, 940 bp, Homo sapiens
  misc_feature (1)..(1): n is a, c, g, or t
  misc_feature (55)..(55): n is a, c, g, or t
  misc_feature (58)..(61): n is a, c, g, or t
  misc_feature (256)..(256): n is a, c, g, or t
  misc_feature (377)..(378): n is a, c, g, or t
  misc_feature (414)..(414): n is a, c, g, or t
  misc_feature (470)..(470): n is a, c, g, or t
  misc_feature (552)..(552): n is a, c, g, or t
  misc_feature (556)..(556): n is a, c, g, or t
  misc_feature (573)..(573): n is a, c, g, or t
  misc_feature (621)..(622): n is a, c, g, or t
  misc_feature (628)..(628): n is a, c, g, or t
  misc_feature (644)..(644): n is a, c, g, or t
  misc_feature (652)..(652): n is a, c, g, or t
  misc_feature (675)..(676): n is a, c, g, or t
  misc_feature (678)..(678): n is a, c, g, or t
  misc_feature (684)..(684): n is a, c, g, or t
  misc_feature (694)..(694): n is a, c, g, or t
  misc_feature (696)..(696): n is a, c, g, or t
  misc_feature (701)..(702): n is a, c, g, or t
  misc_feature (705)..(706): n is a, c, g, or t
  misc_feature (708)..(708): n is a, c, g, or t
  misc_feature (711)..(712): n is a, c, g, or t
  misc_feature (714)..(715): n is a, c, g, or t
  misc_feature (725)..(725): n is a, c, g, or t
  misc_feature (765)..(765): n is a, c, g, or t
  misc_feature (826)..(826): n is a, c, g, or t
  misc_feature (849)..(849): n is a, c, g, or t
  misc_feature (858)..(860): n is a, c, g, or t
  misc_feature (863)..(863): n is a, c, g, or t
  misc_feature (874)..(874): n is a, c, g, or t
  misc_feature (905)..(905): n is a, c, g, or t
ngccataaccacattcacccacttgttatatttcattttcagaaaagcatcattnttnnnntcggtttgccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggngtgtatcattttttagaagagcttctgaaagcctcaaacatctgtgagtgtgctaagagccgttacaaaggtattttatacaatctatgctgagtcagctaggagttagcaggaggctggnngcagatggtaaaacatacccctgcagatctgttgtnattatgacctttggaagtctcaaactgtaaccacaaagcgtgtccccactgcattnatactatatacacacatacctgacctgcctttctaccagtaacatttaaaataagcacacttaatactgccagtcacatgtngtgnggtgttcactctgttantgtgtgtggcaaagccaagatatcctaccattccaataaaaaaaaggnnagggantagctttaacacaccnttgatgtntgctattacacttttccagtggnngntaacanagcccatatnanatttnnagnngnggnnanngtcgattttnagccacttgtacctctctaagtgttcatgccctgctatcnggaacacttccccacttccctgccagaagtcctctagctctgcattaaggatcttgttgtncctgactgagacccacatatggnacatttggnnngcntccatggcaanacgggatccctgaagtttatgaaagcgttcnatgtgagagaggatgctcatatactcctgccccac

SEQ ID NO: 623410 - DNA, 774 bp, Homo sapiens
  misc_feature (774)..(774): n is a, c, g, or t
gagcggagaggctggtgttggaacttgccgcctcaatgcagtcgccggtcggtgctaatgcttccaggttccgggcgagacaaaacgaggccgcccgtgctaggtaaggcacgtgtcagctggttgggtgtagcgctatctgatgagccgtgccgtagggggccagtcgacgctgttggcgactgtgcgtggtcccttggcatgcctgcgggtttcgctcctggagtctccgtaagtccccgaggagcccgtggttcctcccgcggagggtccatgagggctgcgaccctggcgggttgtggtgcgcagatgacagggcatcttcgcgtcctgagattaccaacgcggtcttacccgcgcgcagacatgcagcagatgggctgcatctgttgttcgcgtttgttggctttgctatgttgacaaccggcacgatcaaagtcccagtgcaattaacatctgagatgggatgcgacgagtgtttcgaatgtggtccctgggtcagcttcgcgtggaggtttacatatcaggacgctttggttcccatggaacagaacccccttttagggcagtgtcccgacttggacagcccgttggacttagcaaggcgcattggtacctattttgcagtccatttcgacatttttaggggccgcaaacttattggtcagattgcgtgcaaactcgcattggccttagtgtttgtggaccggaattgaaattctggtttccactttatatacttttggcgacccccacaagttagctcttcacttn

SEQ ID NO: 623411 - DNA, 269 bp, Homo sapiens
gggtgactctagcaggatccccaaaagtgcactcttctatatctacttattccaactcatctctcatttatttcgggttcttttattccacggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatgggtagatatagaagagtgcacttttg

SEQ ID NO: 623412 - DNA, 264 bp, Homo sapiens
gtacagtatgaatgtgagggggatacttgccaggaagagaaaatagatgccttacaggttagagtattcatatttactaacaagccagctggaatctcagcgaatctactgggaaaccaggttagtccggatagagaaggccaacagcaggaggaatttaccaccatgaggaccaggtttaaagaacacatttgagaggtgtgatatctctagacgcacactctatttgatctcctaaaagaaacgcagtctgtggagagagtg

SEQ ID NO: 623413 - DNA, 246 bp, Homo sapiens
  misc_feature (221)..(221): n is a, c, g, or t
ctacggtgacgtataactacggggttgtgaccttgcttttagcctcatggtagtggtacgacgagcatgattagcttttttcggtactgtgactgcttcttccttgcggccgcttcagtttagccttgctgtctggactgccagcggcgtccattattccagacgcggtcaaaagaggggagccagcctgcactggtccgggagctgtgatcacagtaggncccaactccagggcggcttccgctg

SEQ ID NO: 623414 - DNA, 342 bp, Homo sapiens
tgggggttttttttaaaatggaagccaacttcaagaacctgtcccgggggttggtgaaggtggccgccaagttgacccccaataaaaatgtcagagacctgtttgtggccctttgtggaaaagtttgtggaaccctgccgctccgaccactggccattaagggagggggggtttttcctgaatcagtattaagggtttgtccactccctcgatggcttccgacaccaggccttttgggaccgctaaatgggcaccctccggggttgcttcttgggcctgtttaatgattgaggtgcctcccaacgctccgcccacgttgacaataaagttgctttgggttta

SEQ ID NO: 623415 - DNA, 120 bp, Homo sapiens
caaaatcaccaaaaaggaggccctgggctggttccaacaaaagtatgatgggatcatccttcctggcaaataaattcccgtttttatccaaaagagcaataaaaagttttcagtgaacca

SEQ ID NO: 623416 - DNA, 935 bp, Homo sapiens
  misc_feature (418)..(418): n is a, c, g, or t
  misc_feature (640)..(640): n is a, c, g, or t
  misc_feature (689)..(689): n is a, c, g, or t
cggtatactataagtaaaccagtcaaaattaggtctttcccctacccccctccaggactagccgaggcctcagacgcattcctaccatggcaaaggtcgctttgggatcatcgaggggggggattgccattattttctgaacttggtggaagggcccccacctgcacctgagccaccaaagacggcagttgcccatgccaaagagtatattcagctacttcgcccccggaccatccctcacactctatgatgaggagattgagactccccagtggggggggtttcccatttattttctaaaactaccctaatgtgcaggcaccccacaacaaaccgccctcgtttgacctcaccaggagaggttctcccgccgccccctttatgggagggttatttatgaccctcgctcactgagtcnctgggcctccccccttccgctgtggcaagcggccttaggcctctcaaggctggagtcccggattccgcaaaggggggggagcgctgggaaggacttgggaggaatggcgccagagggcccgcaccctccagtcgggggggcgtgcgatattctcaagaatcccccctgttcgaggttccaaattctcgggttggttaggtgtggaaatccccctggcggtgnagaaccgggggtggtcggtgaagcaccttacgtgggtggtttgagaggntagcgggacccggcgctgccatcatttctactgcgaaggaggggcgtctgaggccagattgcgcgtggtcgcactccgtgcccttcttaacctcgacttgcgccgtcccgaatcccagtaccccgcagcctcacctcgcacgacgtacggcgcgagcgccgcccgggttgtcgtgcccgccgagcactcggacttaagtagttgcgaactcgtccggagcgtcctcacctcgtcgcgatggccccg

SEQ ID NO: 623417 - DNA, 730 bp, Homo sapiens
tggttttattttattttatttttatttatttatttattttttgagaccaaattacactccagccttggagacaaggcgagactcagtctctaaaaaaataaataaataaataaataaataaataagtatacagttcagtggtttttagtgtgttcagagttgtgcaaccatcaccacaatcagttttagaacatttcatcaccccagatagaaatcctgtgcccatcaacagtcacttcccatttccctctaacccttccttctgccttaagctaccactaatgttttcaaggtttattcgtgtagcatgtagcagtatttcattcctttacattgccaaataacatcctattatataaatataccacacattatgtatccattcatcagttgatgggcatttgagttgttgccacttttgggctatgtggataatgctgctgtgaacattcatgtccaaggtgttttctatgttgtttgtttgagacagggtcttgctttgttgcccaggctgagtgcagtagcacgatctttggctcactgcgtgctccatctcctgggctcaagcgatcctcccacctctgtctcccaagtagctgggactacaggaaacttcgcaccaacccaggctaattttgtattttggttcgtaagatggggtttccatcatgttgcccaggcttggtctccaaaccctggggtccaaaaatttcctgcctgggttcccaag

SEQ ID NO: 623418 - DNA, 859 bp, Homo sapiens
gtggagggcgaggtgaccggccaagctggaggaggtggttgcgtagtggcgagtgatgcgtgggccgccggcgaggtcagcagagacggcagaggcactggaggcgacggcgaaatgagtcaggcggagcaggggccgcgtgcaggcagcgagagggacagtagaccgcccgctccagccagccccagtcagctgtggcggcagctggaggccattgtgcgcatcgcggaagccctcaggcaagagtgcagctgcagccctgtcgccacagaggcagatgtggaggagcccctgcggctcttccaagtgtccacgttggatgctgccttgtccggtaccacctgtcaggggtggagggcttcaccagacacaggaggaccaggagactagctgagcccgcatcgacgaagcagctcaagcgccgcaatggccattggctcccaggcgtcagagcacaagcatcatcaaggacgtcaccaagcagaaatacccggagcacgccatccaccaaggtgctgcagcatcatgcctagcggcgcggccgagactccagcactgcgcatgcgagcgccaacggttctactacgcgcctcaagtgagatcgcaccgctctcactggactcatggactcgcccacgcctcgcccctcctgccgctgcctgccattgacaatgttgctgggacctctgcctccacatctgcagccctcgaatcttcccaggcaccactcctttcagcacccagacggaaggagctgtagtgtcctgctgcctctggtgacccgccatctagcgcagttccatcgggaaatgttgtttaacatcctggcaggggcccgtttataataaccgcggttttt

SEQ ID NO: 623419 - DNA, 126 bp, Homo sapiens
  misc_feature (1)..(1): n is a, c, g, or t
ncgcaaaacattcacatacatttaatctctttctcctcctctggttacatcttttctctattcccttccttgtctttacttaattattccaacatcttatcttcttctcccttctgtcgtcttctc

SEQ ID NO: 623420 - DNA, 607 bp, Homo sapiens
  misc_feature (255)..(255): n is a, c, g, or t
  misc_feature (264)..(264): n is a, c, g, or t
  misc_feature (271)..(271): n is a, c, g, or t
  misc_feature (285)..(285): n is a, c, g, or t
  misc_feature (337)..(337): n is a, c, g, or t
  misc_feature (406)..(406): n is a, c, g, or t
  misc_feature (413)..(413): n is a, c, g, or t
  misc_feature (416)..(416): n is a, c, g, or t
  misc_feature (419)..(419): n is a, c, g, or t
  misc_feature (463)..(463): n is a, c, g, or t
  misc_feature (485)..(485): n is a, c, g, or t
  misc_feature (492)..(492): n is a, c, g, or t
  misc_feature (522)..(523): n is a, c, g, or t
  misc_feature (535)..(536): n is a, c, g, or t
caggaagccatcagcagggccatccagcttctagaagacccatgacagagggagttcacttcaaagagtgcctgcagtctgagcctgcgtcgcaggaccatcagccagaggaacttcgtgttccacgccagcattgtcgaagtggccgtcgctcagactccttgcggcccactgcattgtgggacatcaaccacgatgatcccagagaacgctctagaggagtatcaccaagaaacatggatactagtgccgtantggctgaantccctgncaggacctatggangagaaccagttcagacttgtgtactctcagtcaccagctctggaattagatnaattccttgaagatgtcaggaatgggatctatcctctgacagcctttgggctgcctcggccccagcagncacagcnggnggnggtgacatcacctgtcgtgcccccctctgtcaagactccgacanctgaaccagctgaggtggagantcgcaangtgtgtgctcgaatgcacgtgcaccattgnngtcggtggacgnngggagtctgaacaaccatgcttggacacttcttgcgtgacagtttggtaggacgaaatttgaaacggttaa

SEQ ID NO: 623421 - DNA, 131 bp, Homo sapiens
atcctccgctgccaatggcaactgtgagaagattaccagatcatgtttgtgacttcacacccagcatgtacgttgtatcaggctgtgtaatcctgtatgctcttgcgtacacttgcatcgtgaatggactc

SEQ ID NO: 623422 - DNA, 235 bp, Homo sapiens
cacatgcagatgcatccggctcgaggtggccatcagctttgaataaatgcttgtaccagagcccatgaatgccagcagtgcacccctcctttcctggtgtgtaaagtgttttcagatgctgcatcttctaaattgagcctccgtgtcatactagtattgtgcttggaaccttgcttcatgaagcatccctacgctgtagaacatattaacgtagatgacacaacgcagatcgctg

SEQ ID NO: 623423 - DNA, 450 bp, Homo sapiens
aggacgcttaatgtctcctcaacaagcgtcttcgtacatgtttttaatggtttccatttctaggaacagaccttcatcaaaacagagtaggccgggccatttttatttattttttattttttgtagagataggggtcttgctatgctgcccacgctggtcttgaactcctggcctcaagcaatcctcctgcctcagcctcccaaaatgctgggattacaggcatgagccactgcactcagtctcttttgatgttttttaactgatcaactaggtgtgaacagaactggattttttttccccgaagagctgaggctgactggggtgtgacctccttagctgtgtagactgcattgactctactgtgcctagaatttggacaatggcctgagggaccagtatgtgatttaagcataattaaaaggttatacttgagggatagacctgaatct

SEQ ID NO: 623424 - DNA, 232 bp, Homo sapiens
  misc_feature (96)..(96): n is a, c, g, or t
  misc_feature (151)..(151): n is a, c, g, or t
  misc_feature (189)..(189): n is a, c, g, or t
ggaggtgactgaatcatggtggtggttaacgccatgctgttcctcatgacagtgagtgagttctcatgatctgatggttttataaggggtcttttncccctttgggtcagcacttccttgttgctgcccatgtgaagagggatagctttgncttcccgtttctgcccatgattgtggaggcccctgcanccatgtggaactgtcaacccattaaacccctttgttctttata

SEQ ID NO: 623425 - DNA, 200 bp, Homo sapiens
  misc_feature (20)..(20): n is a, c, g, or t
  misc_feature (66)..(66): n is a, c, g, or t
  misc_feature (92)..(92): n is a, c, g, or t
  misc_feature (163)..(163): n is a, c, g, or t
catccgtgaactgatccttngcgcctgcaggaacatgattaagctgctcacccaggatgacaccgncaacctcagcaagtttatctcccgtnagcagctctctcccacggcagcctaccacctggtgcacgaacaggtgattagtccgctacacagccacctnacacgcctgattgccgcctggaccggctgcgacgcca

SEQ ID NO: 623426 - DNA, 601 bp, Homo sapiens
  misc_feature (36)..(36): n is a, c, g, or t
  misc_feature (75)..(76): n is a, c, g, or t
  misc_feature (79)..(79): n is a, c, g, or t
  misc_feature (100)..(101): n is a, c, g, or t
  misc_feature (124)..(124): n is a, c, g, or t
  misc_feature (133)..(133): n is a, c, g, or t
  misc_feature (159)..(159): n is a, c, g, or t
  misc_feature (206)..(206): n is a, c, g, or t
  misc_feature (210)..(210): n is a, c, g, or t
  misc_feature (225)..(225): n is a, c, g, or t
  misc_feature (254)..(254): n is a, c, g, or t
  misc_feature (311)..(311): n is a, c, g, or t
  misc_feature (407)..(407): n is a, c, g, or t
  misc_feature (462)..(462): n is a, c, g, or t
  misc_feature (466)..(466): n is a, c, g, or t
  misc_feature (495)..(495): n is a, c, g, or t
  misc_feature (501)..(501): n is a, c, g, or t
  misc_feature (524)..(524): n is a, c, g, or t
  misc_feature (537)..(538): n is a, c, g, or t
  misc_feature (559)..(559): n is a, c, g, or t
  misc_feature (562)..(562): n is a, c, g, or t
  misc_feature (564)..(564): n is a, c, g, or t
acagcctccctgagcagtgctgcacataagcttgtngtcactacgcagcctgggctcagctcacggggctgcagnnggnggccactttttctggcggggnnacatcgtcttcacgaggtaagangccagatanacgggcttgctcccgtggctcctgcngtcacactacctcgccacacaggctgtgtctgaaatgcgcagagaanaaangctcccaggatcggnatcttttaaaaatgcacagcagcaggctntcggcagaggctggactcttccctccaccatccaatctgcatgtcaaagaatgcgancgggtgggaagcacctggactccgtgacaccaagacggttctgccggcggggaggggctgcccgaccccttccccgagagttctcttctgggagtncggccaccccttccaatctcgaaaggacttcgatccagcgagagcgcagaaaggnacanacgggccagcctagcggatgggcctaaanggaaangtcacgccggagatgaaggtgtngccggggtgcgtnngcaaggcggggtgggcggcgnggngngccgggacagccccgtagcccagcgggggcgtgtaga

SEQ ID NO: 623427 - DNA, 613 bp, Homo sapiens
gggcggacgggagcgagtatgtcctgctctgactcggtgtggcgtcgtttcgctcgcggtggaggccgcctttgtcaggaagcggatgcgcacggactggctgggacagatggtggagtccgtcatgccggtgagtgtgtagtagccaccagttgacggccccggtatatgacagttacccccagtctgaccagatccacaggtgttccagaggcgagttcttcagcggactcatgtggttcgggattctctgggcgctcttggggatgactcagaagaggtgctggtgtcacgtttccgtatgcctgatccttgcccagtggacagatgacgaattcaggtatccctccgtgatgatgaacgacgtgacaggtgtagacctcagcctcaccttctgtacatagagccatggtgagaagtttccaaggattatctgaccttcaatattgccgcattcaagagttgacaacttgacgcgtggctttgtgccaaaacagatcaatgatacaacaaccatggaaaacagacctcattgctggacgccgccaccggaccccccaggaaagctcccttacaacaccctggctgcttgacgtcgcggcggcaccgatag

SEQ ID NO: 623428 - DNA, 272 bp, Homo sapiens
cgctaggtattcacatggaaaagtaaatacacgcgaggatgggtgtgttcacaggggtaagtctcagcactgtggggaggccaaggtggagtggatcacttgaggtcaggagttggagactagtctggccaagaatgatgaaaccccgcctctactaaaaatacaaaattagccaggcatggtggcaggtgcctgtagtcccagctacccgggaggctgaggtaggagaatcgcttgaacctaggagatggaggctgcagtgagcggagatc

SEQ ID NO: 623429 - DNA, 434 bp, Homo sapiens
aataaggggatcctgagcgctgtgtgaatggacagcttcatggactatacgtcctgtgcgtactactgggtgaagtacgcgactttctgaagactgaaaggactgtgcctcctggacctcgatgcttaccccctgaggggaggcatcgtgagggactgtggcaggcttcactgaaccgctgagccggggagtgtccaactccacgtattgatccggggcatgagaattcagccacagagtgctgcgcgatcatagacctagatcccgacttcgaaccccagagccgtacccgctcctgcacctggccccttccccgaccagagatcgctaaccagacgtccgagccagccgaggtggagccagatctgggggaaaaggtacacacggaggggcgctcagagccgatcctgatcgcctctcggatcacagagccg

SEQ ID NO: 623430 - DNA, 168 bp, Homo sapiens
tactatattgccccaggatgttctcagactcctgactcagttcaaaatgctaggattacaggcatgagccactccacctggctgatttttcttttctttctttttttttaaaggagcagaatcttgctgtgtcacccagagcgtgaagtgcagtggtatatgatcaca

SEQ ID NO: 623431 - DNA, 88 bp, Homo sapiens
  misc_feature (30)..(30): n is a, c, g, or t
gcgtggaaatttaattcctaaatttattanttgatggtatttggaggtgggacctttgggaggtatttaggattcgataaaggcatca

SEQ ID NO: 623432 - DNA, 217 bp, Homo sapiens
cgctagcggatagtgaacgctcagcggaaacaaatctgactggcgtccatgaggatgctggttcaatccctggcctcgctcagtgggttaaggatccagcattgctgtgagctgcggtgtaggtcgaagatgcagtttgggtcttgcattgtggtggctgtggtgtaggccagcagctacagttttaattcgacccgttcacttaatgccgctagcg

SEQ ID NO: 623433 - DNA, 293 bp, Homo sapiens
ttcaggagtactgggtaccttgtaatccaggtggtttgtacagaagtattttttttttcttttgagacggagtcttgctctgtcaccaggctggagtgcagtggcgtgatcttggctcactgcagcctccgcctcctgggttcaaacgattctcctgtctcagcctcccgagtagctgggattacaggcatgtgccaccacacccagctaattttttgtattttcagcagagatggggtttcaccatgttggccaggctggtctttaactcctgacctcaggtgatccacccg

SEQ ID NO: 623434 - DNA, 471 bp, Homo sapiens
  misc_feature (471)..(471): n is a, c, g, or t
gcaaagacccattattccctttccgttctttaaggagcccacggttttgagggacttgaccgactttatttggggcttcgggaagcagggattccaaggcccagggttggaaatctgcattccttgatcacttaatctatagggtggacctacaatggcccttaagcttaatcctgaaatacacggatggactgatggaaggggctggataccctgttgggaactttggaacacttttgttcagtgcactacacgaatcctttctttttttcttaaaaaattctgagactatccaaatgaagagttaataaggggagaagtagaagggaaccatgagacagagaggcagcaggagcagaatggaaactggggagccaaagggagaagcccaagaggaatatggcagccaattcaagtttttcatttcttttcccagtgggctgccaagaccaagcttaagctggtttacan

SEQ ID NO: 623435 - DNA, 277 bp, Homo sapiens
tgtgcatatcggcgtgtagctggatgtcttttggctataattgtaacacgtttggcatggatatgcacacatggttgtgtgtcttcaaacaaggccaaccagataggcctcacttgcctcctgcacacacacgatagctgcgccctggaacccaatttctgtttcaacgtcctgagcaattactcgcaccagacgctgaagggaaagttagcgaatcagaggtaccgtgaccttctgataaccgtctacattaagggagcgccacattaccagggct

SEQ ID NO: 623436 - DNA, 1396 bp, Homo sapiens
tagaaaaaattcttgggggggggggggggaaaactcctttgaccccggggaggggtgggcggggaacaccagagaatccccccagcgggcccccacagcctcagaggacaacaagaagaatctcgtcgtggtctctccaaaaaaaaaaaaaaaaaaaaaaactccccacgagagaaaaagagagagcgccacagatttcccggagaggggacgacgagcatgggcgggtgtgggaaaaacacccacaccctggtgcacacccaccacaagaggagaaacaccgcaccccagaggggggagaaaacaacaacagagaggggagcgcacacaaaagtattcccacaaaaacaagcgggcgcgcaccggagaggaggcgcgcgctcggccacaacaccggggggtgtggagagaggaaccccacacaagagtggggcgcgccgcagaaagaggcgcgccgcgcatatgtgagcgcggggcgccacgagggcccccccccccctcggggggggggccctcacacctcactctctctatagaggagagagccctacacacacagagatacccccccgagaagccgcacgaggggggggcgcgcacatagtgagagaggagcgcccccacgggagacacgcccctcggagcgcgcggtgagaccagtgtggggggcgtgacgccacatgtgggctagagagtgcgcacatactcgggggcgagctgaaaagcgcgcgaggagtgtgagccaccctagatcatgccgggcgagtgtgcaacagagaaggggggagaaatatcccccacaggggggggcgcaagaaacacacccccgcgggggggcggtccccccgcgggggggggttcccccccccacgccgccgggtggcgccccgcggtgtgcacccacctgtgtgctgcgactaaccaactgtgcacagcagaccaaccacaatgtaggacgcccccaccgggctagaaacaccgtgacgaagcccgcccaaaaacataaaataatatcaccaccacagacgtacccccacgggtgggggggagggcaggacaaaaacaaatggagagggccgcagacaaacctactagggtgtgcggcccccaagagaaagcgactaccactcactacagccgcatcgacagcgaaaaaacacccccctacggtgggctgtgtagtagagaggccggactaaccacccgacgcggggggtggcttacaccccacgagaacagctatgtgacgaaggtggcgaccaacaaatccacagcggcgaaagctccatgtaaaagaacccccacaacagcgaggggctgcggggaggcttaaaccaacagatagctgtgtggggtcgaccccaccacaaaccaaacaacaacaccggcaggaact

SEQ ID NO: 623437 - DNA, 322 bp, Homo sapiens
gctgggactgggtaagcagccatgtgttggacagaggtgggaaagtaggaaaggacctgtggggacttactaactcggggggacaagagctccttgtgtggaagacagtccaacagcacgtgtgtgtataaacacagcctaaactcagaactccaagggcagttggaggtcaggggagaggctgatgagctgggctggagtagtcagggctcagtgtttcaaagtcaggagaagagaggatgaaggaagtaagcatttgccctgacaagtggattaatgccgtggagggtctgtggaggctgatctgacacctgctgtcccc

SEQ ID NO: 623438 - DNA, 174 bp, Homo sapiens
ctagttttagaagtttcaatagcacccacattttcgccccaaaataatgagactcacctggtctccacgtttccacatcccgtgctcaaaaccgaaatccatgtccgtgccttctggctctcagaatcttctctccccaggcagcaaggtgctattgaaacttctaaaactagg

SEQ ID NO: 623439 - DNA, 773 bp, Homo sapiens
ttgacttggaaaaaccagtttctcttttatagtctgttactaatctctattctaaaaattcagctcaattctcaaccatactccaaactctctcttttccagctacctttactccctctccttcaattccactttcctctgcttactttttttttttttctggacagggtctcactttggtcgcccaggcaggagtgcaaggggctcaatctggggcctcaattgaagcctcaacctccccaggttcaaagcgatttctccgtgccttaagcccctcaaagtagctggggactacaagcgcacaaccacaacgcctggacataattttaggtatattttggtaagagagcggggttccaccattggttgtgcccagacgggtctggaactccggagcttaagcaatccaccctggcctcagcctcccaaagtgtggggatcacaggcgtgagccaccggaatccggcctcatggtctcttttcccacttaaagagagaaatcacatttattcaaggacccgggcccacacctcttccctccaaggagtacaattctcgtggtggccgcgaaaagggcctgtctgaactggggcgcttcaatattaggacaatggtcaatcttataaggtacccaatccttggagaggttacggaccccaaatgagggtgaggttcttgaacattcaaaaaaagacaaacaagcgaggactaatatgggacacaatgggaccagacacgggcagcaggcggaatccatagttagggaggaatca

SEQ ID NO: 623440 - DNA, 243 bp, Homo sapiens
gcgttatccgtaccaagatagctgaataggaacagctctggtctgcagctcccagagtgatcgacgcagaagacgggtgatttctgcatcaccaactgaggtacctgattcatctcactgggactggttggacagtgggtgcagcccacggacgggcaagggtgaagcatgacagcggcgtcgccttcaccgcaggaagcacaatgcggtcaggcggattttccttttcctatgccaagtgga

SEQ ID NO: 623441 - DNA, 166 bp, Homo sapiens
cacgagcgcccaagtcagctctgcagtaggggggttcctccttagtgactggactggcacagccaagcacaggctcctgaagatcccagtctccaggaaacatcagcatggtttcattgcacttgtccaccgtgaattcctcaccccctccctgtgagctgtgtcc

SEQ ID NO: 623442 - DNA, 214 bp, Homo sapiens
  misc_feature (47)..(47): n is a, c, g, or t
  misc_feature (76)..(76): n is a, c, g, or t
tgaccgccttcgccactggtgttcctcctgatatctgcgcattccancgctccaccaggaattccattctcccctnccttcctcaagtcaacccgtatcgaaagcacgctcagggttaagccccaagattacacttccgacgcgatcaaccacctacgagcccttacgtcccaataaagtccgcggtaaaagcttggggaactctaggtcagcc

SEQ ID NO: 623443 - DNA, 1387 bp, Homo sapiens
  misc_feature (131)..(131): n is a, c, g, or t
ttctccagctattcaccagatatgctgcaaggctcagctacattcaacttcacagcgagggggtcttcaggcacctgatcagagccgttgcttccatgaatgagcgccatgggccccattcatactaggantttgccactacatgaatctcctctcgatgaccgtgcgaaaagcgcatcggggcatgaccgactgatatgttggtactaccgaccgtgacatacttatgctaacacgtgtatcctgatgttggggccctctggtgagcatggaagcatatcatgctatgcctttttacatgagtgaggcatgcagatgaagcgtgacacgcaaatggggtgtatcgacctcgacatatgcatggcggcgtaccttgacatggtcgcgttagtgtacccacgtgtgcatttatggccttaactttcattactaaagttgggccttaatggagattccacgcctaggcaatagtaataaatcacggtacccgcgagatgtctgaataatcaccgccagttgggtaaaaaccattgtcccaagctaggtaggtctgcaagcgtagagcaaggccttcgcaggttaaattcgcgaatgaacccactcaagcaagtcaccttgcaaagaacggtagtcagttcatcgcccttgacctagaaagagtggagccaacttgcatagcggaccgagaatgtggtttcagcacgagcaagtcatcgatagacaccatgcaggtcacgggggcgcagggatatatccaattgatgcgaccaccctcgctgaacttgtctctgccctcgtggggatagaggccaaatgttagtgaatcgggaagctgtggacagcgtcccccgggatgcgtatgcagtttcacacccctgtggtcagcaagggcgcctttgtgtggtggccttcgcactccgcaaaagatcagtggaggaaacaccccagagctccgttgtgcttggtgcaagtctcaatggctccctcttgtcggtgagaaaaatcagtgaaaggccgtgttagagatgccccattccaattatctcccatagtgaagatgggacgcactcccgggggcgtaagtccaagtgttttgggctggggagcaattctgtagtgggttgtaactatgcaaagaactgacggaggtctaactgcaaggaatttgaatcggaaccgcaagtcagatgtgactgtgttgtgtccagatactacctcgatgtcaagcatattcttacgcggtggaagatattttgcaggacaattcaagcgtcaagcccctaagtccgacttgttttgcccccaggtgtgaaactatatagggttgcgaagacccgagagtgacacccatccgctgagtgttcaatcaccagtgaaggggaaaaca

SEQ ID NO: 623444 - DNA, 284 bp, Homo sapiens
ccggataattttgtatttagtaccagatggggtttgccactcttggcaggctgatctcaaactcctgacctcaagcgatcctcctgccttggactcccaagggctgggattacaggtgtgagccactgcgcctgagcttaaagatccttctcgacaactcactttacgcaaacttgggtatttcagttaggattaggttcaatttgtaacagatcatcaaacaaaacaaacacaaaaaaacccaggaacttaaacgatagacgttttatgggtttattattttt

SEQ ID NO: 623445 - DNA, 1212 bp, Homo sapiens
  misc_feature (1129)..(1129): n is a, c, g, or t
  misc_feature (1131)..(1138): n is a, c, g, or t
ctggtctggcccggaagttatgggatcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgcccaanannnnnnnnaggtttcaatgagttatgtgaatgctcagggcggggcctggcacatagtaaagtacacttggtaagtttaaaaa

SEQ ID NO: 623446 - DNA, 1127 bp, Homo sapiens
ctggtctggcccggaagttatgggatcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgccca

SEQ ID NO: 623447 - DNA, 1170 bp, Homo sapiens
ggtatcggacgaggggaagcgggctggcagcggggctcgggtctggctctgtgggctgtccctgggtgagccttcttacctcatctgcaaaatgggcgcagcggtgcacacctgaggcaagggaaattgggtggtgcctccgagtggtaactaggaacgcccttcagcctagccctgggaagataccggcaccagataccgcctctgctctccaggcgccggggccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgccca

SEQ ID NO: 623448 - DNA, 1152 bp, Homo sapiens
ctggtctggcccggaagttatgggatcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatgtaagcaggcctggcccagctcgggccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgccca

SEQ ID NO: 623449 - DNA, 1224 bp, Homo sapiens
  misc_feature (178)..(178): n is a, c, g, or t
  misc_feature (255)..(255): n is a, c, g, or t
  misc_feature (374)..(374): n is a, c, g, or t
tggggagattcagtggtagacactggggggagacgcgacactgactgcttcccggagcgtgttcatgctatcaagacgccggtacgccctcatagctcgagatgactaatccgtacgcctatccgaatgctgtgacggttctgcttgtctagctgaacgatcgactgtgggtagacangatatcctagtctagccttcggggaattcttccgtccatgggcactctgtgtatgtgtggtagatgtgtggtggaangctatggtcaggaaaccatacatctttacgacgttatggaaaaagaactctgaatagggcgtacatcacatgggtcacacactcaataggacattgtgtttccacacgctagtgagtanactgggttgctatgacacactttacgacatggacggtagtcgtcttatgtcgtagccgtttgcatcagttcttatcgcttgtgatcgtggcaatataatggcatgtctcactggatagacactgatgtagtgatactagggcaggttaggcaggagactctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgccca

SEQ ID NO: 623450 - DNA, 151 bp, Homo sapiens
cgttctaatagctccggcgtgatggaagaggggacaggtccctcaaccacccacaatcctattctcgggctgagtaaccctgcgtagaggacagggctcgcctacaggaatgggctgtctttaggactaacccttcagaaacactaggggc

SEQ ID NO: 623451 - DNA, 754 bp, Homo sapiens
  misc_feature (29)..(29): n is a, c, g, or t
  misc_feature (89)..(89): n is a, c, g, or t
  misc_feature (92)..(92): n is a, c, g, or t
  misc_feature (111)..(111): n is a, c, g, or t
  misc_feature (120)..(120): n is a, c, g, or t
  misc_feature (124)..(124): n is a, c, g, or t
  misc_feature (129)..(130): n is a, c, g, or t
  misc_feature (133)..(133): n is a, c, g, or t
  misc_feature (176)..(176): n is a, c, g, or t
  misc_feature (190)..(191): n is a, c, g, or t
  misc_feature (223)..(223): n is a, c, g, or t
  misc_feature (287)..(287): n is a, c, g, or t
  misc_feature (290)..(290): n is a, c, g, or t
  misc_feature (326)..(326): n is a, c, g, or t
  misc_feature (492)..(492): n is a, c, g, or t
  misc_feature (578)..(578): n is a, c, g, or t
  misc_feature (685)..(685): n is a, c, g, or t
  misc_feature (747)..(747): n is a, c, g, or t
ggggcccatcttcttcgggggcgcctccncgtccagcttcttcatccgccgctctgtcttcatcttgcctgggcccttgccatggaagnggngggacggggggggggagcntccttgggngtgngtgtnnggnccgtctcatccacgttttcgatcttaacgtcgggtttgtggcngtgcttctccttgnngtcctgtgtgaggcctcggtattcctccctcngggtgtgcttgtgatcgatggccatcttatcctcgatgcagttcacggctgggggcagcgactngtngggggccttcacccgggccaccttctgcactgtggnctccagcagccctttgttctgacacaggagcggggcagctgccagccccctattcacgatcggttcctcgtccaggatggtggtggaggaagcagagaaatcctgctgctgcttctcctcgtccaggttcaccgtgctccagccgatgttctcctccccgtcagantcggagccaccgttggctgagcgctcctcatcccgttcaaagtccatgagctcctcctgctcctcgcgattgccagccagcccgtngtgggggatctccccaaggtgcggcagaactcggacgtggcgttgaacacgatggcccccttccgctcgggatcctcatcctcctcccagccccgctggcgagactncagcttcttcacaatctccaccaccttctcgccactgtctcgcagctgctgtagctgctgtnactgttg

SEQ ID NO: 623452 - DNA, 1621 bp, Homo sapiens
gacatggagaaaatctaggcaccacagccttctacaatgagctgcgtgtggctcccgaggagcaccccgtgctgctgaccgagggccccccgtgaaccccgaagggccaaccgcgtaggaagactgacccagtactcatggtcttgagcacctctcaagcacccgcagccatgatacgtattgcctactccagtgcttgctgcctagtccccctgttaccggcccgtcttgcgcccggatacccgagcgctggcccattcgcctggcacctgcgcaccctctcagggcctgcagcggggcgcgcctcgaccccccaccacctctgtctgccgcgcgacttcgctacccgcacgcggcgcttacgtggccacgatcagccctcaatatgtctctaggtcccccatgcccgcctccatggcaccctatgggcctatggtccccgcgagcacccactggaccctggcagcaataaccttcaacatggagacgaagctccctttgcgtacccagtagcacgggcgggctcgtaaaccctagggccttttacaagcttcgcattcgcgcaaccgcgaccgccgtaatcgcccgtgggtgcacacaagtaccggtagggccgatatgaaactcacttttcacaacgcgcgcaccgccatacgctctaggattaggcccataaagcccgcttagcaggaccgcacgatggggcaaaacccttactacccgcagacagccccatcacagcccaatggtaaattgctgatctccaaatccggcgcccagttgggagccctatgcattacccctaaactgagcccgttaacgccaatttaccgctcctcttaggtggctacggccaacaaggggccaacgcccacttataacgacgagaaagcggctattgggccccaggttagcatccccgtggcggaccccccaggggcagcccttccgacgctcttccccatcgcgcgcaccattttatctcggctcgttcgcacaaccgcgtccgtaacccgcgccgcggggggctatcttacccgcccgcgccccattgcggcgctcccccccttggtcatcggcgtgccctcagctgcccttccgcattcgttcgctactacgggcccggcacctttttattcccggccattttggccgcgaccttgggccggcgcgtcccgtacccttggctggcgccactgggcctctaccccccacttgtgttcctttgcccggtcggtcgcagttttccccgtcgaacgcgagtcgtacctccatgctgcatcttaatccccgcgcgttcccttctccacacaccgcctcgttttccccgcgcagtctgttagcgcaagccttgtggattacaacacgcgtgccttggtccgttttgccacctcccgtgactctctggtcgctcgcaatcacccgtcatcgtctctctgctctgtgcctcctctctgtccccggggttagctctgcatgctattgcgcttctagcgcctcgtgcctgccctgattacgcactgacctccgctcaggcttccctgggcgcgcgctgttcgcccctccctgtatggctggccgccgcgcgtggctgcctcactctcctctaatgtcgtcgcga

SEQ ID NO: 623453 - DNA, 948 bp, Homo sapiens
tgacgcgtggggcccatgccttctgccatccctgtaggccgccaatccagtcttccaatccagcctctgtatggactagaggctatcgtcactagtgacagagaccctggaggaactgcagctgcctctggaatccacagagagtgaatcccgtggaggtccatctaactccatcccctatcatggtaggacggatgtgattgtgtgtaagcttccactcgcagtaagactccatacatagagcccctaggacgctcctatagatttgaatacatcaatccttattggtatctgaccacgtgggtttctctagatacgaggaaggtcacggctacttgcgcaggaaaggaagcagagacatatggaagactgcaagcacagagaagggaggaggacacaagacagtagagacgtgcacgagtagcgagggcatgaggcgtcgtagtggggcatgttgctccccagacggaacttcagtctggtcccggtgcaccctgtaggccttcgtcgttcactcctatctagtagtcgcagacaagcccacaaggagtgacgtcgaggtcgtccacaagagtcgccctgtctaactggggcgagaacccattgcaaggcacttggaaggccaagtctaaccaaacttacactgtatgggcagaggatccaagaacagcttttcctagaggctctaccaaagggtgcttcccatgtgggaaacacacctcttaaccgtgaggacactatctagtcccctatcttcccccacacgcgtgcaatgaagtgaaatccgttagcctattctcccaccaatcacacgttttcccaacgttcatgcggttgttgacgaggccaacagtaagaagagtgagagagggcagggacgacatcttgggaatgtcgctcttggcacgcacatactcgttaaggagttccccctccgaagcgaaagag

SEQ ID NO: 623454 - DNA, 92 bp, Homo sapiens
agccacttcgcccagccacactttttttggttactgtaactttttagtaggttttgaaattagacagttttagtcctccaactttgttgttg

SEQ ID NO: 623455 - DNA, 431 bp, Homo sapiens
tagagccgactagtctcctctgacctttgtgtttttcacgcttcagaagacagagtccaagtatagttcgcaggcgacctggggtctctagggagaggaaagcgaagagcggagggagcaaaagagaattggggatatgtccacctgtaggtacactctgtgacctcattacgttccatagaactattgagtttcatcacgagcaagccacaagagtgttacaggttgctcatgtggcgcccatcatcataccgccattacatggagatctaggattattacatgattgccaggtgcctattatgccaatacagcaggtatacatgagaatcaagtcaaaattccagtacccaccagtctgatgatctacaatttatctcgccagcaggatgcactaataaataaataacacaaaaaagatcagaaaaaag

SEQ ID NO: 623456 - DNA, 934 bp, Homo sapiens
ggagagaactagtctcgagttttttggggttttttttttaaaaggtccaattccagtttatccatctgtttatgacacagtacacgggaggcaaagtgtttcacattcatagacttcacttctccaaccctccttgggaagtgtccattctcttgggcttacaggagagactagacgggaaggccaggcaagtgcttaggcaactaaaagtgaggtggggggtaaagtgctaacgtcacccttcacgagggatggccagcggggacgtggtaatctcgacaagcgggtttccataaaccgtgtatagcgtggaaccattggggtgagcaccattttcgtggacgctcaggccggtgtcgggcttacagtcatctccaccacacaggtacagcagcgcttctcgggtagctcgccctatagggtctggcggggatataatgagttacgaggggcactggccgaacttcctcttggaattccagaaccataatttctcaacgatgtgttcccacttcacgtggggggagaaccagtgaatctcgtgactcgaggacccttatatctcggcgtccccctggtgcccttctaggggagtacaataacgagccgatcagcaaatatcacgggggtctgagtcctgaatgccactggaaccgaggttcgaggaaaagctattttcccccgagggctccttaaacactcttttctgtggatgctttcccaaacatggtcataaggggcggtaacttctgtgtacctatcaaaatacttccgggaagggtgggggcaccgctccgcatacggacatgaagctgatcccactggggacacatcagttcccttttcctgtttcactccaagggttatagagatcccgaagatctggggccatccagttcataaatcatgacagagccatcctttgggaaactag

SEQ ID NO: 623457 - DNA, 114 bp, Homo sapiens
  misc_feature (1)..(1): n is a, c, g, or t
nggtgctggagagtaagagtatatgaggaacttttaaacgacaacaatactggctagctttcaggatgatttttaaaaaaatagattcaaaggtgttatcctctctcggaaccg

SEQ ID NO: 623458 - DNA, 145 bp, Homo sapiens
tcgtcgaccgctggatttgactcagagaggaccccagagggtgtctacatcttccctattaattttcagcccttgagggcttcattgtagatcaaacgcaaggaccccaggaaggtgaatactcctgtgaagtcacctcctgggt

SEQ ID NO: 623459 - DNA, 267 bp, Homo sapiens
agtccccgatcagtaaaggaaatgggcctgagatttacagtggatgtattctgctcgtggcgactatcttccgtgctacttccagactaacaacagattacgggcaatgctagcgaaacacagacagatttgtcatagaagaaactcaatgatcgtgtcactgagcagtggggcaggggagcacaggacagttaataagtaatagatagggtcatagcaatttccattatagcaagcatgagaagacttactaggacgatagactgg

SEQ ID NO: 623460 - DNA, 389 bp, Homo sapiens
  misc_feature (2)..(2): n is a, c, g, or t
  misc_feature (20)..(20): n is a, c, g, or t
  misc_feature (75)..(75): n is a, c, g, or t
  misc_feature (90)..(90): n is a, c, g, or t
  misc_feature (107)..(107): n is a, c, g, or t
  misc_feature (137)..(137): n is a, c, g, or t
  misc_feature (198)..(198): n is a, c, g, or t
angccatttgtccagtaaangaatgaaacctacctgatagaccatgccctataaccccagatgaaccctttaaanaattatgcccccgtnaaagaagtccaattacnaaagacccacataaatgcacatattttcanttatataaggtgcatgcagtgggcatatcccatagagacagaaagcctgattagtggttgnacagtggttggagctagttgggggtgcagagtgactgctaatgggtacagagtttcttttgggggtgatgaaaatattctaaaattgattgtgataatggttgtacaactctgtaaatatattaaaaactagtgaattgtacatcttaagtgggggaattttatggcatgcaaattacaccttaaagcttt

SEQ ID NO: 623461 - DNA, 377 bp, Homo sapiens
ttagcgtggtcgcggccgaggtacacatctgccatgtggcattaggtcggacagggtgtcatggtttggggcactgtcgggggggtagatcgacggccgtagtatggcattaaatcaattggcatattgtggcttattcttgagctgctgagcacagaggaatatgataatgcaacatcttggcttcctcaccgatactaaaaggtggggagctaaactgtggtgatttggagggtttcaaagggccagtttggctgtcttaagaaaacaatgatctatagctgatagctttgtctctcttccattcaaaggaaacataactgtggcctttcccacttattttcctggcacaatctcctcactacctaattctttcc

SEQ ID NO: 623462 - DNA, 126 bp, Homo sapiens
gatgatcgagctcggtaccggaagcaggtggtcccatcccagctgggaagacattatccaatctcatctcttgtaaatacatgtcccctgtgagttctgggctgatttgggtccctcatacctctg

SEQ ID NO: 623463 - DNA, 937 bp, Homo sapiens
  misc_feature (186)..(186): n is a, c, g, or t
  misc_feature (190)..(190): n is a, c, g, or t
gggaggaggaggttcgggtgctgggtaagtgccatgtcatgtgtggacagaggcatttgactaagccgaacctcgctctcacagcctctgtatctctgtcaggccatactggttccatctgtgtctgtactaatactgacataagataaatttacttgttacgatgactcgctcataagctcttcntagnacttggagcactagaagccaagatctcttagtttataactctcttgtgttaagtagaatcaactcttaaagacgacatctttttgcgtcaacctagacacctggagtgaaactctcagtgttgtactattgtcctagggtgctatgagtacttgggtacaacgttgatacgttgtcctaaggaatttaccagtgtcatagtttgtagagaactagatttagagtgtgcttcttattgctcacaaaatactaaatgtcatgggtcatagtatctgatatcaatatcggtcgagtaacatagtccacaggtaacagcccatgatgtacggcataaatggacaatagacaagaaacctcgtactatttcaaagtagtattgtcacttgtatttcattatctgtacagccaactgtgtgccatttgcactggacttgtaagctctagacttcagtgatgtctacatagtgaaatgatctattgtgtggactattctgtcagctctggtatatcacgcaaagttcagcaacatgtatgcaaccaagttcacaatgaactgagtaggtagaaacacgtgaacttaatatcttcatgatactactagtcctggaaacataattacatgaaggcctactaatgctaggagtcaatagataatagtagcttaccaacaagagccaaagaagtcccccatggatctaaaaaccgagatcaaaggggccctggcctagataccccgacatcgtgctca

SEQ ID NO: 623464 - DNA, 132 bp, Homo sapiens
aaaggagcacagactactgcaaatatttcacgattagaagaaattgcctgtatctaagtcaggttactcaagcaaaagtgatccatgtagagtatgagttgcactccaaaatctatcattactgtaaatatc

SEQ ID NO: 623465 - DNA, 419 bp, Homo sapiens
taatgtccgtgctcatttttctacttagtattttatttaagctccttatagacacgggatattagacctttgttagatgcatagttggtaaaaatattcttccattctgtaggtggtctgtttactctgttgatggtttctttcgctgtgtagaagctctttcatttaattaaatcccattggtcaattttggctttggtggcaattgctttggacatcttggtcatgaaatctttgcctgttcctatgtctaggatggcattgcctaggttgtcttctgggttttggtagtttggggttttacacttaagtctttaatccatatgattttggtatatggtataaggaacgggtccagcttcaatcgtctgcatagggctagccagcccagcaccatttatggaacagggaggggtacc

SEQ ID NO: 623466 - DNA, 249 bp, Homo sapiens
tggggtccacccgggcccaggccccttccttttcatgggctggaaccgctttggggaggcccggttgggctgtgccccccgattccaggagttcccccgtgcctacaaggctgcccgtgctgcccccctccccccctgcgaggtggcgctgcactaaggggctgggtgctggggaggggctggtagaaggaagggtgggccccctgctttggaggtgatggggctatcaataaaaactctgttccccca

SEQ ID NO: 623467 - DNA, 176 bp, Homo sapiens
gtatgagtactcctgctgtcgcacgttcacagtataaatatgctgcggagttcgcaatcctcagcaacatcttaatgcacagcacaagttacaatgcaacagcctgctgtccatgtacaaggtcaggaacctttgactgcttccatgggtggtatcagcgtataccaccggactgg

SEQ ID NO: 623468 - DNA, 832 bp, Homo sapiens
gtcaagatcagcgatatcacgcgtccccggagcatcgcgtgcaggagccatggcgcgggagctataccagcgaagagttcgcccgggcgggcaagcaggcggggctgcaggtctggaggattgagaagctggagctggtgcccgtgccccgagagcgctcacggccgacttctacgtccggggatgcctacctggtgcgtgcacacgtgcaagacgagccgaggcttcacctaccgtctgcacttctggctcggagaaggagtgtcccaggatgaaagcacagatgctgccatcttcactgtgtcagatggatgactatttgggtggcaagccagtgcagaatatgagaacgtgtcaaggagtagtgagctctaatgacgtatggttagctattgtcagaaggcgggtctgaaatacaaggtctggagtgcgctggcattctggattagatcatgttctgtacgaacgaccctgacgggcatggaggctcctacatgtgaaagggtcgtagtagtggtgagagccacaggaagttcccctctagctgggacacgggggagagcaaggcgtgacttgctttcagtgcatttgaggctttgtgcacctgaacatttatcagtagagtgtgggttccctcttcgcagaggaaattatgcatcggtcgggacagggaaccaagtagaatactggattccggcacaatggaagggagaggaaggtctggaggtaatagctcgtggaaggagggagtgcaccctcgagaacgggaccaaggccaagggggagactcgagaagttcgagcttgggttggcgaggaggaaatgctccagc

SEQ ID NO: 623469 - DNA, 702 bp, Homo sapiens
ttaaaaccctggggtgggaatccctgtgacgcacggcgtgatggccaaggaagacagggcgaactggaaattcaactaattccttaagatcctccaactattggatgaatattccgaaatggttccattgggggaacagaccatgggggctcccagcagaatgcagcagaatcggatggccccttcgcgggaagggtggggtggtgatgggcaagaacaacatgaagcgcaagggcatccgaaggcgacctggaaaacaacccaactctgggagaaaatggtggctccatatctcggggggaatgtgggctttggggttcacaagggaggactcactgagcatcagggacatgttgctgggccaataagggtggccagctggtgtgccggtgctgggtggcattggccccatggtgaagtcactggtggcaggcccagaacactggtctcggggccggagaagaactctctttttccaggctttaagtatctacactaaaatctccagggggcacattgaaattctgaatgatgtgcagctgatccagactggagaccaagtgggagccagcgaaaacacgctggttaacatgctcaaattttccccttctcccttgggctggtcatccagcggtggtccacatggcagcatctctggaattgttatttacagaggcttggattccgcttctggggtttcgc

SEQ ID NO: 623470 - DNA, 972 bp, Homo sapiens
  misc_feature (123)..(123): n is a, c, g, or t
  misc_feature (234)..(234): n is a, c, g, or t
  misc_feature (239)..(239): n is a, c, g, or t
  misc_feature (247)..(249): n is a, c, g, or t
  misc_feature (253)..(254): n is a, c, g, or t
ggcgcgcggaacatggcggggtccaggtggaggtcttgaggctatcagatcggtatggcattggcgtccgggcccgcaaggcgggcgctagctggctccgggcagctcggccttgggggcttncggggccccgagacgcggggcgtatgagtaggggcagtgcagctccacagccggtaagtcaggagcctaccatcccctaggataagggtgtacgagatccctgagactggnagccnaatcaccnnnttgnnggggaagatgcactttccgcgccgggaaatgggcggaaggcagaatcttaacccgcccgtggaaccggcaggtttaacaagggacccacaagggtttccataacctgttccggcccccttcttcaagggaggcctttccggctgtaccaaaaacggacgaggggcctggtaatattcttatcaccagcggggtggccgcatttcctcgagggtgtgtaaaaaggcaaggggccttcttggttcaaacaaaggacccaaagttaaatagaagggcttcccaggaagaaaagttgcttaacgctgtgtggattgatccaaggggaaccagattaagaagaaccaaaagaaggaagtggttcctggaagtgtgatctctcaccgccggtgtttttgggaaggaccagtggaggaaaatccccaagaaagaagagacttagttgccagtccatcggtgacaaccctaatacaggttgtgtaaattcgcaggattctaaaggactcattcttgttggcaggaggatgtgtgtccaaaactccaagttttgtgctacgggaacggaagttcttcctcaaaccggggtctgggggagcgattgactaaggtcttgccccatgcctcagagaaagtgagactagattgttagaatttccattccaaagagtcgaggatttggaaagcaggcggggttccaccaccgttgagaaacacgcacaaggg

SEQ ID NO: 623471 - DNA, 394 bp, Homo sapiens
agtatgtctctagcccattcatattactgtgtacaaaagccatgatatcgtgccatgaacaatatcgtgccttatttcttttggtgactcatagagttcagattgctgctattctcttaggccctcttatccctacagatgaaaggggcaaaacttccaggcccgatcaggccaatgcttacacagtatgcctgtctatatctctggtgagcagatctttcttaattctgtgccactatggtcaaattctaaaagcagtccacttatagctgttgctgccacgttttcatctcttttcctctaagccacaaattagaattattgagctttatcccgatctttagtgccctttctgctatccaaataggttattacgatccctgagctgcggccg

SEQ ID NO: 623472 - DNA, 241 bp, Homo sapiens
  misc_feature (58)..(58): n is a, c, g, or t
  misc_feature (104)..(104): n is a, c, g, or t
  misc_feature (205)..(205): n is a, c, g, or t
  misc_feature (219)..(219): n is a, c, g, or t
  misc_feature (232)..(232): n is a, c, g, or t
ttgtgcgtgcgcatgcatgggaatagcggcccggaggatgttagacttgctcctctcnaagacagcagcagcctgcacctgccccgtgtgtgtggccggcctcntctcacccttcccggcccccggcaaggacccaggcgctgcatacaggggggggcgacccacagctggggccgttttcctcagctctaggctgttctgtagnttatctgccctccnactttaagcagtngcaggagtt

SEQ ID NO: 623473 - DNA, 149 bp, Homo sapiens
tcgtaaagatgcttttttcactgtcccctgcacccctcgtccccgcctctctttgctttcacttagactgaccctgacacccatcaggctcagcaaattacctgggctgtcctgccgcaaggcttcacagacagcccccattacctcag

SEQ ID NO: 623474 - DNA, 179 bp, Homo sapiens
tgagctggtccgcgattgttcctgagtctgacctggtgcggttcaccctctccttaggcaacctggtggtccccgctcacgggaggtcaccatattgcatgccgaacttagtgcggacaccctgtatctggcatagctgcactactgtgccagtaactcctggtgctcaagctgatcct

SEQ ID NO: 623475 - DNA, 574 bp, Homo sapiens
  misc_feature (1)..(1): n is a, c, g, or t
  misc_feature (81)..(81): n is a, c, g, or t
  misc_feature (98)..(100): n is a, c, g, or t
  misc_feature (130)..(130): n is a, c, g, or t
  misc_feature (158)..(158): n is a, c, g, or t
  misc_feature (169)..(169): n is a, c, g, or t
  misc_feature (197)..(197): n is a, c, g, or t
  misc_feature (199)..(199): n is a, c, g, or t
  misc_feature (203)..(203): n is a, c, g, or t
  misc_feature (222)..(222): n is a, c, g, or t
  misc_feature (224)..(224): n is a, c, g, or t
  misc_feature (242)..(242): n is a, c, g, or t
  misc_feature (244)..(246): n is a, c, g, or t
  misc_feature (254)..(255): n is a, c, g, or t
  misc_feature (262)..(262): n is a, c, g, or t
  misc_feature (318)..(321): n is a, c, g, or t
  misc_feature (324)..(324): n is a, c, g, or t
  misc_feature (326)..(327): n is a, c, g, or t
  misc_feature (355)..(356): n is a, c, g, or t
  misc_feature (393)..(393): n is a, c, g, or t
  misc_feature (419)..(419): n is a, c, g, or t
  misc_feature (498)..(498): n is a, c, g, or t
  misc_feature (568)..(568): n is a, c, g, or t
ncaggaatatattcaacacttacaaaaagtgatatgataaagaatataaagtactagtttccttttaacacttcaaaaganatgtatatatacttttnnntacaagtaacatcacaaatgatcacatctncacatgcccttaaagtattatttgtacncagtgtaaggntattatcgtttttcatacataaaatttncnagcnctgtaacacaatgcaattntnaatccattcaagtaagtncnnncccaaagnngccgccncccagcattaagacatgcacccacccccctcctaagattttctaaaacttgtatgnnnnggngnnagacccctttgaaaaaatagtcccaatnngggggagagtaaatggctgacattagtagcaaaaccntagttatctgaaaataacatattggnaatgagacattattaggattttaaacaaacaatagcatttagacataaagtaggaagcaaaatacagtaaacagaaatngtgtagccaaatatgcattctcttcagccacactagagtggaccttgcttagtacccttaagtaaaaganaaaaca

SEQ ID NO: 623476 - DNA, 172 bp, Homo sapiens
ttggtcccatctttaatcgagaaacatttatctgtataaaacatattgttggataaatatatatatatatatttatccaaaaatatgtttaatacgattaatgtttctcgattaagatgggacaaggctataagctataaaataaagaacattggctttggtaagactattt

SEQ ID NO: 623477 - DNA, 1346 bp, Homo sapiens
  misc_feature (565)..(565): n is a, c, g, or t
  misc_feature (640)..(640): n is a, c, g, or t
  misc_feature (670)..(670): n is a, c, g, or t
gaataacatgtcctcgtctatgtatctatgttatttattgttgtaattgaatgccgccattgtaagattatgtgtgatgtctgtaaaacagctcgtatcattcaagcacaaggggttacggatgcgagtggatcccgaggtgtgtgaggactattcagcaaatcacccaaaatttacactacgtacagagacacgaaggtactgagccttgagactccacggagttgctgggtgagaacactaactacgtgtgcttattagggccagttaatccttcctgtattatccaaaatagtctggggagtagactacaacgagtggacacgaatattttcattgccatatatcctataattgaatacaccaattgcgaaatattcctcaatcaaaaaactatcttggacaagagccaacagtccaggcagcacaagtcgaggagataatgcgttactctccaggcaattgaattttcaggaaagagctttcatccgttccatgggatagcccgcggttgggtttctaatcgagtagtagcgaagactacaacataaacaactggttgatntcattcaatcactaaaagcgaggaaaccctcacatatgaacaaaagagacaatacaactcaggagtggcactttnaattcgttcgagatagtgaagttggcccgnacacacaagggcccgtgtggggactttgagaaggattttcatatcactctgccttttccatggttttagagacaaccttccttttaacttaaaagccttgagggtactatggcacacgcgcacacccattacactttccgagacactcacacttcagggcgcacccacctcagttgttgaaccaaaaagcgccgagccaaggccccaaatgtggtccacttaaccttgacactttggtggcacaacacgtcttgggaacaggcattttctaccctggaaaaaacccaggttacccaacagaacgcgacggtaaatgatccgcttccttactaaaaaccaactttcgtttatttgccacccacatgtaattttgggcgaaaccgttttctttagggtacccggcgcggttctaacttaccaagggcccccaaccacggtcacacacgcacacaacttaaccaacgggggcgttaattccacaagcaaggcggaacagaaagcggacaagattccaagaaataattctatctggctctaggacgcgaaactgacccatgtgaatccacagataatctatagtgaaaacaagtcccaattggctaccacaaagccccagaaagaagcttctcttgtacgggcttgcgtaagccacaacgttacaagcaaacaactcgtg

SEQ ID NO: 623478 - DNA, 730 bp, Homo sapiens
caaaaagaaaaaacttgcccccagcccgcagagccccagttagaaagcccacacttggccttttggagaccaaggtctggtgagacattccttggcatcaaaagattcacagttcagaggaaggcccaggccagaaaataaatgactgaaatatcacgagtgaggtaagtgctgatctaggagaaatagggtgttagcaagaaagtgtctggccgcagcatcccttggcccctctcctaggactgccaggccaatcttgtgtttccagtgaaacctcccagggaggaagcgaacagaagaagttgcctgaggggcatgagccaaagctggggcctcagttgtggaagcatctcccaaactgggatgatgggggtgggggcatttcggagggtgtgacaatgctgtgttgcctcaaagtgcccagagaggcaccaggaccctagcaggagtaactgcatgacgctataagggaggttgcacccccccagccactgccaggtgcctgtgcccaacctgggaaggagtagcgaggacacccagcttccaggaccagatggaattggaaaatactgcactgtgttgcctgctgcagataggagacagagggccctctctaagtgtctgtgctgtgtaggacaccccatcccctatcctctgtttccccctttggttctctgtaggcacagagagaatccagacaaccactgagagcaatttattgtaactctgg

SEQ ID NO: 623479 - DNA, 398 bp, Homo sapiens
gccgggatattcaatactgatttaatgattatatactctgtgcatttaacataatttcacatgtaccccatgaatacgtataaatatagcgaatcatgaaaaaaaaagaaggaaaagaaccaaaaccttaaaggtaaagttggctaacttggagaattttttttttcttgagacggagtctcactctgttgctcaggctgtagtgcagtggcactatctcagctcactgcaacctctgcctcctcggttcaggcgattcttctgcctcagctaccaagtagcttgggctataggcccgtgccaccatgcctggttaatttttgtattttgagtagagatggggtttcaccaagttggccaggctggtctccaattcctgacctcaggtgatctgtccg

SEQ ID NO: 623480 - DNA, 131 bp, Homo sapiens
ggctatatttcctaaagcacctgtgttttcctctttttaagccagggtcctgtttggatgacttatgcggtgggggagtgtaaaccaaaacttttcatctatttgaaggcgattaaactgtgtttaatgca

SEQ ID NO: 623481 - DNA, 90 bp, Homo sapiens
acggccgtgtattactgtgcgagagatgaatgtagtggtggtagctgcgtctatgactactggggccagggaaccctggtcaccgtctcc

SEQ ID NO: 623482 - DNA, 370 bp, Homo sapiens
gttagtgttgaaatgaatacagtatgagtattgtgtaggagggtggtttggcaactctagctgttaagaataagccaccaaatttatggtatgcctgacagattttaaatattctttggcgcttggaaatccctggtcacggggcccctggagtgtctctgttctagagagaattggtaggatccctcagtgtagcatagccctaagtagtagagggaaaacttaagccaatgaacacaaaggagatgagagagggattgtgagtagtggagtaaaccatttggaatctggtgaaatggatgacccaggtgtgcagcagcagagtcatcgcagggcatgcagtagcacagctgtggtggcatgtgccccg

SEQ ID NO: 623483 - DNA, 222 bp, Homo sapiens
agcgggcgtatcgatcatcatgttcgcacttgtactgaacgcccattattcgccctcaaacgggagtggggcaagcaaacgccgcgcccgtgacaggacggtgagggttgcatattcagcgattcaggtgctccgtattgaacgcttcggcaattgcgccttcaggaaggccatctggtcggccagcatgttgcggttggacaggatcaggtgttcgatcca

SEQ ID NO: 623484 - DNA, 278 bp, Homo sapiens
gagtaaggcgtagaggcgtagcgtccaatgctcaaacgtaagtcgtcccaacaattatagttactagccacgtgagcgagtgactttccaaaaaacacatgagtttgaatcaacacaaccacccacagcctagttattagcatcatccctctactattttttaaccaaagtcaacaagcaagcctatttagtctgttccccaagccttttcctcctgacccccttaacaagccccccgtcctaaatactaagctaccctgacgtccgtactcccgtca

SEQ ID NO: 623485 - DNA, 562 bp, Homo sapiens
tctggatgtgcaattggttaaagtgtcatgtctagatgcacacagcttgctgctggaacagcatcgactagaacgatgtgagctagaggctgctgctcacctttggtgacctgaggaatcccaggcctgtgttaaattctaaaccgcacattgcagcacatgatgccagaaatagcactgaatcaagaaaatagccattgcggagctgccctcttgagtctttctgtccatcccattctattctgtactgtgacttcagttcaggaagtttggtttggtgtatagataaaaggaaagagcaagtttgctcagtcaaagtgatcagatcccgaatctagattcccagttctaaggccttatcacctcccctgcccataaggccaacaaccatagttcctcacattagtgattagcagactctttgtggacgagtgaatttcacaaacagcacaatttcagaagacatcgagggcacaggccctcacttttcttcttttgacgcatcatcctgtgatgttgacatgtcaattgcaggatgctgatgttgtgcacgtcactcacc

SEQ ID NO: 623486 - DNA, 138 bp, Homo sapiens
gaactctaatcaactctatgtcgcacgtatttaccatgatgggataaatgttaatcattacaagtgccaatgtgtgaaaatgtaataaacattactgctatcacttataagtacggtctggaccattcaggcgtgtgc

SEQ ID NO: 623487 - DNA, 1128 bp, Homo sapiens
cacgcgtcgcacaggttaaaggtcttgatgaagtcctgcagtacaagagatccagtatcctcatttaatccagaacattcccagatgtacttaaccgcaggaaccattttcgtcccaacagcatgacacacatagccatatatttgcccatgtgcagcccagatgcacaggtcccgatattgccgtctccaccaagataggcttgagcctatctatattagatgcccgatgcagtaggacaggcccatcccattctccatctccattactccttgagccttcaaggctctaccattaggacatccactccaggcagcatgattcatccactcataacccccatgggcatgcaaggccctactgctgggcacgcacatttacgtgatgtggatacaggccatcacccttcaccaattgcacacaactgatgagcaaaataccatgtgcagtgaactgaataatgcagtgcacagatgtcccaggggacctgtcaggatcacattcatttgccccgaccaggccaatgtcatatggaaggtggccagcgagcccagcaggaagcagaagtgggacggccctgaggcatgtaccatttgagctgatctcctgaaacatctctataaatcacagactcccagaccacaaccccacgctatcatcactctgatgtactcctaggcacaatacaccaatccggcacactacaacctcaggcccactcacaaagacagagacacacaacgtctggcgcagacgacaccagacacaaacgcgcggcagagagcgctcaagcaacgcacaagcaggagcggaagcacacacggagagcacgaagaagaaacgaccaggcaccaacgcaacaagcacacacaggcccaaaaacagcacaagggcacactaaacctgacaaacaggacacacaaagaatacgaagcgacacacgaacacagaagggcacagaaaaagcgaaaaaagaccacctggaatacagcacgaacgacagagacaacgaaccgacgcgaggaccacacactcacacaacacaacacgcaccaccacagaacgctcaaaaaacaaaaacaagaaaccacgaaacagcggcacacaccaatcagaaagcggaaccac

SEQ ID NO: 623488 - DNA, 208 bp, Homo sapiens
tgagatcacaaagaccctctggctgtggacaaataatgtaggacctggaccagtgtagagatagcaaagtgggcttccgagagcttcttttccctattgcgggctcaccattgcatgcaatgacctacttttgtaggtacaccattaatgctagatagggacaagaagtatggccgaaatgagcagttcgctcctccctagttaggct

SEQ ID NO: 623489 - DNA, 816 bp, Homo sapiens
  misc_feature (72)..(72): n is a, c, g, or t
ggcgcgaacgacctctggctgttgtttccggggaaggttctgtccgtctctctattaagggggtcccccccngctatttatcctggtccccgctgctgtgtatgaggttttaggagggggccccccccaccccctggtctttcttgggggtcccacagcagagtgccacaacggtcttgggtcttttgtggtgaaacacaccgcgggccgagacggcgagaagcggcgcaaggttactccccgtgccgcctgtcttgtccgccctctgttgcaccgcccttcctgcgtctgtctaaccagagaagttcgcccccggacacccagatcgggggctccgcttaattatgtggggaattaaccatttgggtggtcccccacttgcgaggattatctggccgcccccctctccgcaccccctctggttgggggcgacacccccgcgctgtcgaagacactcttttgtcgcactggaatagaccctcgcgcgcggcgtacatacactcggtgctgagccacccgacaggtccacaccctcttctttcgttgggcggggtacattctcgctggggtatgctgtctataccgcgctcgtcgtgctgtgtgtgcgctccatccgtgggatgctgcagcacagctgggccgcagccccactgcgatggcaccgcgatgaggggcgccccccggccacgcggagacaccacccgcccactcggcgcgacgctcacggccccgccaccccctcgtggtgatggcacgcacaaccacgcgggctccgcacaaaacagtcccccccacggcgccaccacatgaaacgaa

SEQ ID NO: 623490 - DNA, 478 bp, Homo sapiens
  misc_feature (216)..(216): n is a, c, g, or t
  misc_feature (228)..(228): n is a, c, g, or t
  misc_feature (236)..(236): n is a, c, g, or t
  misc_feature (291)..(291): n is a, c, g, or t
  misc_feature (395)..(395): n is a, c, g, or t
  misc_feature (420)..(420): n is a, c, g, or t
  misc_feature (443)..(443): n is a, c, g, or t
  misc_feature (478)..(478): n is a, c, g, or t
tctgtcacccaggctggagtgcagtgatgtgatctcggctcactataacctctgcctcccgggttcaagtgattcttgtgcctcagcctcccgaatagctaggattacaggcgcatgccaccacgcctggctaatttttgtatgtttagtagagacagggttttgccatgttggccagtctggtcctgaaatcctggcctcatgtgatctgcccgncttggatcccanagtgctgngattacaggcatgagccaccgcgcccagtctcactttaaaggagagagttaaagngacatctaaagatatgcatcccaataggattggggtgattttcaacattcatataaaaaatgagtttatcaacactcaaaatagatttatttggtatttctagnttgtttgtttaaaatgccaacaaancataacatactatggctatcttnctccatttgaaaagacaagtaatgtggtaaatatn

SEQ ID NO: 623491 - DNA, 99 bp, Homo sapiens
tgacaatgaggaggaggagtactttgtggcccaggggcagcagtgaccagccaggcgaaatggcttagaagaggccactccccagccctgctgccagca

SEQ ID NO: 623492 - DNA, 335 bp, Homo sapiens
  misc_feature (35)..(35): n is a, c, g, or t
  misc_feature (130)..(130): n is a, c, g, or t
  misc_feature (157)..(157): n is a, c, g, or t
  misc_feature (191)..(191): n is a, c, g, or t
  misc_feature (208)..(208): n is a, c, g, or t
  misc_feature (331)..(331): n is a, c, g, or t
gagcggcggcctcggccagcccggacccggagggnctgccggtggagcccggggcagtgccggcgggcgcggggaggcggcggcggcggccgggcccccgggggtcgtcggggcgggcggcccggggcgnctacgagctgcgggattgctgtgggtnctgttctttcttttgtgttcttctcctattgttncactgatctttttctgnctgtctcctactatcttagtaatcaacacacctatcatttattcttatcttttcttttttttttttctttttctctcttgtttttagttttttatctttttttttttttttattattattttngttt

SEQ ID NO: 623493 - DNA, 119 bp, Homo sapiens
ccttttctacgctggtgtacatgttatgtagtggactcctttataattgacccatgctgggtaccctttcagatccatcatgttcttagcccaccccaggccctgaccctccatcaaca

SEQ ID NO: 623494 - DNA, 353 bp, Homo sapiens
  misc_feature (59)..(59): n is a, c, g, or t
  misc_feature (109)..(109): n is a, c, g, or t
  misc_feature (186)..(186): n is a, c, g, or t
  misc_feature (188)..(188): n is a, c, g, or t
  misc_feature (197)..(197): n is a, c, g, or t
  misc_feature (212)..(212): n is a, c, g, or t
  misc_feature (237)..(237): n is a, c, g, or t
  misc_feature (245)..(245): n is a, c, g, or t
  misc_feature (302)..(302): n is a, c, g, or t
  misc_feature (327)..(327): n is a, c, g, or t
  misc_feature (329)..(329): n is a, c, g, or t
  misc_feature (350)..(350): n is a, c, g, or t
  misc_feature (353)..(353): n is a, c, g, or t
tggttcagtgcaagggaattcctcattctcttcaggggcagtgatttctggagcataancctgtaatcctgctgctttgacaaattcagataaagttaaggaatcagantttatcccagtatgacctttttgctcgaaatataagcggagaatatccctatagggaaggttgatggagcgtttgantnatggctctncaatttccaggagcncctgcgtatgcggagaaattgcctncatgttcncaaagtttgttatccccatgtgagggagggttgagcagtcgacgtgaattagttttnggccactgatgaagtttgtgataananactgcttgtattgagggaagngtn

SEQ ID NO: 623495 - DNA, 662 bp, Homo sapiens
  misc_feature (511)..(511): n is a, c, g, or t
  misc_feature (517)..(517): n is a, c, g, or t
  misc_feature (564)..(564): n is a, c, g, or t
  misc_feature (619)..(619): n is a, c, g, or t
  misc_feature (635)..(635): n is a, c, g, or t
  misc_feature (644)..(644): n is a, c, g, or t
  misc_feature (662)..(662): n is a, c, g, or t
tctctccacacaccaagcaagcactcctccagcagacacaagctgggtgtcgtgtagttcaattcaatcctaacactgtgtacctggagataacatcagaccccacaggttgagtgctcagtcccccaagagtgtcctccacttcagatgccaactgcaagccccaggttgtggcctgtgcttccgacagagcagccataaatcagggttcccatgactctccttctcagtttctgttaacttactagaggttctcacataactcagggagacacttacatttacccacttattatgaaggacattataaaaaatacagatgaacaaccagatggaaaagtgtatagattaaagtatggaagaagggacatggagctttcatgctctcactggcacattactttccaagaaactttcacatgttcagctacccagaagctgttccaaactctgcctttttgagtttttatggtggcttcattgcataggcatgattgattatatcattggncattgntgatggccaactcaatcttcagcccctctcccttctccaaaggttanggctgaaaagtctcaaatcctctaaattatggtcctggggctttctgggaaccanctcccatccctggaanctatcttangggttccaacaaccgtan

SEQ ID NO: 623496 - DNA, 244 bp, Homo sapiens
tgtgtatgttacagccctaggtgatcagatactggtgggctcagctggtttctctgcttcaagtttttcaagggtgttggcaaggctaagctctggggagaagccacttccaggctcattcaggttgtcatgtagaattcagttccatcgtggtatgtaggactggaggtcctagtgttcttagctgcaagatgccagtcaagcagtgggtgcaaagtcaaagctcatgaactctcgtcccgac

SEQ ID NO: 623497 - DNA, 341 bp, Homo sapiens
tgatatgagtatctcgatctcctaaaatgagagctttcttgcaaaattctctacctggaaccatccataagcctgatgatttttcattcggtgaaaagggttcaaactaactgtttgctgtctgaaactgattaatatcccacccaactgtgtccttcttttaggcaatctgcagtctaaataggtggatattttcttagctggcttacatgcatttatttatacacttttttccccacaataaaaattacacaaggtatgacaaagagagtgtgcacttttaacgttggccacgctcccttcccatccattccatgtaactgcaaccccgagctgttgtg

SEQ ID NO: 623498 - DNA, 568 bp, Homo sapiens
gcggaggtcgctcgctcgctcgatcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcgtgcccgagctggagtggccgctggcgcctgcctcctgatcttgaagagccctgcgctgctgcggagcccctgcccccgcctgcgcacccgggcacccgacgcgggagcgacccagcccaaggccagacccggcccggctgcggcctgatcctaaacccagcgcaggcaggcaatactagcccctctggagcacggagctccttccccaaagacatgaagctatgggacgaactcgagctttgaagccatcaagcgtcaccagctgacttgtggaagaaccggagatgcccacattcattggacaggatgagaagctacctcatgtaagatggcaggagcacgacgaaacacatgtcaagcagttctgccaggagg

SEQ ID NO: 623499 - DNA, 103 bp, Homo sapiens
cttggtcagtgatatagggcagtacaacccctcttacttggacttgacgtcttattagtaataagaggttgcgggtagtaacagtgatttcagagaattagac

SEQ ID NO: 623500 - DNA, 1024 bp, Homo sapiens
gctgctccccagcccctccttgactccaaacccccgagcacttgctggggctgatccctgctccatccatggtaccagccactgacaccaaggcacctccaacccttcaggcagagacggctaccaaaccccaagccacatctgccccgtgccccgcccccaagcaaagcttccgtgtttggagcacagaacacctcaccttccagccctgcgaccctgctgcatcttcagcacctcccatgttcaagcccattttcacggctccacccaagagtgagaaggaaggccccaacaccgactggcccttcaggtctcagaccacagcgccactccagctcctccctccccacgagcaaccaggcaacacagacccgaccttccaggactgtctttagcagcatggggccacctgcatctgttgcccttgccatgatcccttcttcaagcagacaacatagtcccgcacacttggtcccagacagaactgccccggtcttcactggcctggccaagagccacctcatgctgtggctcccatcaccatctgccagtccaatcccacgagaactctgcattcggaagccatgcgttcgggcttgggcataaaacgagatgtgaagcaagacagcaggtgtggagataccaaggaaccaagaaaacaggccgactagacagaccgtcaacgaggacatgatccatcatcacggagcgccccagggccctcatggcgtggccaagcgcttcaacaccacgggaccaatgggagttccaaataatcccaaagataggggaaaacccttaccatgggccgttggccaaacaaagcaaccaacatggacaccaacacatttaaggcccacagtcacaccgttgcacccagtgcgacgtgcccaagcgggatcacacaagcaaggaacacagccggccgggagcgtaaagagagataaacggcaggagacccaaaaccggcgaactccgacacagagaacacagaaacagataagaccaaacatagagagatagt

SEQ ID NO: 623501 - DNA, 240 bp, Homo sapiens
gcctggttcattgcagagcgctgcagaaagcagatattggtgaactgcaaatgttgctgcctgatcgttcctctggaggttttgtctcagaggagtacccggctgtgtgaggtgccagtctgcccctactagggggtgcctcccagttaggctactcgggggtcagggacccacttgaggaggcagtctgtctcttctcagatctccagctgtctgcaaggaacccacgggtaccgagct

SEQ ID NO: 623502 - DNA, 330 bp, Homo sapiens
atggatttcagaactaggatgcgcaatatctggcttctgttttaaaaggttgtcatctgactgtcatgctgggaatagattgtgtagggtgagaggacacatgcaggaagatcaggtaaaatgccatcatagaaattcaggaaataacatagtgtggcacagatcagatttccggagactgaatatgaacaatgtggtcaggttgggaatcacgtattcacttgtttacatgctgatcagaatgatccagtaggacaaggggagacaaatggtgtttatgagagatcacgaccttgccggaacatgttctttgctaagttacatctgctg

SEQ ID NO: 623503 - DNA, 315 bp, Homo sapiens
tccgatggcgcccatattcgttgcttgctggccaccctgttcttccgttatatgcgcccaatggtggaggctggccgggtgttctcggcggtaccaccgttgcaccgattcgaactcatcaaccctaaacgggggatggacaagtacctatacacctataccgatgccgagtaccagcgcaccgccgcccaactggcgaagaaaggggtgcggttcaaggaaccgcagcggtacaaaggtctcggtgagatggacgcttcccaactcaaggagacgacgatggacccgcgccatcgcactctgcgtcgcatcacc

SEQ ID NO: 623504 - DNA, 175 bp, Homo sapiens
caacgaggcttataatgtgcaaggcaatatcagtctaaggtatcatgacttcagttattctctcataaaacacagatgaaatacaatgtatgacattcccaaagagggagttcctcatgtgattcatacttaaaatgcgcaaggtcctggtcgatctcaaggtaaacaattaact

SEQ ID NO: 623505 - DNA, 802 bp, Homo sapiens
tggagatggagctcctctagtttctgtgtgcccaggctggagttgcagcgggtgtgatacgggcctcactgcacccgtgtcctccggggtccaacgctattctccgtgcctcagccttcccgtgtaggtgggatcacgggtgcttaccacgccgtggttaatttgggatatttccgggtaggagacggcggttcctcccccatgtgttgggccactccgggctctttgaactttcttgaccccaaatgtgattctgcctgccttgggcctttcccaaaggtgtgtggggatttacagggcgtgagccatgtgcgcccagcctttgaggtacgcatactttcttgaaattaaaaacgtagattattgtccgaagcagttgacctaaaaacgtgccttggactgacatttggtcagggggtcataagagtgtccctcttcacgcttggcaaaaaatgtgagcttttgggagctttaatttaagcatccctcgtggtgtgtcggcgtttttaagccaccaaaattttcccaattttgataacctgtcccgtgtaagttcagaaagccttgggtcttactgggcgactgggggggtcattgggtcatacatataaggtccttttctaacaaaatttttggccaggtatcctcccaaatatttgcccccttcaatgggtttcctctcaagggtgacagtttgtgtggccaaacccgtgcacagggaagtgccctgcccgtgggttctacgaccaatgttgggggacctgttgtatcacccaccaaagttatcctttttgcccaaaag

SEQ ID NO: 623506 - DNA, 399 bp, Homo sapiens
gtcgaccaagatgcaaggaacagtacgccccatgaactgtctggcgcgcttgctattcaaaggtgcagagcgccgggttggtcgccttgcactcattgcccgtccaagcaccgccgaccggcttggcattgaccgggtttttcagggtcatgctcaccggctcatggttctgatccaggtagtggcatgccaccgacgactgaccctggctgctttggatcaccgccttttcgaagtggacctggtgcaggtctttctgctctgtcatcgggttttgcccggtccattgctggccgcccgggcggacgcggtgtaggcgaccacttccccggtcggcgtctttttgaacgcgtctttaagggcatcggtgggcgggcaggcggcagtaccggcgtaggc

SEQ ID NO: 623507 - DNA, 1237 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1093)..(1093): n is a, c, g, or t
  misc_feature (1122)..(1123): n is a, c, g, or t
  misc_feature (1129)..(1131): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtgcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623508 - DNA, 358 bp, Homo sapiens
  misc_feature (4)..(4): n is a, c, g, or t
  misc_feature (35)..(35): n is a, c, g, or t
  misc_feature (42)..(42): n is a, c, g, or t
  misc_feature (338)..(338): n is a, c, g, or t
gggnccaagaccttaaaaaatccttggggggttanccccccnggattcaagacaaaagctcactttcccctaacccagtcacaaatcaggagaatttttgaattcccaccctatgaccctgtgaagctccctgcttcaaagatattcccacccttttttagggcccaaacccaatgtataacctcccaagtgtcgatttacactttcgactgtaacttctgctttcctgagatttacccctgcctttaaaaacccttgcttgtaatccctcagggaggccgtgtatttattaatcatgagctgcccaattctccttgcttggtgccctgcaaataaanaccctcttttctcccactgc

SEQ ID NO: 623509 - DNA, 1914 bp, Homo sapiens
  misc_feature (921)..(921): n is a, c, g, or t
tttgtgtgtgttttgttcgcctcccccgatgtggttctcctcgttccctgatgagtgtgtggtgtgcgtctccccctacatctttggtggggggtgttggatgccctcctccttccgatatgtcttgtttgatgttgtcggcagctctcttcccatgctgtgttttttgttatcgagtgtgttgttctgaggcttgcttgtgtggtggcgagggatggcacgccggtcgtctggtgtgtgttgtggcgttggcgccgcccgcggctggtgtgtgtgggggggtggtcacctccgcctgcattgcgtcgtgatcagtgactactgttgttcgcatgagagtccattatgggccgtcgtgcaaaacagttcttagtgtcctgtctgtgtagatgaatgaataagttgggtgggggggaggtgggtgcccgcacccccccctccctaccgcggcgggtaggtagttgtgttgtcactccccacgcaaacaggggggtgggtagcagcgacaccaccaacacgacgttttgtgaggtgtgggggtgtttgtcgcagacgagatatgtatcgatcattctattctgcataactaccgtatggttttggctacgcagatcagcagaatgtgggtgtgtggagaagtgctgttgctccagcccgctttaatgagtctcttgtgagtgggggcacgcccgttgcgttggtggccgagcaaccttagatgggcgtcgttgtcgtcctcaccatcgagccacttttgtggtgtccacacacacaacaactgagcctaccgttggcctgtcacaacacgcgccccaccatagaaagccccgcgcggcggggggtttttttcttaatacagaatgaggctggttagtaatagggaggaagtgatatgtgggcggcgatgggaagatagtgggncgtgtgatagatgattaggtattattgtagcctgcgtgacgcaggcttgcaacatacagctttctgcgtaggagatatcagttcgtctaccttcgtccatcaagcaccaaccaccagctgctgcatgcgggcacacacccttctgttagaatgaggggcggaggatatatggataggggcgcgcgatgaaaagaagaggtgaggaggtacttgaggccacttcttttgtagggaggaggggccaccacccacgacgtgcttgtccataactcgtcgcgccaacggctcttattgtaggagattgagacccacactcgttgtcaccacacctctgtgtttgtccaccaccactactgttgtcctcttctcgcgcctcatcttatgtggtggcgacgtctaatttgacgacccccagcctcgtgtggtatgtcgtgtgcaccccactggggcgttatttggcacactcggggtcccacccactggtgtgggagcgtcgtggggtgcgtcgcacacacacacacactctctacacgcgctcacacactcggggctccacatcgccgtggtgagagaaacgagcgaggtgatatatttggagaagagagatgcgctctgagaagtgtctcgcgcgcttcttcacactttgtccacgcagatatagagacaccacacactcttcgtgtcacctctgtgtgggcgatatatagaatagtgtggagaagactcgcgttgttcacgccacacggagccacacccacctcgaggagaagaagagagattctaagacacacgcgtgggcactaaattgccacaggggcacctctcctcgcgcctcggagagaaagagccctttaacaccaccaccacccaccaccactacaccaccaccaccacctcccccccacatatccccgttttcacccagcccctggatgcattctcatggcccactgtcatgtttctattaataaagatttgttgatctgttcccca

SEQ ID NO: 623510 - DNA, 1374 bp, Homo sapiens
  misc_feature (1230)..(1230): n is a, c, g, or t
  misc_feature (1259)..(1260): n is a, c, g, or t
  misc_feature (1266)..(1268): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623511 - DNA, 112 bp, Homo sapiens
cgagtggagatggcgtctacataccggtatggtgggtcactttgctccagtcaacgttacgacggcagttaaatctgtcgtaatgcacatgaagctttgagtgaagctcttc

SEQ ID NO: 623512 - DNA, 1101 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (957)..(957): n is a, c, g, or t
  misc_feature (986)..(987): n is a, c, g, or t
  misc_feature (993)..(995): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623513 - DNA, 1091 bp, Homo sapiens
  misc_feature (947)..(947): n is a, c, g, or t
  misc_feature (976)..(977): n is a, c, g, or t
  misc_feature (983)..(985): n is a, c, g, or t
gaaggaggacgtaggagcagcatagcagcgtgcagcgagagatggattgtgtggcatgcaacatagggttccttgactggagacgtacggacgagaccttgcgtccagtgagctacgccggggggcgtattctggcattccctgctgcccggtggcacctggaagcgtcttgcatatacatcgtggatgagtggatggtcgggtaccgcaatcgatctgtgagtcgaatttcgtggagagacgctctgactgcagtaggcgtctactcatcatgatgccaggcaaagacactggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623514 - DNA, 1089 bp, Homo sapiens
  misc_feature (945)..(945): n is a, c, g, or t
  misc_feature (974)..(975): n is a, c, g, or t
  misc_feature (981)..(983): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaacactgcggagcatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623515 - DNA, 1505 bp, Homo sapiens
  misc_feature (776)..(776): n is a, c, g, or t
  misc_feature (1361)..(1361): n is a, c, g, or t
  misc_feature (1390)..(1391): n is a, c, g, or t
  misc_feature (1397)..(1399): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccaggtgtgtgtgtgtgggtgaaacagagtgggctgtctccctcccagggctgctgggaggagtgtccgaatggtggctatttgtcacctgtaaagcactgttcctcattggctgccagctgactgcccctctcctattcccctgcacgacttctttccttcccaccccantgccaagctgctgggctcagctgagtccacgtcactacctggtggcttctgactctagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623516 - DNA, 207 bp, Homo sapiens
gccaccagtggtcatcgcctcttcaggttgttttctgatgtcctgcccttagtgttgccttcttaccagtcgctgtggctccatgcagactgcgggtccgtcttcgccgccctctccattaaacccgttaacatgctggctcctcttctgcttcacatggtgctttaccagattcttcagcacccagtaacagcaggcggtgcgctg

SEQ ID NO: 623517 - DNA, 341 bp, Homo sapiens
ctctcacggattactcaacatcaggcatctcataggaaaggttaaaaaaagtaaaagtgaactcgcgcaaatcttaccccgcctgtttaccacagaacatcacctctagcatcaccagtattagagagcaccgtctgcccagtgagccaagattacaccatctgcaccccagcattggcgacaaagtgaggccatctcaaaaaaaaaaaaaaatagcatactgtttaccctctaccaaagattgctcgtaaggtaccgcaatcatacctacagttatcataggcgtctcctagacccttgtgcgagtagccatggatcctcttgtttcaacctgttcgcat

SEQ ID NO: 623518 - DNA, 1276 bp, Homo sapiens
  misc_feature (1132)..(1132): n is a, c, g, or t
  misc_feature (1161)..(1162): n is a, c, g, or t
  misc_feature (1168)..(1170): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623519 - DNA, 1702 bp, Homo sapiens
taaaaaacacagagctttattattctcaacaccaagggcaggggtcttcataggacaaaggaggtgatgttctggtcaacaagacagggcgggcccctattggccgggcagatagacgcgggtgtccccgcagggaccacagatagactggagtctccctcgcgcaggagaactttctgggaagattgtacgcgggtctttggtggagactggggctgtgtgagaatatctctcttcttgtggccctgtggccacactctctgtgggggatccctctcaggctcacaacacttctctctcttctcaggtgtctctctcacaggacaccccgtgtgtgtgtgccaggggtgcctactatctccagaggggggccctttcaccgggcgggccccgagggagagtattctcttatgagtgtgagtgtgcgcgggcacagagtgtgacagtgacacacacactgtgtgtgggtctttagtgtggtgtctcctgtgaagagcgtcgacagcgtgtgtgtgtgaaagccccaccgagagagagagtgtggaccacgccgggtgttgttacacaattcctcctctactcacttctctctctgctgcggcttctgctgtgcgcggagctctccctctgccgtgaggagaggcgtccctactctctccacaactctctgtgttgggggcctgatgtgtggtgagagagagagaggggctctcccagtgagagtggtcgtcacactataaaggcctctctctcgcagtgtctcacactctccccgcgggttctccctctccccgcgcagtgtgcggcagtgtctctcaaccccaacagacaacaccctgtgaaacagtctggtgggcccagagagtcgacagttgttgtttgccaacctggtgggaaacaacgcagtgtgttacgccccaaagttgagaaacaacaccccagcgggggcccaaggtggggtgcggagggtgcccgtgaaactctataagagagagccccctgtggggggccctccacgaaaaggggcgtgccctccgaggagaaaagggcccaactgcgcggagaaagagaaaaggcagcgtgcggagtccctccatgtaggggcgcctcattaaagaggggcgaggttgacagaacccccgctgtggagcgtgcgccggaaagggactacatgagaaaccttccttcaaaaagacaaggataacatcatgcggggagaggaaacaatccccgggagggggggggccctttggtaggcccgcgaaatgtgaaaccccccaatcagagcgagacgctggcggtgggaaacccccggttggctacagtatggtggtgcccccaaggtggcaaccccggggggacaacaacacattcggggggggcccccgaaaaaagagcgcgctcccacacaggggtgtgacccaccaagaggagagacggtgggcccacgaaaaaccctccgggggggagcgacccacccgcaagaaaaaatccgcgcggagcgtgggggggtggcgatacacaccaccccacccgacgaagaagagaatgtggcgtcaagaggagaacgcccgggaggtgggtacaaccacatcgatttgtgtcacgcaccaaccgtgacgatgaaaatgagatagcgaaacgaccaaacccaacacaagcaagtgtcaagttcgtcccgacgtcatgaggagagggcgca

SEQ ID NO: 623520 - DNA, 1353 bp, Homo sapiens
  misc_feature (1209)..(1209): n is a, c, g, or t
  misc_feature (1238)..(1239): n is a, c, g, or t
  misc_feature (1245)..(1247): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaaccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623521 - DNA, 1223 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1079)..(1079): n is a, c, g, or t
  misc_feature (1108)..(1109): n is a, c, g, or t
  misc_feature (1115)..(1117): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggcatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623522 - DNA, 769 bp, Homo sapiens
  misc_feature (625)..(625): n is a, c, g, or t
  misc_feature (654)..(655): n is a, c, g, or t
  misc_feature (661)..(663): n is a, c, g, or t
ctatcttcatgatgtagcagcaggtcgcaggggctggcttgtaggcgcatcagagtgctggtagtcatacaccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaaccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623523 - DNA, 408 bp, Homo sapiens
tttttccgggggttgacccgggcccggtttttggggggttaaagggggaaggggggaagggccccctttttttccccgtttgggggggggccggggggggaccccccaagttcctttttttcacccattgggggggggggtttttttcctttccttccgggggcaaaattccgggggggggtgttccttttggggggcccgggtttttttgggggaaaattttttttttttttccccttgtgggggtttttccttttccccccccccagttttggggccaatttttccggttccccccttgggttttccctttttttttttgggtggggcttttttccggggcccaggggccccccgctttgttttgttttcccggcccctttttttttccttggttttaaggtggga

SEQ ID NO: 623524 - DNA, 288 bp, Homo sapiens
ctctgcgctgacggtcgctatcgatatctgcgtggctagtactcacagatcgagctgactgcttgaagctaggccgggcgtgtgatgacaagggcgtgaccggggacgcgacgacatgttccggcgcggaggtctcgctgcggatgtggatcacggtggacatcggggtagcagagtagttggggcgcccccagcatagccacttcctgctcctccttgagcatctcgtagtagggaggctggccgcatgttgacaggagagaaggtttgcccaaatgtggttcatgg

SEQ ID NO: 623525 - DNA, 419 bp, Homo sapiens
gtgacctttatttcccttctttatctctctagctcggcttataccaggggtgagtttcgttctagatgcccacagtgagtgagagtctgctcatgcacattcatgattcgtgactagacaattatatagccttggtgtagatctgcctttgctcaatatcttcagcagtgtccatttgaagatcatgtagaattactgaatgaagtatctgaatttgcacagtcatgtgttgctgatgagtcgcctgtgagttgtgacaaatcacttcgtaccctttctggagactagagtatgctcagttgcctctcttcgagcctatggagatacggctgactgctgtgcgaatactgcctgagagatgtgagtgctattggtgacactgagatgaccacccatgcctgccccgattggtgagaccg

SEQ ID NO: 623526 - DNA, 124 bp, Homo sapiens
gaattcggcaccgagggttttgcatttgcctttagaaaaaaaaaattgaattcaataacataacctcgtgatggtagaatggcatggaattatgccagatgtttgcctttgcctgaaacatcat

SEQ ID NO: 623527 - DNA, 157 bp, Homo sapiens
tttcattgggtacgggccccccctcgtgccgaatttagtttcattaggatgatgctatcaatattttcttggttacagacacattattaatagcatcatcctaatgaaactaaacatttattttaaacttattaaattgactcttaaactaaaaaaa

SEQ ID NO: 623528 - DNA, 504 bp, Homo sapiens
tcgcgggtgcgttcgatcacccgctgttccagggactcgttgagtttgcgcagggactcttcggcttcgcgcaggggcgtgatgtcccgggacacgcagaggattttttccggcaggccgtcactgcccatgatcgggctgacgttcacgtgccaccatttcaggttgccggccagggtgttggcggcgccgacaaagctggcgttgcgaccggccttggcggcatccacggcggccttggcgtcgagattgccctggtcttgccagaagtcgggccaaggacagccgcgaatcgcattgaagtcgctgacttccatgatctgcttgccgccttcgctcatgaaggtcaggcgggcgtccaggtccagcaccttgatgcagtcattgatgctggcaagcacgcgctcagtgaaggcttcactgtgagtgagcccgcggcggacaaatcactctcgccagattcaggtgggctatttgtatcggagcccttcccgatagtgctat

SEQ ID NO: 623529 - DNA, 925 bp, Homo sapiens
gtaggtctacaagacgctactatccccgtatcatataagagacttatcagcttgcatgatctcgcccatcataagcatttgcctgtatctgtttcctactccggtgtgcccgtttccgaacggtcatcaaggagagagcatagggtaagaactaacgaagcatcatcgacagcgcatcaggaagataggaagaacgtctcggagaacggtatgcggcccgacaatgagtctcgttagtgtccatcattgggcccgtcccatcgcgtacgtcattcctttatcgactaagagatcgaggctcgagcatcccgtcccttaccggagcaaatcaaatgggcatcatcggtgaacgtgaacctacgagtacaccgactacggggactaatcttcaactcctacatacttcccccattattcctagaaccaggcgacctgcgactccttgacgttgacaattccgagtagtactcccgattgaagcccccattcgtataataattacagtcacaagacgtcttgcactcatgagcgtgtgcccacattaggcttaaaaacagatgcaatgcccggacgtctaaaccaaggcactttcaccgtacacgaccggggggtataactacggtcatgccgggaaaggcgtgtggagcaaaccaccagttcatgccatcgtctagattaatccctaaactttgaatagggccgattaccctatagaccccttaaccctctaagagcgaaaaaaaaaaaaaacaaaactggggggcgccgggccgaaaatcaaccacctgggcggccaggaagaaacggcaccggccggacaccggcggtgggggtcccaaaccgggcggcgggaaccggggcgctcggctcacgcgccaaccccgcgcggggagggggaagacgccgcgcgcgcgcacacactaca

SEQ ID NO: 623530 - DNA, 916 bp, Homo sapiens
taaggaagcaagaacaaaccaactccaaggctaacagaagacaagaaataaccaaaaatgaaagctgaactgtaggagattaagacacaagaaatcatgcaaaaaattataaacttaaggtaaaggggtggaaaaagatatcccatgaaaatggacaccataagcaagcaggaatagctattcttataacagacaaaacaaactttaaagcaacaggagtttaaaaagacataaaggaacattacataatgataaaagaacttgttcaacaggaaaatatcaccatcctaaatgtatatgcacctaacactggagttctcaaatttatacaacaattaccactagacctacctaaaaatgagatagacagcaatgcaataatagtgggaaagctcaaaattccactgacagcactagacagatcatcaagacagaaagccaacaaagaaacaatggttttaaactacaccctagaacaaatggacttaagagatatttacagaacattctatccaacaattacagaatatacattctattcatgagcacatggaacattctccaagacagaccatatgataggccacaaaagaagtctcaataagtttaagagaattgaaattatatcaagtactttctcaaacacagtggaataacattgggaaatcaattccaaaaggaaccctcaaaacatgtaatgctggaattaaataatctactcttgatgatcatgggctaacaatgacatccagaggaccacctacacactcattgaacggaaggataatacggacccaattattaaacccccgggataccgcaaaggcgagctaaagggaacgctattaccttaatgcctactcaaaaactcgaagagcccaatagaccacctaggttcccctcaggaactgagaac

SEQ ID NO: 623531 - DNA, 198 bp, Homo sapiens
gaccaatggcggatgagccggcagcggggggccggaggcctggtggcctgggatggggaccgcggtggcttccgcggaggtttcggcagtggcattcggggccagggggtcgcggccggtggacggggccgggggggcggcgggcggtggggtgctgggcgggggggtgggggggcgggggcctgggggccgggcggg

SEQ ID NO: 623532 - DNA, 1048 bp, Homo sapiens
ccttcgaaatgatccctactgattaaatcacatgagactggtcgccctaccacaaatccttggtcgtgtgcatccctgagtccctgactgagctatgttgctgatggtatcatatccaattctccggagcccctgcagcctggcacgtcgttggtgtcctcactgggctagcagttataccagaggcggtgaatccatctcgggaccttggaaccggcatggtagataaacatagtaatagtacggtctgattactatactaaccacacatcttatgtcgtcatgttctccatgaagcttccacattatcaatctaagtatttgactatatttgagtaccatccgtgtgtctagtgtaagagcacgagtactcctattatacctacgtcttcatgaaatttttaaggatgaacgggattaatcatgttgtgcgtaccattcttcaaatctcctggcatgacttttcgagggttcaaagaagacaactcgcgtcctagagtaagcagaaatgtattctgtaatgacttcctagcctgcacaagtaaaaacgagatacttgggtgaaacccggtcatgaagaacagagggcctccttaactgcatgcatgtctgacaaagtgatagatctgccctgtgtctacataatgtcttccatctggtcctgttccctcttaattcctgggaccggtccattgatgacgctagcattctgatggacagctgactagtgaagccgtgacttgtgtcacgtgcaggctatacttaaccggcccttatgacgtatttgcttggagcggcaaggtagacctgcatgtctggtatacggatcctgctgaaaagatgaatggcgacaggctgcaactaactaggacacggcaacaggcacgctaggagcgcacccgaaaggccagatatacacattgacaccccgttggcgaaggcgccccaattagagcagacataacacagaggctggggaccacaaaacaagtgaaggatcacaactacaaacgtgttaaattgaatacgccacacacagaagggaacc

SEQ ID NO: 623533 - DNA, 753 bp, Homo sapiens
  misc_feature (50)..(50): n is a, c, g, or t
  misc_feature (67)..(68): n is a, c, g, or t
  misc_feature (70)..(72): n is a, c, g, or t
  misc_feature (169)..(169): n is a, c, g, or t
  misc_feature (176)..(176): n is a, c, g, or t
  misc_feature (183)..(183): n is a, c, g, or t
  misc_feature (205)..(205): n is a, c, g, or t
  misc_feature (236)..(236): n is a, c, g, or t
  misc_feature (304)..(305): n is a, c, g, or t
  misc_feature (307)..(307): n is a, c, g, or t
  misc_feature (313)..(313): n is a, c, g, or t
  misc_feature (319)..(319): n is a, c, g, or t
  misc_feature (340)..(340): n is a, c, g, or t
  misc_feature (342)..(342): n is a, c, g, or t
  misc_feature (346)..(346): n is a, c, g, or t
  misc_feature (354)..(354): n is a, c, g, or t
  misc_feature (375)..(375): n is a, c, g, or t
  misc_feature (379)..(379): n is a, c, g, or t
  misc_feature (389)..(389): n is a, c, g, or t
  misc_feature (418)..(418): n is a, c, g, or t
  misc_feature (421)..(421): n is a, c, g, or t
  misc_feature (467)..(467): n is a, c, g, or t
  misc_feature (470)..(470): n is a, c, g, or t
  misc_feature (492)..(492): n is a, c, g, or t
  misc_feature (521)..(521): n is a, c, g, or t
  misc_feature (543)..(543): n is a, c, g, or t
  misc_feature (586)..(586): n is a, c, g, or t
  misc_feature (616)..(616): n is a, c, g, or t
  misc_feature (625)..(625): n is a, c, g, or t
  misc_feature (627)..(627): n is a, c, g, or t
  misc_feature (634)..(634): n is a, c, g, or t
  misc_feature (659)..(659): n is a, c, g, or t
  misc_feature (669)..(669): n is a, c, g, or t
  misc_feature (683)..(683): n is a, c, g, or t
  misc_feature (740)..(740): n is a, c, g, or t
gtactatcccctgcggcgcgagccggaggcggctccaagcgccccccagnagacccccatcatgggnngnnngagctccaaggctccccggggcgacgtgaccgccgaggaggcagcaggcgcttcccccgcgaaggccaaaggccaggagaatggccacgtgaaaagnaatgganaattatnccccaaagggtgaaggggagtngccccctgtgaacggaacagatgaggcagcnggggccactagagcgatgcaatcgagccaaaaccccctagccagggtgctgaggccaagggggaggtnncncccaangagaancccaagaagaagaagaaattntntttnaagaagcnttttaaattgagcggcctgtncttnaagagaaatnggaaggagggtgggggtgattcttctgcntcnctcacccacagaggaagaacaggagcagggggagatcggtgcctgnagngacgagggcactgctcaggaanggaaggccgcagccacccctgagagccangaaccccaggccaagggggcanaggctagtgcagcctcagaagaagaggcagggccccaggctanagagccatccactccctcggggccggagantggccctanancagccancgctgagcagaatgagtagctaggnaggggcaggngggtgatctctaanctgcaaaaactgtgctgtccttgtgaggtcactgcctggacctggtgccctggctgncttcctgtgccca

SEQ ID NO: 623534 - DNA, 144 bp, Homo sapiens
cataatatctgtctctcatctgaatattctatgcaccctaatactgcctctcgaaaatgcaactccctggtccagaaataatccatgtaacaatccttcatcaaaaaccaaatctgcacagatcatatagacatatacatccct

SEQ ID NO: 623535 - DNA, 782 bp, Homo sapiens
  misc_feature (311)..(311): n is a, c, g, or t
  misc_feature (340)..(340): n is a, c, g, or t
  misc_feature (363)..(363): n is a, c, g, or t
  misc_feature (396)..(397): n is a, c, g, or t
  misc_feature (401)..(401): n is a, c, g, or t
  misc_feature (421)..(421): n is a, c, g, or t
  misc_feature (434)..(435): n is a, c, g, or t
  misc_feature (437)..(437): n is a, c, g, or t
gggtgtacgcctcctgggtaacgggatcgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacgggtcttaggacctcgatctccttctccctcattttctctcatccctacctattgtgggtttccgcatgggccggaccgtggtcgtgctgggcggaggcatcagcggcttgtcntcagttaccacctgagccgggccccctgnccccctaaggtggtcctagtggngagcagtgagcgtctgggaggctggattcgctnngttngaggccctaatggtgctatntttgcacttgganntnggggaattaggccagcgggagccctaggggcccggaccttgcccctggtgagaggcttgttgggatgtctaggagaggttgtcgcgagggggcttccataggcggaatacagtcagggcgaggacagtatgtgaggctgggtcagatcttcccttagtttctcctcttctgagggcatgctgcgagagcacgcgcttctcgacgcttggcgttgggattcagaagtgctgcctgtccgggggagaacaggccaggtgcccagaaagaggttcctctacgtgggcgggtgccctgcgttgcgcctgccccctgggcctcagggggctactcccgcccctcacgcca

SEQ ID NO: 623536 - DNA, 508 bp, Homo sapiens
  misc_feature (311)..(311): n is a, c, g, or t
  misc_feature (340)..(340): n is a, c, g, or t
  misc_feature (363)..(363): n is a, c, g, or t
  misc_feature (396)..(397): n is a, c, g, or t
  misc_feature (401)..(401): n is a, c, g, or t
  misc_feature (421)..(421): n is a, c, g, or t
  misc_feature (434)..(435): n is a, c, g, or t
  misc_feature (437)..(437): n is a, c, g, or t
  misc_feature (476)..(476): n is a, c, g, or t
gggtgtacgcctcctgggtaacgggatcgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacgggtcttaggacctcgatctccttctccctcattttctctcatccctacctattgtgggtttccgcatgggccggaccgtggtcgtgctgggcggaggcatcagcggcttgtcntcagttaccacctgagccgggccccctgnccccctaaggtggtcctagtggngagcagtgagcgtctgggaggctggattcgctnngttngaggccctaatggtgctatntttgcacttgganntnggggaattagcgcaaagcacgcgcgcagaacatagcgcncgcacagcgcaaaatttgcaataaatgcgctt

SEQ ID NO: 623537 - DNA, 421 bp, Homo sapiens
acatgtcggggctgagagctagagttttatttatcactgttacaacaaactgatgtataacgaaagcatgtttattggaggacctgctcggtattgattcaactagcttacatgaggaatctcatgtattagcacgctgtcagatgagtaggatgcaaaaattatcttccattttgtaggttgcctgttcactctgatggtagtttcttttgctgtgcacaagctctttagtttaattagatcccatttgtcaattttggcttttgttgccattgcttttggtgttttagacatgaagtccttgcccatgcctatgccctgaatggcaatgcctacgttttcttctagggtttttatggttataggtctaatgtttaagtctttaatccatcttgaattaatttttgtataacgcgtaagg

SEQ ID NO: 623538 - DNA, 950 bp, Homo sapiens
cggagacgcgcgacatgggggccgccaggcgcgcgcgcgccgtaaaaatgggcgcacaagggcccggcggtggacaagcacagtagggggctcctcgtgagccgggcgggttcgaaactcatctctggggagggcgtagcacagcgcggtcgaagaaaaggcacagacgccgcgtggcgtactaccatggaagagagggcggcccctcggtcaggcatcgatgcaaccgagagggagtcgtaagctggcgggggcggcgcgagggcgggtgggtgcgtccacgggtagggacgcacgggcggagacaaacaagtgggtatacggcgcgcccgcttgtcgaagaggggggtcgtgaaacacacgcgggggggggaggcggcaccgccggtgggaacagcggtgccatgacaggcgccgcccacgaaggtggggaaagggaacaggccaaggccggggcctaagccaagtgcgaccatgagttcggggttgtcggttaagcaaggggagtcggaagccatcagaattgggtcgccgcgggggcaacgacatgccggtctgatactccgccttgtagggagacgcacccacaggcagggcgggggccacccggtgggaaagacccgtagatggaccccccccctggggggggcgagagcccaggtcggttgttacaccaaggagagcgggtggcttcccgtgcaccggactcgggagcaacactagggggctaaaacccggttgttgcgtcagccaaaagaagacgttagtcggtgcgagtcaggaggggggaaccaccggcagtaggcaccaattcactatgtccgacacccgagaaggggaggagtcgacctctgactacctggagaaggagaaagatggcagccggcgcgaggcagaaccccccccgtcctcccccggggggcacaaaaaaattctcgcccaaacatgac

SEQ ID NO: 623539 - DNA, 470 bp, Homo sapiens
gtccactgtagaccaagatgcctgagtgaacccacagatcgcaagaggcaccccgctcgttacgcggcggaggagggttgagaccgctgcgccgtatacagggtggaacatggctccagataagagctgatcaggagagatcatcgaatacgtgtgctacctcgaagcatagagagagtctttgctgagcagagcgtcaatttcgaacttcgatcagagtcgcgagtatgggtgcgaaacaatcgctgggtgatgaaggcagactgtgatcgagcatcgccaatgtagagactccagaacgtctgaggcagaccgggaggcctgacgagtagtgtcagacgcgtatgactagcgcgagacaaagacgacaggagtcggaagccatcgtcgacatagtatagttgggaataacatgggaacattcgtggaataggacgctaaaggccttgcatctatgcatccagaacaga

SEQ ID NO: 623540 - DNA, 567 bp, Homo sapiens
gcaagaaccagactagtgaatggtcccaacacatggatttgttcgctatcccaaggtgttaactggtctttttagacttgaggtcctgaaaaaataactgacaggtttgatccagatagaatcaattattgccctgaccggtagctgatggcatactcaacgggtctaactgaaggatgctacatgaagggactatatacagatgtgtgggcaggcatactgaacaagcgatggtgattcactgagggactgctggccctatgtttacaacagcctgagctgactgcagttactgaagcattgcactagctgtagctttgagagaggggtccccaccaggagccatggatgtagcagcaacacaggcaccaccaaaactgcacctggtcaaggagtggatttgtgaataacaaacaccacaacatctctcttctctaccttcaaaacgggtgttggaacccctgcgttggcctcgtgccacatttctgccgcccggctgatccactagttttagagcagtcaggcaccgcggggtgctgcacatttttgttcctatagtgagcgcat

SEQ ID NO: 623541 - DNA, 385 bp, Homo sapiens
ctatgacttagttgcgttatcctttcttgacaagacctaacttgcgcagaaaacaagatgagattggcatggctttatttgtttttttcgtttgttttggtttttttttttattttttgggcttgcctcaggattaaaaaacgggaagggtgaaggtgccagcagtcggtgggagcgagcatcccccaaagttcacacggtggccgaggacttggatggcacatggtgtgttttttttaatagtcatcccaaatatgagatgcttggtaacaggaagtcccttgccatcttaaaagccacccaatttctctctaaggagaatggcccagtcctctcccaagtccacacaggggaggtgatagcattgcttacgtgtacattatgt

SEQ ID NO: 623542 - DNA, 393 bp, Homo sapiens
ggtaaggtcggaaaggcggtcctgactatcgatccacgggtctgtctgctcagaatagcctaggggctgccggccaaccacacactcacgtccgagacactcagagttttcctacatatcagtgacaaccagggagaaaacgtcctttggaaagatgccactcataacggcctgcagggatttgacagatgctgctctctgggccggtgcggggcccacacggcacctccaggacctgtgcactgcatggcccatcacaactcaaggtcggggtggaccttgaactagagagaaaggtgagtagctcctcccttctgagggctgttacgggacaggaagtgcccgacaacctctgcctctatcctctgatgttttcattcatcccttctggct

SEQ ID NO: 623543 - DNA, 1033 bp, Homo sapiens
  misc_feature (12)..(13): n is a, c, g, or t
  misc_feature (73)..(74): n is a, c, g, or t
  misc_feature (241)..(241): n is a, c, g, or t
  misc_feature (247)..(247): n is a, c, g, or t
  misc_feature (796)..(796): n is a, c, g, or t
  misc_feature (831)..(831): n is a, c, g, or t
  misc_feature (856)..(856): n is a, c, g, or t
  misc_feature (1032)..(1032): n is a, c, g, or t
gagagtctgtanntgcaaccctggcggcgtccgagcccaaggcggagtctgggagacaaagaagtcctcgccnncggccgctggaggattctgccagtagtgaagtcagggatgggcccgagagagcttggaaagaggacaaggaagggaaggagtaggagtagaaaagcatgactttggctgggattacaggtgtgagttgccatgcctggccggttatctttctaaagcataaagcaancctgtngatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctctacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcagcgctgcacgcctgactggtttggtggagacggggtttcgctgtgttggccgggccggtctccagcccctaaccgcgagtgatccgccagctcggctcccgaggtgccgggattgcagacggatctcgttcactcagtgctcaatggtgcccaggctggagtgcagtggcgtgatctcggtcgntacaactacacctcccagccgctgcttggcctccnaaagtgccgagattgcagctctgcncggcgcaccccgtctgggaagtgaggagtgtctctgcctggccgcccatcgtctgggatgtgaggagccctctgcctggctgcccagtctggaaagtgaggagcgtctcgcccggccgccatcccatctaggaagtgaggagtgctttcccagcggcatcacatctaggaataagng

SEQ ID NO: 623544 - DNA, 627 bp, Homo sapiens
  misc_feature (12)..(13): n is a, c, g, or t
  misc_feature (73)..(74): n is a, c, g, or t
gagagtctgtanntgcaaccctggcggcgtccgagcccaaggcggagtctgggagacaaagaagtcctcgccnncggccgctggaggattctgccagtagtgaagtcagggatgggcccgagagagcttggaaagaggacaaggaagggaaggagtaggagtagaaaagcatgactttggctgggtatggtggctccgtgtcgtgtgatcccagcacgtttgggaggccaaggtgggggaggatcacgttgagcccattggagttcgataccgatgccgtgggcaacatagtgagagcccgatatttatctttattcagacttgatttcctgagatggagtcttgctctgtccccagtgctggagtgcagtggcagcgagtctcgagctcactgcaaaggtccggctcccgggttcaagacaagttgatcctggccgtcagacgtcccgaagtagcatgagattacaggcgcaccgtctaccaatgacccggataaagttggaagtcttatagaaggacgagaaggggttacacctcatgttgggccatggcatggatctcagaactcctgaccttgtgcatactgcctgcctcaagactcccaaagtgctgggataacaggcctga

SEQ ID NO: 623545 - DNA, 136 bp, Homo sapiens
attgcaccaggacattgagtgccagagattaagaaactgactacaaggcccggcacggtggctcatgcctgtaatcccaacactttgggaggctgaggcaggtggatcacttgaggccaggagtttgagacaagac

SEQ ID NO: 623546 - DNA, 1712 bp, Homo sapiens
  misc_feature (776)..(776): n is a, c, g, or t
  misc_feature (1568)..(1568): n is a, c, g, or t
  misc_feature (1597)..(1598): n is a, c, g, or t
  misc_feature (1604)..(1606): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccaggtgtgtgtgtgtgggtgaaacagagtgggctgtctccctcccagggctgctgggaggagtgtccgaatggtggctatttgtcacctgtaaagcactgttcctcattggctgccagctgactgcccctctcctattcccctgcacgacttctttccttcccaccccantgccaagctgctgggctcagctgagtccacgtcactacctggtggcttctgactctagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623547 - DNA, 1070 bp, Homo sapiens
  misc_feature (926)..(926): n is a, c, g, or t
  misc_feature (955)..(956): n is a, c, g, or t
  misc_feature (962)..(964): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaaccaggccaagcccgcagtgcctacgtctaagccaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623548 - DNA, 341 bp, Homo sapiens
agtgaaagaaagaaagaaagaaagaaagaaaaaaaagacagacaggaaggaagaaaggaaagaaagaaagaaaagggcagaagcaggaagcggggtcttggtgaggaggaaagaaagaaagaaagaaagaaagaaaaaaaagacagacaggaaggaagaaaggaaagaaagaaagaaaagggcagaagcaggaagcgcttcctgcttctgcctgcttcagggtcttggtgatgtggtgggggaaggcttgtgagcactgatcaggcacagtctccgctgggattgtgggcttggctgggactgccgtagggatgttgtgattcctccctgatacattgtcc

SEQ ID NO: 623549 - DNA, 662 bp, Homo sapiens
  misc_feature (18)..(18): n is a, c, g, or t
cgtgggctacccacgcgntcggatgcaggtggccctggccaatgtgcgatgtgcctgcgcgtggccaccatggccacggactgatgctggccaccaagcttgatgccggcggcttgcagatggatgggctgagggctggcggctgagaccccggagcagcccgggctgaacggtggcagctggcggctgtgtggctgggggcacccgacgagtgcgtgccgaggcgctggtgcattgcgcggactgctgagctgagctgccaagcttgctgcggcgcgcagacctcaaccagggcatcgtgcgagccccagtcgcccagccgccgcgtcttcaacccctacaccgagttcaaggagttctccaggaagcagatcaaggacatggagaagatgttcaagcagtatgatgccgggcgggacggcttcatcgaccctgatggagctaaaactcatgatggcagaaactttggcggcccctcagacccacctgggcctgaaaaacattgatcaaggacggtggatgaggactttgacagcaagctgagcttccgggagggtccaggccatcaacgttgtcagccgcttcgaggaggagatcaaggcagagcaggcggaacaggaagaagcaggcggcagcgagatgaagcagcggaaagcggcctc

SEQ ID NO: 623550 - DNA, 1483 bp, Homo sapiens
  misc_feature (1339)..(1339): n is a, c, g, or t
  misc_feature (1368)..(1369): n is a, c, g, or t
  misc_feature (1375)..(1377): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623551 - DNA, 180 bp, Homo sapiens
agcaccctccgcaccattgaggatgttgcctacatgctctgcttctctgcgacgggcctctttgacccttaccaaacctggtggctgccagagcactgaggaagtcatcagctccaaggagaagagcaaatacaagttccctcctgctgctttgccccaggaattccgctgccttcttcc

SEQ ID NO: 623552 - DNA, 650 bp, Homo sapiens
  misc_feature (506)..(506): n is a, c, g, or t
  misc_feature (535)..(536): n is a, c, g, or t
  misc_feature (542)..(544): n is a, c, g, or t
tagctcggcccggttgcaactgaacaccggctctgaggcagcattctcccccagtttttcagccgtaattagtacaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623553 - DNA, 483 bp, Homo sapiens
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccgcgatcgaagtgtgggagccggct

SEQ ID NO: 623554 - DNA, 425 bp, Homo sapiens
  misc_feature (84)..(84): n is a, c, g, or t
  misc_feature (139)..(139): n is a, c, g, or t
  misc_feature (168)..(168): n is a, c, g, or t
  misc_feature (243)..(243): n is a, c, g, or t
  misc_feature (265)..(265): n is a, c, g, or t
  misc_feature (267)..(267): n is a, c, g, or t
  misc_feature (277)..(277): n is a, c, g, or t
  misc_feature (312)..(312): n is a, c, g, or t
  misc_feature (390)..(390): n is a, c, g, or t
gttacaaccggtgcaatcttccggtgccacctgcaagacatatttctgcccgcgcatatcacgcgatttcacatccagcgaatnaggctggcaggggcgttttccatcgcttcaggcggcaccacttttgcgcgaatanctgagtgtgggcaagcggcaaccagtggnttacattgggtacagagttcctctttccagatggggatctcttcggcgatattgcgtttttcccagcgcgtagtnccatcggccaggtgccgtctgngnaacgccgaanaccggggagggcgtcaccaagcccggcgagcatcnaagccggttacggttttcacgaaatcaggggcggcatcggaaaccactggcggtcgattggcgctgttggaatttacnggttgcaacggaacttcttctacggattcacgcgc

SEQ ID NO: 623555 - DNA, 1322 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1178)..(1178): n is a, c, g, or t
  misc_feature (1207)..(1208): n is a, c, g, or t
  misc_feature (1214)..(1216): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623556 - DNA, 818 bp, Homo sapiens
gctggctactaagggaactatgggaggatcccacctcaggccttcgtgactagtgagtgtgcgcaaacgtcccgagttttcccgtgtgtgcgcgggttccggccgtttgcggtgccctccacccttcctggtgtctgaccgcgcctccttcccaggccttgttgttcctgtcccggatacagccggcgtcctgccgcgcgatgcccctgctcggacttcttcccaggaggtgcctggtgcttcgctgctcagccagcgtacctgtcgaccgtccctgtcgcttactgtgcaccgggtgcggtccgttgccataagccaggttgcagaggcagtgttaacatcccaagtgaaagcacatcaagatgaataccaaatttctattactcaatgaccccaacatgggtaccagggatcttatgtcctcagcactactggtatgtgaggcgagaaaacttcttgatctcttggtttagtcggctagcttgtaaagccgtacacttggtacgccacaagggtgactcgggaccaacgcgcaccagtctatatttgcacgcatgatacgtgaaagccccgttgaactggaatgcaagtaagttgtgcatggggggacctcctgggaggcatctatgggttacttgcaatgctcgagatgggaatcctacaggggtgggcataacgcaattgctagggttcctcgttcccaggctattgggaccttcaaactatgtaaacgccctatttgtccccaggcttcatctttgggccattcgaaattgacccggttgaaggcatacctatcggaattacgttaaataaac

SEQ ID NO: 623557 - DNA, 1122 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccccaacgggaaaggaaacgccccgggcaaagggtcttttgcagcttttgcagacgggcaagaagctgcttctgcccacaccgcagggtgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcccctgtgtggcgaggggcggtcttataattagagctcccgtgagcaggtcagtggaaacccagggattccgccaaacggataagcctgtgaaacaaaaaagaaaaaaaaaattggctcgcgcgaaattaacattgggcggcccaaaaaaatggagcccaaacgggaaggggtccacaagcggggggaaaaagtgtggtaacccaaccccggg

SEQ ID NO: 623558 - DNA, 558 bp, Homo sapiens
  misc_feature (91)..(91): n is a, c, g, or t
  misc_feature (93)..(95): n is a, c, g, or t
  misc_feature (98)..(98): n is a, c, g, or t
  misc_feature (104)..(104): n is a, c, g, or t
  misc_feature (109)..(109): n is a, c, g, or t
  misc_feature (112)..(112): n is a, c, g, or t
  misc_feature (137)..(137): n is a, c, g, or t
  misc_feature (146)..(146): n is a, c, g, or t
  misc_feature (153)..(153): n is a, c, g, or t
  misc_feature (164)..(164): n is a, c, g, or t
  misc_feature (171)..(171): n is a, c, g, or t
  misc_feature (178)..(178): n is a, c, g, or t
  misc_feature (182)..(183): n is a, c, g, or t
  misc_feature (202)..(202): n is a, c, g, or t
  misc_feature (237)..(237): n is a, c, g, or t
  misc_feature (248)..(248): n is a, c, g, or t
  misc_feature (263)..(263): n is a, c, g, or t
  misc_feature (273)..(273): n is a, c, g, or t
  misc_feature (311)..(311): n is a, c, g, or t
  misc_feature (323)..(323): n is a, c, g, or t
  misc_feature (339)..(339): n is a, c, g, or t
  misc_feature (351)..(351): n is a, c, g, or t
  misc_feature (365)..(365): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (428)..(428): n is a, c, g, or t
  misc_feature (544)..(544): n is a, c, g, or t
agctaccctcagctctagctgatactacagacagtacaacagatcaagaagtatggcagtgacaactcgtttgacattgttgcatgaaaanannntgnaaaatnatttntgnggtaagtggcttagctttctttatnatggtagtntccatgnattccgtaatngagtttngcttganagannttgtaatcaagggcctacnctaacagggatttatagtgaatattatattattgnagcatatgcanaagagagttatcagnaaggaaattntgcttccatcatctctttttgcactgttatagtatacnaaaatttcagantggaaattaggattangtactcctaganacacgtgtttttgntnatnggnaaaaaattgataagtaataataattggaaattgatctagccaatcaaagacaaantgcaggagccttttatacaaaagccaaaatatgcttagttagaaaaagtctaatttattgagtaaccaggagctacgggttttttcacaactttgaaagctcagctaactaatagnttatcccgtaggct

SEQ ID NO: 623559 - DNA, 917 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (773)..(773): n is a, c, g, or t
  misc_feature (802)..(803): n is a, c, g, or t
  misc_feature (809)..(811): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacgtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 623560 - DNA, 1032 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggtgagtgtggttgcgtgtgtgtatgtatgtgtgcgcgcgcacatgtgtgtgatgggccctgcctcctctatcctccctggcctgtttccttatccagatccattcactcaactaacctaggactgtgataagtcaggatggggacaccaagaccactaagccagggacccttggggagctgtttgtgggccaagagccactataggggtccgtagaaagggctgtccgtagacagccctgagtcagaagccatgagaaacttcagaagtcaggggacacttctcagagaaaaaccacatacgagctggagcccgaataaggaggagctcgcccggtggagaaggaggaaggcattccaggaaggagggagactctgtatcaccgcatggaggtgatcacttggggagagagaggggctgaccatggctgggggaagcagcagggagagacacggtgaagcaggctctcttgggtccctcaaaactagaccctgcttctaagcttctatgtgtctatgggtttgtgagaatccagggcacctcctccaagaagccttctctgatctcctcagaccttccctgtccatccatcgcgatcggctgtccagccctaggcagccgtgggagggtgttcagcttgtatacggagaacgaggggacagcctcatgtactcatgcctgtgtccttgctgcgcccaccggtcaggactactcccgcgtcccg

SEQ ID NO: 623561 - DNA, 380 bp, Homo sapiens
ggtgctctggaagaaggtcgcgccgaagctgtcagcgggccgggtgcagtcgtcgcgacccggatctcgtccagcgcgagcgcgaacgcatggcgttccgcagcgccggctactgggacgtcaccgctgagttggacgccagcgtgtccgatccggaagcgtctccgcccaagttcaccgccaagctcagcaccgtcgacggccgccgcgtcgccaccggccgggattttgactccctcggtgcggtcaagaagcccgacgaggtgctggtgctcgacgaggtggccgccggtgccctggccgccgggctgcgtggcgagtcgctgaccgtcagctcggtggagcagaagccctacacgcgcaagccctacgcgccgttc

SEQ ID NO: 623562 - DNA, 216 bp, Homo sapiens
  misc_feature (98)..(98): n is a, c, g, or t
  misc_feature (139)..(139): n is a, c, g, or t
gtatgatagttctatctcttctagttctctgagaaatctccacagccctctaaagaggttgcacaatttaccttcccaccgacagtgtataagactcntctcttctctacatccttgcaacatgtattgctcttgactnctaatagctattctgactgttgtgaaatggtattgtggcttaatttgcatttccctgatgattagtgatgttgagca

SEQ ID NO: 623563 - DNA, 580 bp, Homo sapiens
  misc_feature (4)..(4): n is a, c, g, or t
ttantgagcacgaatgtcgactgtctagtatccgctagggctggcgccgcagctgtgcgagcagttgccacagcagccttgtacgttggcgatcagcgacattctcaaggcgatcctcaaggatttcgccctgcgcgatgtcaatgcaccgcgcaccgacgccgacatccgcctggcccaggtgctggtggaccagctcaggcaggcgccggtccacgactgcttcctgccctacgcccgccacccgggattgcttggggtcttggagggcatgcaggcagagccgggagacaaccgccctctggcgcaatgggccgagcaggtgcatgtgagcgagcgcaccctggcgcgccagtttgtgcgcgagctgggcatgagctttggcgaatggcgccagcgcctgcgctacctggcggccatcgaggcgctggacagcgaaccgcagtgtgcaacacggtggcgttggatctgggctacagcaccgcctcggggttaatcgccatgtaccaacgccacgccggctgcacgccggagcaatatcggcggcggacattcgtggccgggaagttgtaacaggttt

SEQ ID NO: 623564 - DNA, 598 bp, Homo sapiens
  misc_feature (1)..(1): n is a, c, g, or t
ntcttatgtgtgtggcatgaagtaggaagagagttaggatccagtctgctctttccagagccctagatatggcttcgggcccctcagtgtggcctctaagtaagatgtggtcaaagatccagggtagctgcaatgcatggcagtagtagaatggaataggtgagcgggtttgaagatgaagtgacagaatgaacaatctagccagtagacgcatagcctaagtcatcaatggtaatccaggaggttaaacacaggaaaaggtaggaatagggtgccgtgaaaggttctccttgagacccccagggagaggtggggcacggcttgcctgttaatgcaatattagattgcggatgggactcgagagcacaaagttatccaggggatgatttatcagcctctcagcctgaacctgtagggttaaagagagaggagcgctagtcataaggaagagataccttacgttaagagccagaagttggggtttaatcccttatgtcagtgataacattgttctcgtgccatgtcagcttgtactacctaagtcagctcctgcgtgagcatgaactgagcctgccatacagtcgagaaccgtcaacag

SEQ ID NO: 623565 - DNA, 371 bp, Homo sapiens
actgtacatcgcccgcgcgggcataagaataatctgcttcttgctctcatcagtggatagctacgcccgagcagatgccaacacagccgccattcaagccatcctcataacaacgcgtatcgagagaatatcgagtttcatacctcgccttcagccatgcatttctcctcacactcccaagtcatgagacccacaacaactagcccttctaaacgctaatccaaagcctcaccccactactaggcctcctcctagcagcagcaggcaaatcagcccaattaggtctccacccctgactcccctcagccatagaaggcccaaccccagtctcagacctactccactcaagcactatagttgtagcaggaatc

SEQ ID NO: 623566 - DNA, 153 bp, Homo sapiens
tgtggtcagactggactgcctgggaagattcatgaatgggatgttcatcaaagcctctttgactaagtgactgctcaattaactgacttataaaggctccgaatatgaggcactaatgatcttctaaaattatacttctgtagaaaatgtagt

SEQ ID NO: 623567 - DNA, 325 bp, Homo sapiens
  misc_feature (9)..(9): n is a, c, g, or t
  misc_feature (117)..(118): n is a, c, g, or t
  misc_feature (182)..(182): n is a, c, g, or t
  misc_feature (214)..(214): n is a, c, g, or t
  misc_feature (273)..(273): n is a, c, g, or t
  misc_feature (295)..(295): n is a, c, g, or t
  misc_feature (302)..(302): n is a, c, g, or t
tctcggctnactgcaaactcccacttccccaggttcaagtgagcctccctccgcagcctcccgagtagctgagactagcggtgtgcgacaccacattcggctaatgttttgttttannttttcgtagagacagggtttcatctgttgcgcaggctggtctcaaactcctgagctcaagtganccgcccacctcggccccaaagggctggaatgncaggcgtgagccactgtgctcggccatgtccctgtggattctctctctccatatttagnataatcgatattaaaactgagnaattagnaagcgtatttatcaatcccttta

SEQ ID NO: 623568 - DNA, 176 bp, Homo sapiens
aattcaagcttctaacgatgtacggggacatgcgtggtggtacgtgactagtcccagctacttgggaggctgaggcaggagaatcgcttgaagtcaggaggcggaggttgccgtgagtcgagatagcgccgctgcactccagcctgggcgacagagctagaatgctgtcttaaaaa

SEQ ID NO: 623569 - DNA, 603 bp, Homo sapiens
cacaacatggactcgactcccaaagagctgggatgaggcatgacgcgcacccccagccacgtcaaagtttattaaagtttttgccaatgtgataaatgatatataattgttacttagttgcatttccctaatcagtagtaaggtttaaacatctatttatatcttatctaaagttttcgatatctgtggcattagtgcaagattccaaatatttatatgaatatttattgctttactgctagtctcctaagaaaattttattagcatatatagcagaatttgtataatatcagagagagaaacactaagttcgtttgtaattttcattaggaaaaataaatggcagtgccacaattctgtggacagagtacacaaagataagggactcagagacagaagcagtttgtcttcaagggttatacagcaagtcccctctgggccttgtagtgacagttgtcactattccattatccgagtgagaactcctggtttgtgagggtgggggctttgatttcttgttcatttctttgtcaaccctttttgagcccctgcagagggcactgaattggcatttgatttactgtgtactctctgagctatgga

SEQ ID NO: 623570 - DNA, 201 bp, Homo sapiens
accggggaaagtccaacggccctaaaggaaagtggggaattatatttaaaaacctcttttccccggcactttttcaaaaatttttcgggttgaaaaatttaaatgggcccgaattccgggggggttatttaaattaacccgatttccgggggggttttaaaacccggtaaccccccttaaaaaattaacctttttccaatt

SEQ ID NO: 623571 - DNA, 130 bp, Homo sapiens
cttctagctcggtaccccacaccacctgagtcgtaaattatggctgaatcatccgctaccttcacgccaatggcgcctcaagtgatgtgggcgattgatgaaaaggcggttgagggagtcaggtggtgtg

SEQ ID NO: 623572 - DNA, 983 bp, Homo sapiens
  misc_feature (779)..(779): n is a, c, g, or t
gacaggagaatcacttgagccaaggttgcaccactgcattccagcctgggcgacagagcgagactttgtctcaaaaaaaaagaaaaaagaaagttaaagttgctgtttgatatcattgtttttcttgagtgcagatggtgatgataataagttaaacttattcatgaacatttcctcgatgctttaggacccccgggggagggagctgagatactctgtcctcaccttactgatgaggaaactaagccatagaaaagcatcacctcctagggcacaaggacagaggctgcctctgggtcattcaaagtcttctgaaacatcacttttcttgactgcgcggcattgtgtccacctgcaagatgtggtagattgatgtaacttgacctgctggagattcgggtcctttgcagtttttcatcacggtgcatagtctgggtaatttcttctttaggttcacttccaagaagtggaatttgttcaggacagtgcgtgttttcacacagcttggagagtttgtcctccgtgttactttcctcaaaggttagaatgctcagactctcactttcatttgagttaactggggggaaaaaaaggttcaacaccagcttaattttttgtttacttttggagatggagtctcgctctgttacccaggctggagtgcagtggtgtgatctcggctcactacaacgctccacctcccgggttcaagcgattctcctgcctcggctcccggggagctggaattacaggggtgtggcaccatcccagctaatttngtgtgatagtggagatggggtttcaccacgtgggccaggctgtattttaagtagagatggggttttaccatgtgggcctggctggtctcgaactcctgacctcaggtgatccaccggctcacctcccagagtgctggggttgaaggcgtgcgccatcgcaaccgggcttcaggcttaagttttggtaacagcgatctaggaagg

SEQ ID NO: 623573 - DNA, 134 bp, Homo sapiens
taaacagaagagactgttgaatgtcaagtattatagacagtccagacaacacagggagacaccatctctacacacacacacacgcacacacacacacacacacattttttacacacacaccttactcgtacaca

SEQ ID NO: 623574 - DNA, 713 bp, Homo sapiens
gacaggagaatcacttgagccaaggttgcaccactgcattccagcctgggcgacagagcgagactttgtctcaaaaaaaaagaaaaaagaaagttaaagttgctgtttgatatcattgtttttcttgagtgcagatggtgatgataataagttaaacttattcatgaacatttcctcgatgctttaggacccccgggggagggagctgagatactctgtcctcaccttactgatgaggaaactaagccatagaaaagcatcacctcctagggcacaaggacagaggctgcctctgggtcattcaaagtcttctgaaacatcacttttcttgactgcgcggcattgtgtccacctgcaagatgtggtagattgatgtaacttgacctgctggagattcgggtcctttgcagtttttcatcacggtgcatagtctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtgcggcttcggctccaatgagatcctcaagcacgaagcacagagtgggcgctcgggcggaggtggttgaatgccgactgagctgaacaacaca

SEQ ID NO: 623575 - DNA, 641 bp, Homo sapiens
  misc_feature (310)..(310): n is a, c, g, or t
ttgatcgagccggcccgagttgatacaccatggatacgcagcctcatcgatagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaantcgggcgactgctgctgctcctgagggtgctggaccccctgctctgcgacttcattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtgcggcttcggctccaatgagatcctcaagcacgaagcacagagtgggcgctcgggcggaggtggttgaatgccgactgagctgaacaacaca

SEQ ID NO: 623576 - DNA, 229 bp, Homo sapiens
tgggtgactctagcagggctatatacacacacttcacaatctctggtaaattatatcagtcttcacctcaaaaggtattggtagttggtctacctgagattcgtgtcatagtccagaagtcacatgccggaaaactggggttgacagtatactgtaagactgactgtacaaagcttgatggggcacccattccatcactttatgctcttttcccctctccttgtaaggg

SEQ ID NO: 623577 - DNA, 242 bp, Homo sapiens
  misc_feature (155)..(155): n is a, c, g, or t
actgggtgctagatgacaggaaggacagctaatagaacccattgaagatcacaattccagccagacgtggtggctcacgcctgtaatccccgcattttgggaggcagaggcgggtggattgcttgaggccagaagtttgagaccagcctggccanaaaaagcaagaccctgtctcttctaaaaatataaaaaaacattagcagggaatggtgacatgcctgtagtcccagctacttgggagg

SEQ ID NO: 623578 - DNA, 939 bp, Homo sapiens
  misc_feature (926)..(927): n is a, c, g, or t
caagcttctgtacaatagactgcttctgtctagatctctcaactccgactttataaagcttatcagtcatcaattacgaggaatgtgaatttcttgctaatgcggaataaatggatattggcaggaactaccagcatacatgtggattattgtgattctggaggtggacggagtatttattttacaacatttatggtgatgttctaggtagatctgttgtagttggaattccagtcagtgttgtggctttcacattataatttgtatatttcttgtgatagaagggatgatgccaatatgtacttggagtgtctaccaggtttctgttaaaaccagggttgaatataatgaagccgaacattgtaagctacattgttgtctcattttagataatgattcagaagatttcagatatgatcattttttaactctttaactgcttaagctagatgtcgtacgattctgaggatagctctaagaaaattgaaaaattttctagggacttggtattttgcaaatccataattttgaatgtttggataccatttgtgatttacaagattgcacgaaaacgatttctattctcttagtgaaagaatgcaggtaaaggtggatatctggggctccacttctgacgagtcaactcgcatatagcctatgatcgccgaatctttgttagaaacgctttcgtaacgcgcctgggcgtcaccgtccttggcacgcctgcggtcccaccgccgtctggacctcggggtcgtgcggcatctcaacagaatatggggccacaaagcttcaccctctcatcgtgtccggcagatacaccccggacacaaacagcgtcaataagcgccaccacataaacaaccacttctcaataatttctcgtacacatacctttcctctacacacaacttccaattatcgannacaaaagccaac

SEQ ID NO: 623579 - DNA, 591 bp, Homo sapiens
gctctcatttctaaacagtagggacgtggccaggcacggatggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccttgctactcgggaggctgaggcaggagaaaggcatgaatccaagaggcagagcttgcagtgagctgagatcacgccattgcactccagcctgggcaacagtgttaagactctgtctccaatatcacataacataacataaactaaataaaataaataaactaaataccataaataaccaaacaaacagaaacccaacacaacacaggacgaacaaagagaagaagagaatgagaacaggaggagaaagacacagaaaaggacagagacgacaaacatacaaagcgaggtgaggagaacgaagcatagagagggacctccgcaaggaaggaggacgaacgaacatgaggacgagcgagccggtaaagcgatcgggaagcaaacagaggaggacacaaa

SEQ ID NO: 623580 - DNA, 162 bp, Homo sapiens
gaatgccagctggctcccgctcctttcctggggtaaaggtttgcagatgtctgcatcttctaacattgagccgtccggtcatactagttttgtgcttggaagcttgctgctcgatgctccctaagctgtagaacattttaagcgttgatgccctaacgcaga

SEQ ID NO: 623581 - DNA, 796 bp, Homo sapiens
  misc_feature (1)..(1): n is a, c, g, or t
  misc_feature (38)..(38): n is a, c, g, or t
  misc_feature (40)..(40): n is a, c, g, or t
  misc_feature (70)..(70): n is a, c, g, or t
  misc_feature (74)..(75): n is a, c, g, or t
  misc_feature (78)..(78): n is a, c, g, or t
  misc_feature (87)..(87): n is a, c, g, or t
  misc_feature (118)..(118): n is a, c, g, or t
  misc_feature (223)..(223): n is a, c, g, or t
  misc_feature (303)..(303): n is a, c, g, or t
  misc_feature (328)..(328): n is a, c, g, or t
  misc_feature (372)..(372): n is a, c, g, or t
  misc_feature (388)..(388): n is a, c, g, or t
  misc_feature (393)..(393): n is a, c, g, or t
  misc_feature (405)..(405): n is a, c, g, or t
  misc_feature (429)..(429): n is a, c, g, or t
  misc_feature (448)..(448): n is a, c, g, or t
  misc_feature (473)..(473): n is a, c, g, or t
  misc_feature (486)..(486): n is a, c, g, or t
  misc_feature (489)..(489): n is a, c, g, or t
  misc_feature (505)..(505): n is a, c, g, or t
  misc_feature (524)..(524): n is a, c, g, or t
  misc_feature (542)..(542): n is a, c, g, or t
  misc_feature (546)..(546): n is a, c, g, or t
  misc_feature (574)..(574): n is a, c, g, or t
  misc_feature (587)..(587): n is a, c, g, or t
  misc_feature (595)..(595): n is a, c, g, or t
  misc_feature (611)..(611): n is a, c, g, or t
  misc_feature (615)..(615): n is a, c, g, or t
  misc_feature (628)..(628): n is a, c, g, or t
  misc_feature (700)..(700): n is a, c, g, or t
  misc_feature (729)..(729): n is a, c, g, or t
  misc_feature (734)..(734): n is a, c, g, or t
  misc_feature (780)..(780): n is a, c, g, or t
nactcattttacattttatatttattgaaaatgaaatnanttactaagactctgcaggccccaccccaancagnnccnaggcctctncttggtctggtcccagttctttaagccccanaatggacaaccatgtgaagcagctcaggtcaactgcagggccacattcccacactgcaaacccctccacccaccctcaactcacacacaccctggatcagcaggnctaggctgaaagagagaacagtgaggttcccagggtggcaggtgggtatgacaggcaccataccccaacctgctcaaaancctaagttagcaaaggaagacagangactggcttgcctgcccattcccctccccccacccccaacagcngcctcacatccctgancagtnacactgtgattntgaggtgccaagaggaggggcttnaccagcccctgggtgattnctaccaaacggcccagaggccaganagagagggcaggnatntgccccactacctgcncagtattagccaagctgcngccttcagcttgtgcctnttgntgcctccagcccctctcccttccagaanaggtatggctggnaaccagtnctcctgacagaagaanttanttccaggaggtcntttctcccccagcctgggaggatgggttgtgacgcctgggacagatacacaagcttcttggcttcaaagaanatcttgaggtgtcgaatcttctagatacnatgcnacacgcagcgatggggctctgcagaatgcgaacaccacagcacccnatcgttgcgctgctct

SEQ ID NO: 623582 - DNA, 1429 bp, Homo sapiens
  misc_feature (238)..(238): n is a, c, g, or t
  misc_feature (371)..(371): n is a, c, g, or t
  misc_feature (377)..(377): n is a, c, g, or t
  misc_feature (381)..(381): n is a, c, g, or t
atctgcgtggctgtcttgcggcctcaacgagtcgttgccgtacagataaggggtgactaaatccacaatcaatggacatctgtgtccgacctgggaacaactgaacatgtgtgactgggaccttagtcaaccgtacaatcaagtaagaagccacattcccttcaaacgatcatttctcgaaaattgaagatcgggctcaacatcggccccgtggtggccggggtgataggggcacganagcctcagtacgacatctggggcaataccgtgaacgtggccagccgcatggacagcaccggtgtacccgaccgcatccaggtcaccacagacatgtaccaggtgctggctgccaacacgtaccagctggagtnccgggncgtngtcaaggtcaagggcaaaggcgagatgatgacctacttcctcaatggagggtccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggaaaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaacaagttctccgtgcccttctttagactatgctagttgtatgcgtgtaagagacacacaagcaaacgaggacgccactcggggggagggcggggatccccacttgtcttttttgtattttttattttgtattattgaaagccttggagatctcacagatagatatgccaaattctatattttgtaaattctctatattagaaaacagctgtgcacagcagggcgggtgtgctcatttgtactgtgtgtatgtcggtgtatgtactggtgtatatgtgtgtgtgttcatgctgtggaactggtctcacacaggatgtgttt

SEQ ID NO: 623583 - DNA, 943 bp, Homo sapiens
aaactggagggcttcaaggctctcatcgctgctcagtacagcggggctcaggtccggtgctctccgcacatcccacttccattttggccaaagcaatccgggagcccctgtaatttctccgataaatttcctgccggcaaggtcccagcattggagggtgatgatggattctgtgtgtttgagagcaacgccatgcctactatgtgagcaatgaggagctgcggggaagtactccagaggcagcagcccaggttggtgcatgtgtggtgagtcttgctgtagttccgatatagtgcccccagcacagtagctgggtgttgccccaccttgggcatcatgccaccagcgaacaaacaggtcactgagaatgcaaaggaggaagtgaggcgaattctggggctgttggatgcttacttgaagacgaggactttctgggtgggcgaacgagtgaacacttggctgagcatcacagttgtctgacccgtgtgtggtgtctataagtcaggttctagagctcttctttccgcagggctttcccaataccaagcgctggttcctcacgctgcattaagccagtcgcccagttccgggctgtcttgggcgaagtgaaactgtgtgagaagatggccagtctgatgctaaagaagtttgcagagaccaactagaaggaaaaacgagggagaagagaatggttccacgggaccgagaagcagaagcccaggctgaagcggagggcggagaaaaggggtgccctgctcctgggggtgatggtgaatgtgcaccgggctgggtgtgagtccaaagccagaaccttccgtcacctggcagagtacgttgtgttggtgaattaacggcagcccaagagacacactctgtgggcgccatttgggaacttgagggggggctctgggcacaaaaatccggaaatcactagaggaacggg

SEQ ID NO: 623584 - DNA, 1001 bp, Homo sapiens
  misc_feature (7)..(7): n is a, c, g, or t
  misc_feature (10)..(12): n is a, c, g, or t
  misc_feature (20)..(21): n is a, c, g, or t
  misc_feature (67)..(67): n is a, c, g, or t
  misc_feature (108)..(108): n is a, c, g, or t
gtgctcntgnnngccctccnnctggcatcgccctgcgcaccaacgcccaggaccagttcctgctgangcagcttgtctccaatgttctcattttctcctgcaccaacntcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaacaagttctccgtgcccttctttagactatgctagttgtatgcgtgtaagagacacacaagcaaacgaggacgccactcggggggagggcggggatccccacttgtcttttttgtattttttattttgtattattgaaagccttggagatctcacagatagatatgccaaattctatattttgtaaattctctatattagaaaacagctgtgcacagcagggcgggtgtgctcatttgtactgtgtgtatgtcggtgtatgtactggtgtatatgtgtgtgtgttcatgctgtggaactggtctcacacaggatgtgttt

SEQ ID NO: 623585 - DNA, 762 bp, Homo sapiens
ggcaccagggaagggcaaggttcatggagcatgggccttcgtctcatctacgacagcctcgaggaagtcgacacgagtatcgtggtacccatcctgcaagagccaacggcttggatcctgcaccacgtgtgtaaccagaggcatgtacaatgccaatcacgccggcatggtggtaaatcggagactgcttcccactgccatcatggcactttggaactgacggtatctagtgctttctaacccctctggtctgggggacctcgctgactcgtgcagagtatcaagtgatgatggacaagcgatgggaaaacagcccgtggtccagcttgccattgggaatatcctgggcagacgatgtacagggaatcgctactggaaggatgcatccactttgagggcattgccctaggtggagaaggccctgtcatggtccgcgtatggcgccatgcgcccacacagcatgacctccggccaccctccggtggatgtaccaccactcacagctgcagggtgcccacgggcacgcggtcatcatgggcacggtgccagcctggagcagctggagcagaacttggcagcggcagaggaagggccatggagtccggactgtcgtggacgccattaactcaagcgtggccatctggttgctcacgaatgtcccaactacttccgtctaggcccatcgtctctaaggctgcccaggctcttctgtgaatctttctactcacatttcttaatgagactgcctcagttatctaggaa

SEQ ID NO: 623586 - DNA, 610 bp, Homo sapiens
  misc_feature (7)..(7): n is a, c, g, or t
  misc_feature (10)..(12): n is a, c, g, or t
  misc_feature (20)..(21): n is a, c, g, or t
  misc_feature (67)..(67): n is a, c, g, or t
  misc_feature (108)..(108): n is a, c, g, or t
gtgctcntgnnngccctccnnctggcatcgccctgcgcaccaacgcccaggaccagttcctgctgangcagcttgtctccaatgttctcattttctcctgcaccaacntcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatgacatgatcgagccatctcgttggtccggactcgtcagagtggaccga

SEQ ID NO: 623587 - DNA, 1309 bp, Homo sapiens
  misc_feature (48)..(48): n is a, c, g, or t
  misc_feature (118)..(118): n is a, c, g, or t
  misc_feature (251)..(251): n is a, c, g, or t
  misc_feature (257)..(257): n is a, c, g, or t
  misc_feature (261)..(261): n is a, c, g, or t
tttgccatgaagctgatggaccagatgaagtacatcaatgagcactcnttcaacaacttccagatgaagatcgggctcaacatcggccccgtggtggccggggtgataggggcacganagcctcagtacgacatctggggcaataccgtgaacgtggccagccgcatggacagcaccggtgtacccgaccgcatccaggtcaccacagacatgtaccaggtgctggctgccaacacgtaccagctggagtnccgggncgtngtcaaggtcaagggcaaaggcgagatgatgacctacttcctcaatggagggtccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggaaaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaacaagttctccgtgcccttctttagactatgctagttgtatgcgtgtaagagacacacaagcaaacgaggacgccactcggggggagggcggggatccccacttgtcttttttgtattttttattttgtattattgaaagccttggagatctcacagatagatatgccaaattctatattttgtaaattctctatattagaaaacagctgtgcacagcagggcgggtgtgctcatttgtactgtgtgtatgtcggtgtatgtactggtgtatatgtgtgtgtgttcatgctgtggaactggtctcacacaggatgtgttt

SEQ ID NO: 623588 - DNA, 152 bp, Homo sapiens
gactcggacctgtcacagcttcctgatgtcccccagctagaatacccctaggatgtctactgaattctgagtcaaactttaagactcaaagtatgggccatgcatggtggcgcactgcctattatcccatcactttggtatggccaaggcag

SEQ ID NO: 623589 - DNA, 121 bp, Homo sapiens
acagaatatcacttgtcttatggtggtctatctctagaactcacgagcagtgagacaaatggacggatagggtgagatgctcacccaacaaagtgaagaagattttcagcaactcccaaga

SEQ ID NO: 623590 - DNA, 1353 bp, Homo sapiens
tccttctcttcttgggttagtctctcctgtgtgattttctccttcttgtggttggtcctcacaggtgagttcttcccctctccttctgcgggtggactttcttggtgctaacctatactgtgcttcggctcccttctaatattggttcgtagttcttctcacgaactctgttggccaacaaaaaggtgttttgtggggcgaccacacattagttttctctggttttttccacgaggtgtcctctaaggtgtttttttcttcctggtggccctctttctccttcttgtttgtttcaatagttctttgcgctctctttgtggtgcctcatttttttctctttgttgtttcctcgggcgttctatctactggggcctctcgttgtgcaccctctttcctctccacgctattggggggtttttcccccctcccccgcggtgttttttccgcggtttttcgtcccccctccctcttgttgtgcctcccgcgcctatgttgttttttgtgtgcggtttatttgtccttgtatttgtgggggctaaacacccgccccttctttgtggacgccaaaagccatttatttgtggccgcgcagtgtatcccccacggtggagcagtttgccgctcggcgcctttttattttgtagttttgctttgtgttttgtttctgttttctggcgtgtcttttttgttgtgtttttttgtgtgggcttggacatcccgcggaggtctttctaaaaactgtggcccgcgctcgtaagagtggcacaccacccgctccgcgctctgtgtgagccgccgaactcatctcctccccacagatgtgtccacacagatgtgtgccgctgagagagacatttgtgtgttgtctcgaacacacatgtgttgtgtttgttttcagaagaaatcttatctctcccaatatatatgagaagaggggttgtttcacacaggagaatatcccccttcccccactactcttttaaagccccccccactttttttcaaagggagaatatggcccacgccccttcttctcccacaggtctccacacaccgcgggagggggataaaccccatggtttttctgtgtgaaaaatatagagtggaacccacacaatttttttaatattttcccctaaaaatttttattattttgtttatatatttttgaaagagatgagagccctttggccccccctcttccccctttttgtccccccaccctgagagagagagtattgaaaggcttttggtgtttccccgggagagtgggggggggccccccggggttatccctttatccctgatttgtagacccctgtgtatatatataaagggccccccctccttata

SEQ ID NO: 623591 - DNA, 1370 bp, Homo sapiens
ccgcgggtgtgagtctgtacccgttgctgtctgtggtgcactctggttctccctgtttagtgcgccgcccgtcgcggtctttgtggtgttgttcgcactcttccctcaggagtatctctggtgtcctcgtgccgcccgtctttgtgctggagctggctcaacttgccgcgttgtgcgcgcttcttcagccggcggtgttggtccgcgacgcccgtttggggggctatcccccccgccttcgctttttttcttgtcaaaactgtacctgcctgcttatcgtaggtgctctgggcctgtgggggcccccccttgggggctcccccctttattgctgacccaccgttgaccgacagggtgtccttcttttttctggggggccgtttctgatcgtgtttgggggtttgggtaacgtctttcctactctcaccacgcatagggtcttcgtttggtgggtggggttcacccggctgtctggttgagatcacccgttggggttgccctgtgtctgtgcaccgcccactctgtcccagagtcctcttgtgggggaacacgcccaacctttcgagagagggttattggggggcccccatggtctcccgcccgtgttgtcctgggtgcctcgtagcgtcccgtgtcttttctcccccctttcgcacgagaccgtgccgtgtccggcgtggggacacctttctcccaccacggggggacccccctgggggcccccgcccccccagcggtggacacctgtggctccccggagaggactctctggactcttgtgtcccggtccccccgtctctttgctccaccacaatctgcccacctgtgcccaccagcgtgaccccccagcgcgtcttcccgcctcttgtcgggccttccacggttgttttctacaaatgcaccacaccctacgcgcacccaggccatgcacacgtggcacttgttccacagtgcgtttgtcggctttttgtgcttgttgagtggctaaccggttctgtacctgaggttctaaagaattcgctttgtcgggcacccactcgtttatcttatttcccgtggtcacataggtcaagcctttgcttctcttgcgtcggcgcacggtcgccactgcctgcgtcccctcgtcctttgttcccacgccaccgccacgggccactcccctcgtgatcgtcggccgacccggtctggacaccctcctgcacgagtaatgacgtgtgtggctgggacctctctcttattctcgtgctctgaatggcctacacccgttacacctggcgctgggttgggttgggttttctggcttttttcgctggggtttttatttttaaagaaaccctccaatcatccctaacaaaagaaaaacaaaaaaa

SEQ ID NO: 623592 - DNA, 1690 bp, Homo sapiens
aattctgtatccgtctgtggcttctctcctctggccgttttccctcacccttttgtggtgcttttgctctgtcctagcgtatcttctgtagcgtgccatgctattgctctggccagttgcttcatcctccatactttgcgttctcaatattacttggtgttgcgtgtgctctccatcaatcgattggctatccgctgtctctacgtctttctgtgttgttgcgagctgctttgtttatactctcccgctctctctcggtgtgcttccgtgctctgcttggtattgacctttgacttcactgactctcgttcgtcggtcgttttctgatattcgtctctccttgttacagtcgtttgctctctctcagtccgccggctttctccgttgtgtagcttcgcacttcgtcctgtctgctttcgctgtgtttgtcagctgccgttttgctgctctccgttcgagcgtgtgtgtctctgtgcactctgtttctctgtggcgtcgtgtgtggctgtcgtcttcctctgtcgtgtgtggtgtctcttcttttcgtctgtgctttgctctcgagtcgtcgggccgggtcgtttgtgtctgtggtgtggcgtgtgttgctcgtgtctttgtttgcggtggtcgttgtgtctcttttcgctttgtttatccttggggtttctttcgtctggtttccctttcctgtgtggttggtccgcgtttgtctgtctctgctgttctgtctcgtgtttctttctcgattctgtctctttctgtggcacgcttcgtccctgtcgcgcgctgctgttccggctggtttcgtcttctgtctctcgttttgggctgtcttgtctctgtctcggttctgctgtacctcgttcgtcgagttggagagacgctgtggcgtcttgcgctctcgtgctccttcgtgttctcttcccttcggcgcgctgtcgtgacgtgtagcctgtgggaggaagtgtgcgtggatggtctcttttgtgttgtgtcgcctctggtgcgttgctgacgggttccggcgtctctgcgcgcttctcgtgtctctctctgctctctcgctctctcgcggcgcctcgctgtctctccggctgtactaggcgagtgcgtaggagtagtggtgttcggcagccgcgctgccgtgcgcgctggtctctgtcatctctgacgctgctctgctcgcatcttgtctttctttcttctgtcctgctggccgattggtgcgaatgctgtccatcgttggttttctctctctctctctctctctctttcttgtgttccgttctttgctgtctcgttgtgctcttctcgcttcgcgctggatgctctctcttctctgctggttctctctctcgctcttctctcggctgttccctctctcgcgcttcctggtttctcttcttctttctttctcttcctctcttccttcctcctcttctctttcctacatcttatactgtcacggctccgcattctttttctttttcttttttcatatttacttcagccttttatctttcttttctttttcttctccgtttgtactcattgatattatcctatcacataatagatctactcaaaacacaatattttttaaataaaaaaattaacaaatcattttacaaaaataataaattaaaaaaaaatatataaataaaattaaaataaataaacaataata

SEQ ID NO: 623593 - DNA, 886 bp, Homo sapiens
ggctgtggccctggcgcggtctgggtccgtctcgtcgcgtcgggttgtcactctctcgggttgtactctgtagcttcccggctcgcgaaagggaggacctgtcgtgggctcagtggcattttgagaactcttttctcaaaaccccccacaagcccggccctcggaaaaaacggccacggcactctgacgaaagaattcgatgatgaacaatcagcctacagacagttgcacgaacaccacacacgcacgaagacatgcattaacacttggagttgcctgacgcaaaatttcccccagagagagcattttaagaaccacttcttgccaattattcaccaaaagagcgcttccgcgtgcaattcgcaaccacctccaccgaaagctaagcgcactactgactggtaactattcggtggactaatgaatcattctggcagtcggttggaatccagcacggattacgtttggtgccacaacgaagccttctcgccaggtacattagcaatagccccgcagaaaattgggccactctgcttgtcgtcacttccctgttgaacgaactcctacgaatcgacaccgacagtgggagttcacagggaataccgccccaacatgcgctcttgcctcaccgctcgccacaacactgcatcattcttacaacaggcattgtgttcccaacgcaatttgcgtcaaccgcagcaccacaacaccttccgcgccgctcagcatgcccctggcccccttggacaaccagcagtgatcccaggctgccttctgctagaggcacccgggcggcttcactcggcgcacgccaggcatgcgtccaagccttataggacaaatcccgctgcattcggcgctcggtgcatccctcactcccaaccac

SEQ ID NO: 623594 - DNA, 137 bp, Homo sapiens
ctcgagctcggaccatataagatacaatgcaaattaagtacagtagtgaacatttaaacagaacaagaaatcataccaagcactcttttcttcatttgtagtttggtatgatttcttgttctgtttaaatgttcact

SEQ ID NO: 623595 - DNA, 617 bp, Homo sapiens
aggatgtcagtcccaaggaccagtagctgccatcagttggattctgaaaactaactggccatcaacactgggtgtagaaacatgcttgccttatgtatcagaggacatgctcagcagatccaagagatatatttggcaactttttctagaaaaggcacattgggtatcattcattacattcttgagtttttgggtgttcattatttcgtgtcttcggaaacagtctggctgtatggcccaggctgcagtgtggtggccaccaatcacagttcatcggcatcctcaatcacccaggcctaagaatcctcccaccttgtttgctgggcactacagctcacagaaccaccgggctaaaattcatcaccaggtagaaacggattatctatgtagcccagggagggtaacaggctccggggctcaagatgtggtccctcggtggactcagtttccaaaaggccaagggacaagttggaaccttggacctttgcgatgttgcccaacagcaggtcatatacctttaaaggaatcgctttcacaactggttcattgccggcgaagtcttcacctgcaaatgaatgtcctcgaacgttccctgcattcctgatagttactaacgt

SEQ ID NO: 623596 - DNA, 853 bp, Homo sapiens
tacaccaccacagccccactctcagagagcacggacgccggacacgcacgagtcttcttgagagcaatggcgaccaccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaggccggctcccagatcttcagcgagggcggcctcgactacctcggcaaccccagcctggtccacgcgcagagcatcctcgccatctgggcctgccaggtcgtgctcatgggcgccgtcgaggggtaccgcgtcgccggcggcccgctcggcgagatcgtcgacccgctctaccccggcggcagcttcgaccccctgggccttgccgacgaccctgaggcgtcgcggagctcaaggtgaaggagatcaagaacggccgcctcgccatgttctccatgttcggcttcttcgtgcaggccatcgtcaccggcaagggccccctcgagaacctcgccgacactctccgacccgtcaacaacaacgcctgggccttcgcaccacttcgtgccgg

SEQ ID NO: 623597 - DNA, 459 bp, Homo sapiens
  misc_feature (186)..(186): n is a, c, g, or t
  misc_feature (229)..(229): n is a, c, g, or t
  misc_feature (232)..(232): n is a, c, g, or t
  misc_feature (243)..(243): n is a, c, g, or t
  misc_feature (264)..(264): n is a, c, g, or t
  misc_feature (267)..(267): n is a, c, g, or t
  misc_feature (279)..(279): n is a, c, g, or t
  misc_feature (296)..(296): n is a, c, g, or t
  misc_feature (301)..(301): n is a, c, g, or t
  misc_feature (308)..(308): n is a, c, g, or t
  misc_feature (314)..(314): n is a, c, g, or t
ctagaggatcccacgggaggtttggtgctgttcttcttcttcactgccttagccaccctgaccgtggccatcctcctgatcatggagggcctctcggcctttctccacgcactgcgcttacactgggttgagctacagaataaattctacagcgggaccggttacaagttcccacccttctccttngagcatattcgggaagggaagtttgaagagtgagtccctgtgnggnccgtgtgcccnatgctaccctccccgactccntcnacagtgatcagntgtgcctctcgcctgtngttgngatctgnggcacnagctcattcgtgtcaccctgtctgtgagtcatttacatagaatagccctccttgggtattccaccaaccatagctttgtgtgtcgtgcactgatattttggctgccactcatactgactgggcaccatacttgcccttttaggct

SEQ ID NO: 623598 - DNA, 776 bp, Homo sapiens
tatttttcctttgttttttaggaaacagagtttcgttctgtcgccaaggcaggagtgcagcggcgcaatctcggctcacggaccctccaccacccaaattcaagcgatttctcctgtctcagccgccgtgagtagcctgggatttgcaggttgcccaccaccacacccagcctcattttttggatattttaagatagagagtggggttttcaccatgtgtttggctcaggcgtggccctcgaacgtgaccctcgtgatccaccgtgccctggtccttcccaaaggtgctggagtatagacaggactgttgagcatgccgctgtccaagctctaaatattggatcttttaccaaagggctgggtacaatgtggcctttgtagagccaaagatattattcttgttgttctataacaatcgcttaagctattttccctatatacaaacctggtgaaattattgtcccacagtaatattgttcctaagtccagtccatgtgtaaaatattggaactctggatattggggggaagctattcatcacagttttataaagggaaagtatcccccaaatgtgcccagagacaactccagtgtgctcttccgagaaaacgccaacacattctattttttctcaacttccagtgctcaattttgtgacctttttacggaaacgggaaataggaccagttgagcctgtggggagaaaaggcaccttaatattttctgggaggaaaaaattttttcacatttttgaaaaaaggtcccatacggttatt

SEQ ID NO: 623599 - DNA, 227 bp, Homo sapiens
tcgtctccacacttgcagtacatattctggtgagcttcgcctgagccagagtgatatcataggcgccagaaatcatactctccttacttagtcacaacaaaatcacacatgtcatctatggtcaatgagcataacatatatcatatcataccccacattaaatttaggtaagcaaaaattaccacattaatatatatgcagtaaagtagattggatatgctagaaat

SEQ ID NO: 623600 - DNA, 149 bp, Homo sapiens
tccgtaacgagcccccgtaacgtccgtaacagcgccttcttacagcgcctcctaacagcgcctcctaacacgcgctgactcctcaagctgcgctcgttaggcgctcgttacggacgttacgggggctcgttacggagggtaccgagctc

SEQ ID NO: 623601 - DNA, 253 bp, Homo sapiens
ccttataaatgaatgaaccagttatcatgcttttctgtggttttcctatcccaatagtgaatttctgagctatcctgtgtgttcagttatccacttacttgatagcaacttacgaccagattatatcagtcttggcatttattgaaattggtaaagtgatttaatacttgatagattgatattgggctaagatgcttctaggaactttcataaaagcaattagacttgtgcagctttatctatgaatatcagg

SEQ ID NO: 623602 - DNA, 452 bp, Homo sapiens
gctgtgagtctatgactgacctgtggataaacgggaaccatttaatggccttttctatctagcggacaacaggacagacaatcatatggctccatattttcgagatttgtgcggtgcgaaacaaaccatgagtgcattactcactaaatattctcgttcttcgatgcgaaatggtgttaacgattataattcgagaagacccatttcttgaaagaacaacagctgaaagcttccgcctcatcatggtgcataaaggtgctgtatacactaaaaaatacttggacttggataaaagccttgtagaaacctagtcttctaaggcatttttctcctcatcttaagcattttgaaactactgttatttcttaaatgttataggatgtagctttaaaattatatttgtactatgtacacagtgtaaacaaggacaaaagaattctttcctatattat

SEQ ID NO: 623603 - DNA, 425 bp, Homo sapiens
  misc_feature (1)..(1): n is a, c, g, or t
nctgtgcttctcagtgctcccccttcttaaagggtgtgtggacacacacacagaaggggacagtgaaaaaggccagccttgggcacaagcctgtaagagccagccacaggaacagccttagaaaacctctcggcggtggccctcaatgggcctgcacagccccctctgggcccattctgagtgccaaagcctgggcttgggagtctgtctcttacctcaccctataaaaccaatgcacagttcaggaagttggaagcacaatgtgtgggactgccaccttgtgggcccccctatcacacagggaaacagaaacgcagggcacaggggcacagggtgaggctcacagcagcgcaaaggtagcaaatgtggccgggcctaagtctcacaagaggaatacactctctccagatactatggctctcgtg

SEQ ID NO: 623604 - DNA, 389 bp, Homo sapiens
  misc_feature (60)..(60): n is a, c, g, or t
  misc_feature (65)..(65): n is a, c, g, or t
  misc_feature (378)..(378): n is a, c, g, or t
gacgggtgcgagggcaggagcttggctgtatccctgcctgtcgttatggctgctgcctgnggacntagttcccaccccagtcccacctggcgtccccagtcgaaggagccccagcgttgctctgcactggtccaggtgtgatgtgagccacgcgatttccgctctccaggaaggcaggtggatggggagccccagaagcccaggcagtgacgaagctgtggctcagaaagccccgtgaggatggaggacaacttccggaacttccacccagggatgagtcaagtcttacttgactttagagctttttaatgaaggaggaactttgtttttcatccacaagcatgatgactaaatatgtagtattattgtctacacttnaatgtcgacgc

SEQ ID NO: 623605 - DNA, 381 bp, Homo sapiens
  misc_feature (10)..(10): n is a, c, g, or t
  misc_feature (15)..(15): n is a, c, g, or t
  misc_feature (39)..(41): n is a, c, g, or t
  misc_feature (66)..(66): n is a, c, g, or t
  misc_feature (91)..(91): n is a, c, g, or t
  misc_feature (117)..(117): n is a, c, g, or t
  misc_feature (126)..(126): n is a, c, g, or t
  misc_feature (135)..(135): n is a, c, g, or t
  misc_feature (152)..(153): n is a, c, g, or t
  misc_feature (199)..(199): n is a, c, g, or t
  misc_feature (202)..(202): n is a, c, g, or t
  misc_feature (208)..(208): n is a, c, g, or t
  misc_feature (241)..(242): n is a, c, g, or t
  misc_feature (270)..(270): n is a, c, g, or t
  misc_feature (286)..(286): n is a, c, g, or t
  misc_feature (299)..(299): n is a, c, g, or t
  misc_feature (310)..(311): n is a, c, g, or t
  misc_feature (357)..(358): n is a, c, g, or t
  misc_feature (361)..(363): n is a, c, g, or t
  misc_feature (368)..(368): n is a, c, g, or t
  misc_feature (376)..(376): n is a, c, g, or t
  misc_feature (378)..(378): n is a, c, g, or t
taaactccancaccncgaccctactactaactcgcaccnnnaacaagctaacatgactaacacccntaattccatccaccctcctctcccnaggaggcctgcccccgctaaccggcnttttgcccnaatgggccnttatcgaagaattcacnnaaaacaatagcctcatcatccccaccatcatagccaccatcacccnccntaaccnctacttctacctacgcctaatctactccacctnnatcacactactccccatatctaacaacntaaaaataaaatgacngtttaaacatacnaaacccacccnnttcctccccacactcatcgcccttaccacgctactcctacctatcnnccnnnttatnctaataancntat

SEQ ID NO: 623606 - DNA, 585 bp, Homo sapiens
  misc_feature (204)..(204): n is a, c, g, or t
  misc_feature (209)..(210): n is a, c, g, or t
  misc_feature (229)..(230): n is a, c, g, or t
  misc_feature (235)..(235): n is a, c, g, or t
  misc_feature (245)..(245): n is a, c, g, or t
  misc_feature (293)..(293): n is a, c, g, or t
  misc_feature (304)..(304): n is a, c, g, or t
ttttttttggcggttccaggctttattaacaaagggggtaaaaaaccagagggatctggaggaagggacagggctgcccggtcttcaggcttcttcaacctttcccaaaaagagggggccagggcctgtggcacgccctgtgtgtgcgttcgcggcctctcctataaggcagctcaaccctgtgtgtggtcccctctcacaagngtganncagggacattctgtgaccnncacanatctcacagnggttccacgatgggagacgggcggaagtctcgacaccaccacctatanacctctcgtangggggttatatctctcgtggctctgcggcctctctctctctgctccccctctctcccacagaatatagcctctctctccacagccgcgtggtgggcagcgggaacagagccacacagagacacttgtgtggccgagaaacactctcacacccgcgggggagagagtttctctctcagaggtgtgcgcaagacacagagcggagagccgtgagaggtctgaggagggttgtggagagagaggcctgtgacaacctctcgagagagagggcccccgcgagggg

SEQ ID NO: 623607 - DNA, 128 bp, Homo sapiens
tacttgttgtaatagctctctagtatcagacatagacacagcttactcctctcttgatcttgggtagcctggtgtctcgcgaaaccagacagattggttccaccacaaattaaggcttgagctggggc

SEQ ID NO: 623608 - DNA, 1043 bp, Homo sapiens
gcatcggaccggatacgacgagcatctggtccagatctctatgatgctgggtcatgtctaagtcgtcgcgactacagccacggaggcatggcagattgacatcaatgccaattatatcacgaggctataaccgggaaggacgaaggtctacacttggcctagccgaaggtcccctcgatgcccacaatacatgatggtcaggacttcatgaggagcatggtgtggtcgagagagtgaagtgtaccctacgagtatgtcgatgcgaactacttcaggctccgaagagggcaagtgagaactgtgtctcggactagtgggcccacaagaagagatggaaaacgcttataggacccgttcacagatctcgagcagtccaggacatctagaaatgacgtgcccagaatagtatctacattgatgcgagcgaaggatcaaccaagtccaaggtagccagggaaacgaagccggcgcgggtcatgataagacgcacgaggtccctcatttctcgggactggaggccaaggaatccatcatgacaagcgagaaatcaaggctgagtgcccccatggaattgaagccgtaaagattggtccaagaaggtcgagaccggaaaggaggccctggaagaaacatagagcagaccaaacaccagtgaggcacgtagatccggtaaagatcacagtcttgcacacgctatgcacagggcagtttagagcccggaaccgatgtgctgcctatccaaatcgcgccacctgcctgacaacttggagtcgtcgttcaaacaaaggcttcgacataaggccccccggacaggacgacacaagtgcgacaccaattcctggggagttactacggtggttagcccgacaccgtggcagagcctaacgacgcacgaacgagggagtggaattcgaactccacacgaaacagcggcgagacagctcaggtcaccccaacgattgccttaagacaaccaacacacttattggggcccctgcgtcaatagacatgtggcccaaattctgccctcgacaggacaccca

SEQ ID NO: 623609 - DNA, 858 bp, Homo sapiens
  misc_feature (114)..(114): n is a, c, g, or t
  misc_feature (207)..(207): n is a, c, g, or t
  misc_feature (216)..(216): n is a, c, g, or t
  misc_feature (296)..(296): n is a, c, g, or t
  misc_feature (301)..(301): n is a, c, g, or t
  misc_feature (312)..(312): n is a, c, g, or t
  misc_feature (314)..(314): n is a, c, g, or t
  misc_feature (325)..(325): n is a, c, g, or t
  misc_feature (342)..(342): n is a, c, g, or t
  misc_feature (350)..(350): n is a, c, g, or t
  misc_feature (363)..(363): n is a, c, g, or t
  misc_feature (367)..(367): n is a, c, g, or t
  misc_feature (372)..(372): n is a, c, g, or t
  misc_feature (375)..(375): n is a, c, g, or t
  misc_feature (393)..(393): n is a, c, g, or t
  misc_feature (416)..(417): n is a, c, g, or t
caggggatgtacatctctccctccgtacacttcgcgcacttctcaccttttgtcaacggcaaaggcagcctttttctggccttgacttatggctcgcttttttctaaaaaaaanaaaaaaaagaaagaaagaaaaaaagcaacgaaacataaaacacacaagcgccccgtgcccccagtgactctgggcctcacagagcccccgccnagccatgcnatggggccccgccctgcagccagtcacgcgcccccacaccgcagccccccgtggctgtccttccaaccccacgtgcttantcttnctcctgcccgntncttttcttcantcacaaaaggcgtgganactcgganacggacgttttancccnttatnaangttattgacgcccagagngcctcgcctcttcacccatcaanngctgtgctttgcccactggactcctgaagagggggtggggggctccctcggttcgcccaccctgggaagtgcctaaactttaatattatgattattcttctcgaggaaaagagaaccgcctgagctcacaggttgcaagaatactccctggggccctctgtcaactggccgggttccccgtccctctgcagaggctgcgaagggtccccgggctggagccacgggggctactctgggctgtgcctccggggccaaccactggctgctaggggctgcccggggcactccagaggactgcccggtcaccctgcctggttagagcgcaccccaccggtagccacgtgggcttggggcggtcgcacggtggtcccccggtgacattggcgagcaaggcccttggatgggcgcctcgcttgttggtccgcttcgtgattgtcccat

SEQ ID NO: 623610 - DNA, 442 bp, Homo sapiens
tcaacgaaaaaaaacaactaactcaaaatatttctttttcaaaccaaaaaacacatcactaaaacaccataagagccccttttacctacacatctttaataacatcctcaatatacaatttttctctcaccaatcaaaaaacacacctatatttttttgtccccttcgccccatcttctttttatcctatcccttttttttccttgccccccatttccctctccttttcccctttcccccttttctccccccgttttccaattcccttccccctttttttaccccctcttctttcccccctcccttcccccccttttatcccttttccaccccccccctttttccccctttccttatttcctatgctccctccctcctcgtcttttctcacatatccgcttacttttttcttaaccccttctttttttcccccttccccccc

SEQ ID NO: 623611 - DNA, 186 bp, Homo sapiens
gatgtctcggtccattgaccaggttcgcgtacaggtgtgcaatctcacatcactggacgcatctacctcacgtgctcactccatcactctctggctcaggcttcctcttggttgttcatcaagttggacccccatattcatggctaagtcacagtatgtctagtagagaacaggtccattgatcga

SEQ ID NO: 623612 - DNA, 366 bp, Homo sapiens
ctgtagttatgttggtggcttctgtctccagccctttaacttttcattctaggaggagtttaggctcctaggtatcttatcttctccctgggttcgtctcactttctgtgattcttgtataattgaatatggccatgctaattttacaagtcaacaggagctcagaaatggtgcataaaaatgaaggtcatgtagctaacgatgtcacaggtgaaggtaggagtgagtcctatatgttttagacttctataagcccagggagaaaactctcttttctaggcctttgacatcctcagtcatttttatacaccatccccacctatctgtattttgcacgcccccattatggcttagctgggacctgat

SEQ ID NO: 623613 - DNA, 200 bp, Homo sapiens
  misc_feature (42)..(42): n is a, c, g, or t
  misc_feature (58)..(58): n is a, c, g, or t
  misc_feature (180)..(180): n is a, c, g, or t
  misc_feature (197)..(197): n is a, c, g, or t
accgaacgaaaaattctaggctatatacaactacgcaaaggncccaaccgttgtaggnccctacgggtacctacaacctttcgctgacgccataaaactcttcaccaaagagccctaaaacccgccacatctaccatcaccctctacatcaccgcccgaccttagcttcaccatcgtctnctactatgaaccccctnccc

SEQ ID NO: 623614 - DNA, 469 bp, Homo sapiens
cagtcacaaaggatcacatatgttatacagataactacaaacagtgtggctgggtgtacgagctgcatggaagatattcttggtatcattgtgcttgatatattgaattgtaaagttcatctagtttcattctccaaatgctgcaggtaacgccgggtaatatacttccccgtccatcttcttcacccctcgtgaatagcttcacggattcttccgtttatttgcttgtgtatggtctgtcattcatttggtgccagaaatggtttgtcaccaccataaatctcttccagttttcgtgttgtatttgtccttggtagatcgccacgggagctaaattgttagcttctgctgtgtcctgtcacatggatttgggatgtggtaattcttcatcttggataatcttttatatgagccttgaagtactcaccagaccccggcaggtgattttattcccattgatctctttaat

SEQ ID NO: 623615 - DNA, 715 bp, Homo sapiens
  misc_feature (230)..(230): n is a, c, g, or t
  misc_feature (248)..(248): n is a, c, g, or t
tccccccttgaggtccctcgtttatatggggccctcaccaggaagccacaaggtaaccattctccccatccaaaaaacaaggagaggtctggtgctatggcttgaagatagacaatatttgtggttctgatcgaagtcctcagaactatgttcgtttcctcatttgacatgccgttggctaaacgttagcatggtctccccggtcggtagaggtctccgatgctatatcntgtcctcaacgaaagttntaagtgagttacttctgggtgtctgcagttcaggtggatatgcagtgagttagttagttgctcttcgaaatatttcacttgatgttggagtagacttctttcgtataggaggctttcaagttctgagttgagttcaagtaacatattctccgtcatcgtccagttcactggtgtgcagcgataggtcatatcaagcctgatcaaatatgttgagcgtttgaaatatgtcattcatttggcccttcgtcttatggacaaagtctttaagaccatgtcccaactgaagtaggccattggctagaatctctacatcgtctaacatagcgaatcttgattttggctctgaacatagagactctaatgatgaagtgtcttgatcacattctgtagccaatagctagaggaacaatccaaagaagcagctgatgtgtgaccatgtctatcttgattttcaccatcgagcaacg

SEQ ID NO: 623616 - DNA, 102 bp, Homo sapiens
ccggagcgtagccatttgagatcaacgaagggtagacccagcgatcaactttgtttttcctaaaaatggaaaggggaactgggaacagactaaagacaaact

SEQ ID NO: 623617 - DNA, 540 bp, Homo sapiens
  misc_feature (439)..(439): n is a, c, g, or t
  misc_feature (467)..(468): n is a, c, g, or t
  misc_feature (529)..(529): n is a, c, g, or t
  misc_feature (532)..(532): n is a, c, g, or t
ccttctcaaaaaaaaaaaaaaagaaaaaagaaagtatgaagtctaagtactatttctagggagcttactgttaattgtgcaattatatatgatgtgtgaaaaactaattaataatacaaaacagtagttcaggaccaagtctctaaagtcctattaagatgaaaggaaggagtgagggagggctctttaatctgggctagttagggaggcttatggaggagataagagctaataggtagaatcatagaggtgaaaaactttttaccttagaggtgttcctgagttatgggtggaccggtctctgtgaaatcagagtgttcttgtgaggcaagatactttggaccgaattgtgcagttgttgcaagcatattaattttaattttaaattaggtaaccccgtgtagatggggaggaccccagtctatactttgagtcttantagagtagggccttgttacagatttacnntttttgtttgtttttgttttgagacagagtctcactctgtcgccaccgcactccagtctcngcncagagggg

SEQ ID NO: 623618 - DNA, 132 bp, Homo sapiens
ttattctttccctagatctgatctttttgtgaactattattattgtccacaaatccttgtgtttagctcctacagcaggccttatcatttgaggtcgaggtgccactatactgccatggttccagattatag

SEQ ID NO: 623619 - DNA, 735 bp, Homo sapiens
atccagacatgttactataatcaccctattgcatctattgaaaacaccaggttgatttcgttctatctaactgtatatctgcatgcttcgtccatctctctttatccctcctctctcaatgtgcagctttctatctagtaaccgcccacacactcaatgcttcccttttaccgtcggagaaagctcaagtgaaataagtgaagcaaagcagttggcgaaacgagggtagcacagatgccaccccgaacaggtgccccattaggtgccactctgccatcctgccctctgtcccctcagtcaatgcctggcaatggggagatgagcgctaaaatttgagagtttgtctataacacaacatcaaagcagatatgacgtggaaatctcccttcaaaacatcaggaggaaaatcattgtgtgataggtggctatgaccaaccagcttgaaccgttgacgatcctaccacatgccaggatgttgtgtcactatgttagagggtggaatgcaggagcaagcagtatctacgagctatctaatgtgccatgacagaagcgactttgaaatgtaacctgagttcactggcgcgacaatacctcccaatacactttctgaagttcacttacagagaacagctctcaagactgagtggggagggacacatgcaccagtgtgtacacagtcagatggactggaagacaacaatcatgctctccctggcggggtccaagcaattccca

SEQ ID NO: 623620 - DNA, 260 bp, Homo sapiens
agcacagctcaccctgccgttctggttctcagccatttcccctactattttcggctgattgtgcatctcttctatgtattcgcataatggcccataaaggagagcaacaagtatttcacctttataatacttatttaattttcacttagcgtcgtttctacgattcacgatcaatcctgaggttaatcaggcagggttgccatcattctcctttttagagggcgaacaaggtaacctctagggtagctccaacactgggg

SEQ ID NO: 623621 - DNA, 663 bp, Homo sapiens
ggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaatgctctgtctccatgtcctatggttatgggcaagttggtacataaatgagaaatccatccagtggcttgcccatctcatcccaaaacctgaagaatgtatgttatatctctaaagtagcagatggtctcct

SEQ ID NO: 623622 - DNA, 437 bp, Homo sapiens
  misc_feature (16)..(16): n is a, c, g, or t
  misc_feature (30)..(30): n is a, c, g, or t
  misc_feature (51)..(51): n is a, c, g, or t
  misc_feature (74)..(74): n is a, c, g, or t
  misc_feature (93)..(93): n is a, c, g, or t
  misc_feature (405)..(405): n is a, c, g, or t
ggtccttgaaaaaaangccctatggaccanatttccatccattaaacaggncagcatgaagttggcccagtccnccctttccaggctgctttncacccagcagaacaaaccctttgtggcccaaaatccttgccctttgataccctctgccttcccaagaaatgatgtggtgtgccacatgttcctcacttgtaagtgggagctgaacaatgagaacacatggacacagggaggggaacaacacacactggggcctgtcccaagggattggaggggagggagagcatcagcttaaatagctaatgcatgtggggcttaatacctaggtgatgggttgataagtgcaacaaaccaccatggcacacgtttacctacataacaaacctgtacgtcctgcacctgtancctggaacttaaaatcaaataaatttttttta

SEQ ID NO: 623623 - DNA, 262 bp, Homo sapiens
aaatgtgcgcgtgcggaatcgtcgtcgtcgtatcggaataagcagatgacagaggcttcaggtatgacttcttatgggggcaggggaggtagtcgcccaggcgagcggcgaacaggccccgcccatgggcagccgcttcagagatggccctcccctccgctggatccaagcatggatttcaggagaacccacacgaagaggaaagagcacagtagaccacgacgtccagcgttaaaccgagcgacgacggggagatccgtct

SEQ ID NO: 623624 - DNA, 246 bp, Homo sapiens
  misc_feature (141)..(141): n is a, c, g, or t
tgcgtgccgggtctgactctatgaggatccctccggtgtcctcattgatcagcacccgtcaagaccatgaccatctcttctaagaggcaacaactctacgtggcgtcggccgtgggtgtcacacacctgagcctgcaccgntgccaggcgtatggggctgcctgtgctgactgctgccttgcctgggacccttactgtgcctgggatggccagtggctgctcccgttatacagcatcctccaagag

SEQ ID NO: 623625 - DNA, 148 bp, Homo sapiens
tgcgactccatcagtggggggtatatattgggtgacacatttcactatagggaactcgcacggtagatagtgtggaaatgtacatgtggtgatgatgcactgtggaacgtttcccttttcctagagatatacccgaaatggggggaga

SEQ ID NO: 623626 - DNA, 466 bp, Homo sapiens
agacaattagatgagactacaggtggcacacatccatagtaccagctactccagaggctgaggcgggaggatcgcttgagcccaggaggtccaggctacagtgggccagatcacgccattcactccagcctcagtataaagtggcattctgtctaaaagaaaaagaactggccaagcatgggggctcacgtctgtaatcccagcactttgggaggcccagggcaggtggatcacatgagatcaggagtttgagactagcctggccaacaatgatgaaaccccatctctactaaaaatacaataattagctgggcgtggtggcgggcgcctgtaatcccagctactcaggaggctgaggcaggagaatcatttgaacccgggaggcaaagtgagccaagattgtgccactgcactccagcctgggcaacaagagcgaaactcagtctcaaaagaaaaagaaaaagag

SEQ ID NO: 623627 - DNA, 779 bp, Homo sapiens
ggcagttcgtgggtcccgcggctctgtctctgtgcttcaacagtgcttggacggaaacagatccggggactctctatccagtgtccgacgcacctccgatgtcctctcacggctggcaaacctccggggacctatcttctctggccatctccttgcattccatggggacctgccagcacggttttgtagtggtaagctccttcttgccaaacaaccatgaggtcccagattgcgtcagatttatccaaacgacagtggaggcagccgtcaacagcctggtcaattttgtacctgaggcctgctacagctacctctctctgggcttctatttcgaccgcgatgatgtggctctagcaaggcgtgagccacttctgtccgggaagtgggccgacgtgcgaaagcgacgagggctaacgaggcgtactactgcaagaatgcaagagaaccagggtggcgggctcgacgcccttctctccagggaacatcaaatgaagccactgtgggaaccgaattgacggttgggcttctacaaagaccccccaagaagcggccatttgaacaaccgacgtggccaatgggggcaccttgggaacgtaaaaacactgcttagaaacccggaggaggctcattttggggagcttccataccattttgccccttgagggtatccctgagaccactggctaacggggaacctccctcacttgctctatgaagaacttgtccactggagacgacatagcgacttttgtcttaaagaactagaaaggacaggtagc

SEQ ID NO: 623628 - DNA, 784 bp, Homo sapiens
taccaaataaagtataggcgatagaacattgaaacctggcgcaatagatatagtaccgcaagggaccgatgaagcaattataaccaagcataatatagcaaggactaaccccatataacttctgcataatgaattacactagaaataactttgcaaggagagccaaagctaagaccccgcgaacacctagacgagctacctaagaacagctaaaagagcaacccgtctattgctagcaaaaactagtgggaagatttcactaggtagaaggcgacaaatctaccgagccctggtgaatagctggttggtcccaaagataggaatctttacggttccaaactttctaaaaatttttgccaccacgaggaaagccccttcataaaattccccccgttggtacaattttcaaacccttggttcaaaggtccccacaaagcatgggataccaaggcttcctgttggggaacaactaagcagacaaaaaaacccttttggtacaggaacgaatggacgtcacaccactacaacaatctttttcaacacaagccccccaaattaagtataaagggtcacctttaaacgaaaacagtccagggcaccaactcacatatatttaaaggaaaaacaagtgtccggtttccccagaaggacctcccacaacaaaaccctcaaagctttaatccccttaatcgcaatatcattttccccaaaaaagagcactttaatttaaaacctttgggaaagattccctattcaacacaccccacaaacttttggaggaacc

SEQ ID NO: 623629 - DNA, 204 bp, Homo sapiens
ccgatcagagcataccctgaaatattatacagaataaaacatagctcaagtacatgttcactataatagacacatattcatgaaaccttgggttttggtttttgggcaacaaccaattaaatttttgggtttaagaagttgaacacatgaaaaacgggattgtttccaccatttcaaatattccctaagttccttttaaaaaaa

SEQ ID NO: 623630 - DNA, 1121 bp, Homo sapiens
ctgacccacgctgtacggtcgctgccgggcccatccgtgtatggctgaggggggaacagcgcggccatgtgatgcccctcgtggcccggctgcacttgcatttcgatctccgtgatgacgatgacgctggaagaagaatgggcccaagcgggagcttggtgtccggctgtcccgtggggctgcagtggaaggagggctgtccgagtcaacaacctgcttcgagctgataagacattgacgatcttgaggatgaccctgtggtgaactggggagagtgtcttggcctgttgcgcttcactagactgctgtggcaaccatgtggaacaaatgtgacaggtgtgtcacgcctgtggaaccaacatgagagcaagactggatgtgagatgacacctgagacagtggccctacagagcagtctccatgcaccgtggccaaaactcacggagagcacagaaacacaaaacacagacaaacacccatcaaaaagcatgcaccggcgagacagcatacggaaacacggactaccacagatatcgactctgcatcctaagaagacggatacgacggacacgacacacatggggttagaaccgtaccgcggaccaggactccccctgaagcgtccatgtgaaagcacagtacatctaccggtgcgagccacacgaccactttgaacatccgagaccacatgacactggcacaaggggatactaaggggatgcccggggacaaacacatgagcggagagcgcaaaagtgccacggcgcacgaagcacacacagtgatgaacaccccaagagatggcacaagtgggcatggacccacacacactacaacacgcaacctggggcacacgcatacaggcaaccacacggtcaggtccaatggcggccagctaggagaccaaacacaaaaggactatcactacaaacagcgcaaaggaagaccacaaaagagggagacaccagaaacgggcacagacacaaggtaccgggatggacagagcacgaaaagagacccacaacaaactagagggacgagacccaagacagcctacacgagagacaacaggccacaaggacaccagcggaaacaggagaaacgaaaaaacaaaaacaaaa

SEQ ID NO: 623631 - DNA, 706 bp, Homo sapiens
gggtcacttaccctgctgtctgaatgtctcctgggacaacaggaggctgcactcactggctgagttcagacagaagagggatcatcggactggaagctctggcagagccttgaaaccagcgaaacacataatcaaagagcagttctgtcaaagaaaaccaacataaactcacggtccacaattctcacgagctgggatatcagatctttagctgtgaacgatacatctacattaaaccaggaatcactagaactgacatttggcaccacgaacacctttggacaaaattttaaaactgtgaagcgttgactcactggacaattaacagaggaaggggcactcagacgaacgggcagcactttcttcctacagcccaggccaaatgatcccggggactgtcagtccacaagtatccacgaagactccaaatgaaccgcagtctggaattcatccttgcatctgacatcaacgaatcaggagattagcagctgcaagaatctatcccataactacctgtctaccagtataaaaacaacttcaatcttctcttgcccacatctatctcccaccctacactaagaaaccaccaccggataatttcatctggtccaatgcgccgaccgcttgcatgagcgcaccccagtttcctccacactcttcttccgcctctggactgcttgcgtcctaaaacgcccccccgttcgtc

SEQ ID NO: 623632 - DNA, 812 bp, Homo sapiens
tggctgcttagacctgacaaattatacatttgaaaaaagctctgtccttctcccttctaccgaaaaaaggcggtttgcagggctggcacctgtccacacctgtcatctgggccttcccctgggcaaggctgagtgggagcagatgccctcatcctatgtgcatgggcctgtagcaggagccatcacaccacctatgtagatgatagacacctagtatctacaatctcacactgtacttcatcccccttcttgagaaagacaggaggttctcctgaatacaccgacacctgggtgggtgccccagttaggatgcacttcccctggttaacaatgtgtaacaaactgtggagacccaggctatcaggtcctctgtcttgattaccatctgtttgtgtgttgccgctctggcaccacttccccattcactcggcagcagatcttaaagttgtgtggattctgctacactgtccttggtccaccaagggctcgtggcccagtagggctcgactggtgctcgaagtgttttccccagccagccattgtttcccatcacgtctcattggccagtccacgagaacttcccgctcagtgagcccactagtgaaccctgtccacgttggggcccaaagccctcttgtggccttgatgttgctggccttttctttccaattgaccactgccggttcacttcacgaatttacctctggacctgtgctggaggaccccatttataatgggcccccgatgggtgtggcactgctgcagtgattgcctggtcagccttcgtttttacggtctatattgtcctaaca

SEQ ID NO: 623633 - DNA, 167 bp, Homo sapiens
ttttggtaattatgaataatgctgctatacacaattatgtacaggttttgtgtagacatgttttcagttcatgtgtaaatcgtattcctttttaacttttgtatttatgcacacatttatatagttgtaaaactaagcttatatatttttttcttttctttattctc

SEQ ID NO: 623634 - DNA, 251 bp, Homo sapiens
  misc_feature (12)..(12): n is a, c, g, or t
  misc_feature (18)..(18): n is a, c, g, or t
gtttacgacacnacattngctcgactaccgcgactgcatcttgagagcgtcattctcgaagacgtctgcaaagtcgcttacgcagccaggaagaggttcatcctccattcctgcaggtatgctgttcggctccgctgcggaggcgacacagatccgctgcgcctgtgacaaggctccacagcggctgagctggctgaacgtcttgggtgtaagcacccgagtatcttctacgtcgaggccacatgttggtt

SEQ ID NO: 623635 - DNA, 908 bp, Homo sapiens
gggtccgacgcgttgctgcgttgctgaggggtgtcagctcagtgtcatcccagggcagctcttagctgtggatgcagtgaactgtgtgtggttccttctacttggggatcatgcatgagagcttcacgtctgaagagagagctgacacatgttagccacagagccagccccaggcatcacatgttggcaagataatagaccatagatggatgacctgctgatgctcaaatattaggtggagccaacacacacttatgagaaaggtgtccatgaagctagaagttatcattcctgagaggtacccatttgaagcctcctcagagtccgactttgctcacatgccaatttatcatgccaaacatttgattctgcgtggaaaggcactttgtgctgcgatgcttctcaagattgccaggcaacagaggtgcttggcagaccatccctcaaagcatcgcaaactgtgttgagcctctattcagctgctcagtgtcgagaacccagccctgatgacccgctcatggctgaccagtatccgtcagaagtgtcagatatggataatgccaggcctgtcctcaaggaatgccgagaccagtgggacagagaaagcatgcaaggacaagcagacgcaaaaggctgatgagggaagaagatgcttgaataatctaaccagaagggctggtgactccagagtcacaccagttccaccgccagcacaacggaaggggcacaggtccaggtaagattaggcagataggaaagatgaaaacgttgcattccctggaatggttaaatggggaacttggatcctggggtcaatccttaaagataactgtgatcctgttgtcccaagtggtgatctacagctggccctaccttggagtgtaggtggaagtatattcgactgacat

SEQ ID NO: 623636 - DNA, 414 bp, Homo sapiens
agcaatcaaaaggtacaaacaaggtgattcatatgtttcttacatatatctcactgtgttcagtgcaagtctgtaacactttgaataacaccaggggactcacggaggtaacactagtgatactggaagtgctcccaggaaggagagacatgtcatgatgtcacaacgaaaaagtcaacatcgcttgatatgcatctaagaactgagtgcatactatgtaggcctgccaccttaaagatcacactgaagtcagcatacatgactactcgtgaaaaaaaggaaaggaaactcatgaagccatggtcgcagctataccagcaatgcctcaaaatctcacacttctcgtgaaatattcatttactctggctatcgccaatgcagctcttatgctcagcgcaggtcccccgggggatc

SEQ ID NO: 623637 - DNA, 387 bp, Homo sapiens
aaagaagggtttggaagataaatggaagacttcaagtgaatctatagttttgtttaaaaattctgaagcaaaaataagaaatactgagtttgatctcttcgaggtattaggtacctaatgttttctcagttctccattgttttttgtttgtttttgttttttttgagatggagtctcactctgtcgcccaggctggagtgcagtggtgtgatctcagctcactgcaacctccgcctcccaggttcaagtaattctcttgcctcagcctcctgagtagctgggactacaggcgtgtgtcaccagacccagctaatttttgtatttttacaaatggggtttcaccatgttggccaggctggtcttgaactcctgacctcaagtgttcct

SEQ ID NO: 623638 - DNA, 781 bp, Homo sapiens
gggcctgggcaccccgtgggcgcggaggagcgctcctcgcttctctccttcgccccctgaccgcactccgccggaccctccctgcccggacccggcacgtgaactcgaccactccctactcgcaaaaaggaaaaaaattcaggaacccatacaacgaaaacagagaaccgaagagtacgacgaaggcatcaaccacacaggaaaagaaaagaacatacaacagcacgacagaagcaagaagaaacagcaacgaacagcaagacacgaacagaagaagacaaaggaagaacgaaccaaggcagaaacaacacaacaaaacgaaagaccagaagaaggaaaacaacaacacccagacccgcagagatcgaaagagcgacaaagccgcccagcagcacgacacagaaacagaaccaaccaacaagcaaaagaaaaaaaaagaagaccaccgacaaaacacgacaaagaacagacagggaagaccaaaagcaccgacgagcaaacacaacacccacaacaaggcggcgaaacaacgcaaggacaaacaccacgagacaacaacccaccaagacaacagacagacacagcaggacagagaacgaaaggacaataaaaaccacctaaacaacaaaaacacaaaacatgcacaaagaaaaaaaacagaacaaggccaaagaaaaaaagagaagacaaaccagaacaagaaacagaaagcaagaaacacaacaaaccacagcaaagacacaacgaagcaacagcagcacaacacgaagagaacgaagaa

SEQ ID NO: 623639 - DNA, 156 bp, Homo sapiens
tcacaggatcttacacctcaggaaagacacctccatcggcaatcacatgatctgttcatgggatgatctgcctttggtatttttcggatcgagtgagaaggccatctatcacgaagtaaagaacttatctatacctcaaaggtcatcctactatct

SEQ ID NO: 623640 - DNA, 158 bp, Homo sapiens
gctacttgggggctgcagcgcggaggattgcttgaaaccaggaggcaaaggttgcagtgagccgagatcacgccactggactccagcctggacgacagaatgagacttggtctcaaaaaaataaatacacaaaataaagtaaatgaaatggactcaag

SEQ ID NO: 623641 - DNA, 335 bp, Homo sapiens
tggacctagaggatccccgtcttcatcatacctacctgaaaccccatctctactaaaaatacaaaaattagccaggcgtgtggtgggcgcctgtatcctagctacttagtagagtgaggcaggagaatcacttgaacccgggagttgaaggttgcagtgagccgagatcacaccactgcacttcagcatgggtgatagagtaagactctgtctggaaaaaaaaaaaaggaaagcaaaacgaaaggaggcaggaagtaccccaggaagggtaggtagggctaggtatgatgacaggggtaggtttaattgaaggacggggaaccaagctcgaaatt

SEQ ID NO: 623642 - DNA, 331 bp, Homo sapiens
tagacagaaggaatctcagaatcttctttgggatatatgcacgcagctaacagagttgaacctttctattgacagagcagttttgaaacagtctttctgtggaatctgcaagtggatatttggatagcttggagaatttcgttgaaaacgggattacgtataaaaagtagacagcagcatcctcagaaacttctttgtgatgtgtgcattcaagtcacagagttgaacattccctttcgtacagcagttttgaaacactctttctgtagtatctggaagtgaacattaggacagctttcaggtctatggtgagagtcgacgcggccgcgaa

SEQ ID NO: 623643 - DNA, 583 bp, Homo sapiens
atgctgtcagaggataccgagttgaaatgtgtttggccagccatacaaaacaaggcacaggaacaatgcagtcagcagttgcctggacttgttagcggatgtgatttcagtaactaactacttgctgactcagagacagaggaaagcaaaaatctcctctccctgttctgtggccagccaagtgattatgaggctgtcaaagtccacagtgatggggactccttatagtgctcagcttgttcctttgctgtgtcactggttaacctggactgaagtttcattctaaacataaagagatggccgtctttttaaattcatgcctgcaatcccagcacttggggaggctgaggtgggcggatcacctgaggctggagttcgagaccagcctcgcgaacatggaaaaaccccgtctctactaaaagtacaagtattagcagggtgtggtggtgcatgcctgtaatcccaaatactcgggaggctgaggaaggagaatcgcttgaacccaggagatggcggttgcagtgagccaagatcatgcaagtgctacaggctgtgtgacagaggcgagaactccatctcaaaa

SEQ ID NO: 623644 - DNA, 624 bp, Homo sapiens
caaatccatgccagcgtaatgacacgtctcccccattcacgtcagaatcactgggaatgtgaaggtgctgaggactggctgcacatcagatgctctgattcagcggtctgagatgggacaccctggatgatgattgtcatgggcagccaggtctgataactcggataacagcaggcaaagaaacacagagaggaacagggaacggaagtaaggaaggggaacggttttcatctcatctgccatttggggtgacgggttgtaggtaccggaaatgctctaccgtgagggtttcagaagtggttaccaactcattctgagctgggaatattaaatatccaggggaagcgaagttgtcagtatatatgcagatattttccatttaaactatatgtgtatacacacagatgtactcaagtccaatttgtggtgcctgcactcaagagcacaacagccctaaaagcctcaaacagaagaacaccacacacagtatgccggcgctttgcagtttcctctgtagaacaccacacacagtatgccggcgctttgcagtttcctctgtagaacaccacacacagtatgcgggcgctttgacgtttcctctgtggaacaccacaaaagtatgcc

SEQ ID NO: 623645 - DNA, 203 bp, Homo sapiens
  misc_feature (155)..(155): n is a, c, g, or t
acggatgacgagtcctcctgagtagctgggattacaggtgtcctgccacacacacccgggataattttcgtactttatatgtagagcgtgggggggtttcaccaatgttggtcaggcttggtctgtaactcctagacctcacgatgatctgcctngcactcggcctccgccaaagtgctggcacattcacatggcgtagagcc

SEQ ID NO: 623646 - DNA, 189 bp, Homo sapiens
  misc_feature (1)..(1): n is a, c, g, or t
naagtaggctcggtacctcacattgtggcaggagaaagggtgaaaggggaagtacgcatacgtttaaacaatcagatctcctgagaactcactcactatcatgagaacagcaaggaggaaatcttgccccatgatccaatcacctcctaccagtgtccctcccccagtactggggattacaattcaact

SEQ ID NO: 623647 - DNA, 405 bp, Homo sapiens
  misc_feature (60)..(60): n is a, c, g, or t
  misc_feature (87)..(87): n is a, c, g, or t
  misc_feature (109)..(109): n is a, c, g, or t
  misc_feature (119)..(119): n is a, c, g, or t
  misc_feature (199)..(199): n is a, c, g, or t
atcaagagttgtgtggtctaccgactgagcctgccagataaccctgtagtacaatttttncagcatagtggaaaagaaagccatggntctgggcaggtcagggtttgancgctagtgcnttgtattaatgatcatgatgatagctagtagacagggcttaccagatactaggtgctctcttaactgctttacatatgtnagttaactcatttaatcttcatgacatcacccctgagatatgggtaatattataatgcacattttataggtgatgagagtgaagcacttgcacagattactccagcttagttcatagcagagctgggacttttaaatcaaggcactagatggttccagagctttgtactactcttcctgggtctttcacagtctgagctggtccgg

SEQ ID NO: 623648 - DNA, 458 bp, Homo sapiens
gctggagtgttgttggttcactggaacacgagtatttatgttttatttattaagcatagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgc

SEQ ID NO: 623649 - DNA, 470 bp, Homo sapiens
  misc_feature (57)..(57): n is a, c, g, or t
  misc_feature (470)..(470): n is a, c, g, or t
cacaaagcccaatgcacagagagtgtggcttcatccgcctcaagcctgacaccaacnaaagtggcctttgtcagtgcccagaaccacagggattgtggaaagtggaggagggtgaagtgaatgggcaggagctgtgtgtctcatcccattccgtctccaggatctcctttgccaaggagccccatgtggagcagatcactcggaaattcaggctgaattctgaaggcaaacttgaacagacggtctctatggcaaccactacacagccaatgactcaacatcttcacattacctacaagaaggtgaccccttaacctggagccactcccagagcctgtttggtagacatggtgtggtcacaggctctgctgacactgaagtgttgtccaggtgttcttgtaatggcatagaaaaccaaataaaaggcctttatttttatggctgaagattttgaatattaaaaaaaaaan

SEQ ID NO: 623650 - DNA, 765 bp, Homo sapiens
  misc_feature (92)..(92): n is a, c, g, or t
  misc_feature (289)..(289): n is a, c, g, or t
cactaggaccagccggtgcaaactcgttaatctgtgtgtgtgtacctactgtgcgcgaatacacccagctaaaaaagtgtatttttaggcgngacccggtgttgttcatggaaagtccccacggaattagctcctaggcggagccgggccagagacacgggcctccgagcttttttcgggggtggaggaatcccgtgcaggggctcccaaacttgtcgccgcatcattacggagagaggaggcctgcttttttgtagaagccgacttgtcactagcaggaggggggggnccatgtgccgtccccaggggcctttagatacttgccccaggagaaaatggagctccggcccccttgcacattggccaacagcatgagaacggcccggtcgggaacttttgtcaccttgaaacgtcttggagtgtgccgggctagtgattttcactaccaacaatttaccattttaccgtggacagcgtgtggcgttaaacttcctaccatgtgggtgcaagcatttatcagccatgatcttccagaactttgtcttatgaatcaacaatcggacaccctctacccattaaacagaaacttcccattatcccctcattagggcctgcacaagtaatcctaacctttggaattaagaatcctacttcaggctgagacgcgggacttacgcccgtactaccagactttggaaggctatggtggccggacaacctaagacggggggggaccagccttgccatgtggggcccctattgtac

SEQ ID NO: 623651 - DNA, 151 bp, Homo sapiens
tacatcaagtctgagctcatgtacttaataccttcacatcctattctccaggtttgtttccctcaatccatattgattaatccatatatgttggtgccaggtatcactttctctcaaccagtgatggtaatattacctattactggttgaa

SEQ ID NO: 623652 - DNA, 830 bp, Homo sapiens
gcccattcctaggcataattgtatccccatactccttacactattcctcatcagccaagtaaaaatattaaacacaagactaccagcctacctcctctcatcaaagcccttatacacaaaataatcaattatatgctagagaacgctgtaaggaagcaatagatgaagcagagaaactctgttgggttcattcagttgacccccacgatgcctaggcctacccgtcgtcagaacttgatctattctatagctcccgctctattccgattccctcacctctcaatatatctgcagtctaactagtccgacgtgaatcaccgacccaaccacattgacttgatcgaagacgtaaactcgtgcaagaacaacatgcataaccgatgacgacaaggaccttagagaggacggagacctagatctcgtttatactgaggtatcctgtaatcatgtttgtatttgccgagtacatttagcgccccccaatgacgtgcccattgacgactaaatttcgcttcgagtcccaccgcaaatctttaataaacatataaacagagtaacataagacaagcgcgagaggacatctttatttcaccaggagaggagagggaagaaaaaagaagtggaaagtgacatgtggaacacgaagtggccctctcagagctgcacaccacgggaagccccacaaaccgaggaatgggataagaagaagggggacaacatccgtgggggcgggatactcaccccagacagggacagagcaggaaagaaaaaaaaggcgagaacatagccccagggtttacacgccggaaaatatacagagaacgcgggcc

SEQ ID NO: 623653 - DNA, 469 bp, Homo sapiens
tgatctagaggatcttatgagcgggggctggcgctgcgagttactgaaatagtgtgggcacggtgatcacatgcgtgctcacgggcagggccaggtacgcctcggcgtctccttcatcttgctcagcaccatgggacgagatctcctcggggtagaacgtcttgtcgtccccgagggagtatacgcgcaccgttggacttgcggccctcgttgagcacctggaagggccagtgcttcatgtcacgactgcagcgtgatgtccgcgaacttgggcccgatcagccgcttgggatcgaaacaagggggttgtagggggttcagggccgccgtggctccttggccggcgtccctcggaccaagcgcgctccggtgtcgggtgaaagggcacgtaagctggggcgttggtgcggtttgcccgtgggtcgttgggccatggactctccacccgggagcctcaaattttgggtac

SEQ ID NO: 623654 - DNA, 135 bp, Homo sapiens
aaacctagttactagttaacatcaaaataccaagttatatgatattccaagcagaaacagtctctatacaaagccgtctattgtgtaaccaggtacaaattacgacgtaacccagatttccccacttgtaatcca

SEQ ID NO: 623655 - DNA, 272 bp, Homo sapiens
tggggggggttttgggattaaaaaaaaggttttttccttttgttaaaaaaaaggggcccccttccccttttccaacacctgggggggaaataaaaaaatttttgggatttgcttccaaaaaaaaagtttgggtgtttagggccttgggaaaatttattaaaccaaattggcccttaaaattttttaaagtgggggatgggtaaaaaaatgggtccttaaaaatgttccttcccatttttggaagtttggccttttcccgaaaaaagttttta

SEQ ID NO: 623656 - DNA, 323 bp, Homo sapiens
ggacgcgtgggtgagaattgtccaggtgcggtggctcacgcctgtaatcccagcactttggaaggccaaggtggacagatcaaaggtcaggagtttgagaccagcctggccaacatggtgaaaccgcgtctctactaaaaatacaaaaattagctgggtttggtggtgtgtgcctgtaatcccagctactggggaggctgaggcacgagaatcccttgaacccaggaggcagaggttgcagtgagctgagatcacactactgcactccagtctggatgacagagtgagtttccatcttgaataaataaataaagtttgagaat

SEQ ID NO: 623657 - DNA, 167 bp, Homo sapiens
ccatcgcgcgtggccggaaatgattttggaaaaggacttaattatctttaacaatcagataattattattaaggaaaaggacttaagtgatggcctagtctaacctgataacctgtaaacaaataaaatttatcatatgatgtggtcaagatagtttgctagagatt

SEQ ID NO: 623658 - DNA, 329 bp, Homo sapiens
cgtatgtgcagggcgcattttgttatcaggcgattggtgacatgcaggtattgcgagacaggccttgtgcactgcagaggagttaccatttctgacagggtgcccggtcaaagcattgtatgcgccaggataggaaatgtgacctcttacatgactggaggacctgaactctgtgccgccgcccgaagaatggccttttgatgtgatcttataacatggaacccaacgctttacgacgtttgaagattccaacacgaacgggttttattgctacactggggtacatgtggaaggcgctgactctgtcaagggcactgagggaggcttgt

SEQ ID NO: 623659 - DNA, 130 bp, Homo sapiens
  misc_feature (27)..(27): n is a, c, g, or t
  misc_feature (33)..(34): n is a, c, g, or t
  misc_feature (44)..(44): n is a, c, g, or t
  misc_feature (47)..(47): n is a, c, g, or t
  misc_feature (52)..(54): n is a, c, g, or t
  misc_feature (68)..(69): n is a, c, g, or t
agaactcagctcggtaccggacagtanggtacnngaaatgattntgnggggnnnacatcctactgtgnnaacccatttatcctaatccctctgagccctcaataatccagtgttgggaactcacacagct

SEQ ID NO: 623660 - DNA, 112 bp, Homo sapiens
  misc_feature (3)..(3): n is a, c, g, or t
gcnaacctcctaccttggcatctttaagtttaactatttagaacttaatattgagtggctttgtgtttaattgggtgaggaggataagagggaggctaaaggttgcttccgg

SEQ ID NO: 623661 - DNA, 122 bp, Homo sapiens
  misc_feature (77)..(77): n is a, c, g, or t
ggttttttttttttgagctgcctggagtgttattttaagaaagcagaggcaccatcatttgcacactcctttatagntcacacaccttgaaccctgactttttttgctccagtttttcagag

SEQ ID NO: 623662 - DNA, 146 bp, Homo sapiens
cgattgcggacatgtagaagcacctcctcctctgcgacattaacggcgtgattcaatcagtagcttggcagtgtgggcgggttccagaagtttagaagtaggctgtacgaggacgctctgcaggggacgcgccatcatgcgcttcg

SEQ ID NO: 623663 - DNA, 450 bp, Homo sapiens
  misc_feature (70)..(70): n is a, c, g, or t
  misc_feature (150)..(150): n is a, c, g, or t
  misc_feature (155)..(155): n is a, c, g, or t
  misc_feature (205)..(205): n is a, c, g, or t
cttcaggatgtagggtcatgcatttttaggtctgacaataagttgtttgaaaccccaatcatacctgganctttgtactagttaaaataactcctccccgtgtggtggagatatagcccacttgtttctcatcctgctaatcccaaaccnaaaanaccccacagctgctaaccgtgataaaacctaatgatcaaccaccagagtnatataaataagtttcccccttctggcgtgttttccttaaaccagccaatccacaactcctgttagaagaccggagggataatacccatataccttaataaaggtgaactcccacagctgctctctcactccctacccactgctgagctccctgccacctccagacttatctgcgctccccatcagcacccctaagctgtcagatctgtaagtaataaatttcttctgtttcatgaaaaaaaaaaa

SEQ ID NO: 623664 - DNA, 507 bp, Homo sapiens
cgtacttaggagagacagtgtggagagtctcatcataatcctaaacatactacttagaatatgaaccagcaacactgatccccagtatttacacagaatagatagaaaacttctgcccacaaagaaatctgcacgtgcacatatatggcagctatctatatcactgccaaaaacttggaaggaaccaagatatccttcaatacatgtctatactacattctggttgttgtaacaaaataccatacactgcgtaactgaggcaggaggatcacatagagcctgggaggtagaagctgctgtgggctgagacagagatcacatcattgcactaccagatcacatgtaacctctgcctttcaggtccaagcgattctcctgcctcagactcccgagtagctcggactacaggcgggcgccaccatgccacaggtaatattttgtctaataagtagagacgggtatacactgtgtaagccaggatggtctcgatctcctgaccttgtgatc

SEQ ID NO: 623665 - DNA, 916 bp, Homo sapiens
atgacgccaccaatcacatgcctatcatgatacgtagaacccaggccatgacccctaacgaggggccgtctcagtccctcctataatgacctccggactagcagatgtgatttctgttccagctccatgaacgctccgtcatactaggcctatctagcgcaatacatctaaggcatataccaatgatgggggcgatgtaacgacgtagaaagcaactatacccgagatggccgacgctatacaccactctgtccaagaaggccttcgatacgggataatcctatttagttacctcagaagtatggtttcttcgcgcggattgtttctgagccttttaccaacttccagacctagtctcgtagcgccaccaaattaggagggcgacgtgagtcgctcctaaaaggctgtcatgcgccgtctatagtccctctagaagattcccaatcttatataacatgccggatcactcgcgtcgggagtaatcgatcagctgtaggctgagcatagtctaatatgagacctaatcgaaatcacaatatatgcgacgcgttgtgcttgttacattagcactgggatctcatataaaaccttgctaaaaaggctctagagcatatcgaggctgcccattcgagcatttccgacaggcctctacggggcttaaccattttggtagccacagatttgacggcttcaacagccagtgttggctcacatttcctcacgatctgcttcatccgcaacctattagttctctgtacagtcaaatttccctttggctgggaaacggcggcaggagtggctcccgaaaagggagacaataaagaagtgcccatggggacggcgaaaaacaaaaaagaggcgacacaaaaaatggcggccccccgaaaaaacaagggcgggcaaaaaaacgggaaga

SEQ ID NO: 623666 - DNA, 113 bp, Homo sapiens
tggcggcaccctctatctccaagttgaaccctgctgtgctgcaatcgaagctatatgcagcatttcggtttaaagtccgatagacctaagtttgtattccagatttgccccat

SEQ ID NO: 623667 - DNA, 224 bp, Homo sapiens
agccactgtgtatacaggacagctacgatgttggcgtcatagtcccctcgctctagagggctttgtgaagcagtttgaccacatcgtgctccttccactccgctcgctttagatcgcttgtccaggtgatcaggatggcctcatccatttcggattgttggcaaggaaaagaaaacgtgaatcccacaggtaacttcttgtccttgatcttccttttctccatg

SEQ ID NO: 623668 - DNA, 1106 bp, Homo sapiens
gactgtgccgcgctgctccgggactgtatattgcctcgcgatatgcgcatgtactcatgcggatccgcggggactctcttaacgagctcctactgtgcctccgatgtgtccctctcccgtgttgaagcccttcgagtcggctctcgttcctcaggttcgttctcctggtatctgggacctgacacgcttcgactactgccggtgatgtctgtcttgcgggaccctgctctgaggctgccctgatgttcgttcggacggtattgtatcactctgcgatgtgcggatcccacagggcgagcgatcgtggtatcaatctgcagtggccttacctgtcgctccattcatctagcacttgtcttgtgagactcttgtttttgcggcaccagggttaggagagtgactgagactcatggtacatgtgcgtttgagtcgatcctagcgttcccgcactagaatggtggctagcaagcgtcgaaacgtgaccgttggtggcatacagaagccaggctctgtgctctgaagacaatggctcgaagaccaaagtgggctgagatttcccccgaccgatccgtgaggtcggtgaaacgcatagtggaccagttcggtcaggaaatgtcctacgagttgtacaatagtgggaggagagggtccattaacaaaaggtctcaatatctgctcgaggcgaatcatttggggcccaattcggcctttgcaatgttggaccaatagaatccttcgtccttccggaaaggacttccctcagtaagaggctcaataatcaattcactcgatggagagatatcatggcactcgttagctgaaaggctcacacaaaaaactccctaggaatgacacttggccttgttgagcaaactcctctttttcactagtcactgaaacgaaatggttgtaacgggttaattcagggaaagaatactcggtactagaagcctgaaccctttaaggcaaagcccttcaacagacattgtcctggggaatgacatcgccccgttacagagctgtagtacttgctgggcccatggaattcgactgtacttaccagggccaactggcttcctgcagagtctccggaacctttaaggaac

SEQ ID NO: 623669 - DNA, 127 bp, Homo sapiens
aggtcagttcagtcttcaggcagcggggttgttcagggggtcggcaggcaacaaggtggggcaccagctcaacatcaggttgttgttgcagtttggttcaacacaacatcagtcagcagggcatgca

SEQ ID NO: 623670 - DNA, 443 bp, Homo sapiens
gcctccagtattgataactcagaattcctgctaagggttagcaggctgctgtgttaggcagaattaatggcccccacccatgtcccatagatatctacacccaaatccctggaatctgtgagatttgcagatttaattaagtcaaagcccttgaaatggggactttatcccggattattccagtgggcccaatgtattccagaaatttatttaccaagggcaagaagaagtcaggcgagtgacagaagatgtgcccttaaacgtagagatcagagtgatgagattgcttgaaggagatcatgagccaaagaatgcaggcagcctctagaagctagaaaaggcaagaaaatggattctcctctagagcctccagaaggaagacagctttgctgacaacttgagttgaacccagtgagattcctttaataaactaaaaacttcca

SEQ ID NO: 623671 - DNA, 101 bp, Homo sapiens
ctccattgttgctgctctctgttggtgggggcctccctgctagcctggaggatgtttcaaaaatggatcaaagctggtgaccattcagagctgtcccagaa

SEQ ID NO: 623672 - DNA, 315 bp, Homo sapiens
cccccctttttccccccccccccgggcaacagggggttgtttttttttggttaaaaataggggggggttccccccctttttaacccccgggaaaaaaccaaaggggcctttgtttgggcccccccccccccccaaaaaaggtttggattccttcccggggtttaaggggggctgggtccccccccttttttggtaagggggttttccttttatgggccccccccaatttttttttcccccccggtttttgtgggaatttggttttcccccctttggggttttccaaaaaaaattttggggcccctttttttccca

SEQ ID NO: 623673 - DNA, 1119 bp, Homo sapiens
ggagtgcaatccaggtcctggaatcctgactcaggcattacttgaagctggtgccaaagtggttgcgctcgaaagtgacaaaacttttattccacatttggagctccttaggcaaaaaatctggatggaaaactacgagtgattcactgtgacttctttaaactagatcctagaagttggtggcacgtaataaaaccacctgctatgtcttctcgagggctctttacagaatctgggaatagaagcagttccttggacagcagacatccctttaaaagctagtcggacatgttcccaagtagaggtgagaaaagggcacttgggaaactcgcatatgacttgtattcctgtacttctatatataaattgggcacgaatacgacacgtcactctgtccatcggtgaaacacgaattccagaaactaatggcagatcctggaaatccagacttgtactcatgtataaagtgtcatctggcaattagcttgtgagatcaacggtctgcaccatggagccttggccatcacttgatatatacacccgggaaacagggccgctggaaaacccacagccgtagggcacatactcagacgcaacttacaacaacaagctggtttcttattcaactggttcgtcgtcgaaattattaaccaggacattaacacctatgaaagtatataatattacactggtaaagccctgatccggcacgcgcacgccctggtctcaccactatagtcaatgggcccactggatgcccagaaaccatggggcgcacacagaacaccggcacgacaaacgaaacaacatgacccccaacagagaaaaccaactggcaccacagcggccacaacacggcacaaacgctcggcaccccgacacgacaccaacgacggacgctagcgccagcagacacacaaacgacgcaccaacaacacgacccaaacacgcgggtgaaaagcgaacagacgcaagagctgatcagaacgcaacaccacaccatgactcacgcgagtcttgctatgtgctggagtaatatttacgttaccgcgcaaaccacgctcacacgagaccacgacgcgccgagccacagccacgacccggggacccagccgtgtg

SEQ ID NO: 623674 - DNA, 704 bp, Homo sapiens
ggggtccaccaacccctttttaaattcctttaaaaagggcccccattttttaaaacccccgggggcaaaggcaaacaaaaaaaatttcccgggcccccgttccgggggaaaaccccctttccccggcaaatttttttaaaaaaccttggggttggggcaaaaattttttttttttttagggggggcacccccgtttttttgttccccagcaagggcccaatcttttagcttatgcccggccccgttttttaacttcccaagggttttttccttttcttgacaaaatggggaaagtgagccccgggttttcccaggaaaaactttttccatcccccgggaattttcggttttacactctctaaagggcccccgggttttttttttgggttccaaacaaaaggcaaaggcccccccatgtgtttttggggatggggggggtggtcctttccccccttttggggcacaccccacaccctgggggggaaaaaaaccccctcgccggggtaaggagagcccccccccccctcctctccccggggagggaggaaggctcttttcccccccgcccaccagtgggccacacgctgggctatattcccgcgtggggggcaatttaccttcgaaggggagtgtcccccctctcgggggcgcgaatttaaggggcctcgtttccaccacggaaaaaaaaacccccccggggcacg

SEQ ID NO: 623675 - DNA, 402 bp, Homo sapiens
ggtctctccaggggactgtacccctcctgggaatccagttcagggcttttttaaagggaaaaatttccccttagggcccccccttggttattcctgtgaaaacagggaccacttagggggggtgcagaaacaccaatgcgtttttggggagtggaacagggcccttcccgtctgcaagttgatccaggaagctcccaaaccaaagtgtgaaaaggccctttttgcctttcaggaaagtaagaacctctgcgaacccatggagaactttatgcaccaattaaggaaaggggcatgccaatgggggagctaaaatattctctggagctgaaaaaagctgagttaaaggcaaaattgttgtaaccctacagctgagcaaatgtaataaaaatgaccctttgtttt

SEQ ID NO: 623676 - DNA, 359 bp, Homo sapiens
ctgaagaggcacagcatcgcaagcctatggatcaaaagaggagcagcagcctggggagcaatcggagtaaccgtagtcacacgtctgggcgccttcgctccccatccaatgattcagcccatcgaacaggagatgaccagagtggtagaaagagagtactgcacagtggctcaagagatagagaaaaaacaaaaagcctgcaaatcacacgagaaagaaaatgtatgatagatcaacacccgcggggagaacccagccgaagcacttcttcagatcgccaggattcaacaagccgtagttcaagaacaagtgctccagagtcaaatcgacagggccattcaagaaccgggtcatttgat

SEQ ID NO: 623677 - DNA, 1289 bp, Homo sapiens
ggggcggctgagacagcgcccagttgcctcgtgagaacggcgttggcatgatctgaagactagtggtgtacacagccagttccctcatagtggcgtctccagttcccgaggcatcagttgcacagatccagagcgctgcattgctggtgtgcggcgtggtacgagatggctgaagcctggttgtccatgtggcggcatggtatgaatccagggacgtacttcttcgtcgcggggacatcgctactcgtaggtgcgtgtcacggataggcccatgaatgacggttctccgcgatcgtgtcacctgttgggatacgtgcctagtgagcgtcatcctcggcgatgtagccagtggtgtgtccttgtggccgcagtcgtgggcatcgctagcgaaccatacatgaatggactagcttcgggaatgaagtcgggctcttgtgacagtgacactgcgaagggtgcattgtgcacactgtagttctagagcctcgtctcaatggaggcctactttaccgcatcgtggggccccttcaaaagatagccatgggacacgggtgtgctgataggtagggttcgaggcagttttttcgatcacacgcaacgcatctcgacaatgggaatgcctccccaggggattgccccgaatactaaggtaaagatcgtcgttaacaacgaggtgtttgtacaccgggtggggaagaggcaagggaacaacaagtacacgatgacgcaacgctgaaggcccgggggtcaacgtagataaacctcgggcgcaacagggcgtctctaggaacaatattgggggttgaacttgggcatgtactagtccgcattgggaccacctatgaggggacccaggaaaggcaattcgttcagtcgccttgtgtgtgcttgggatagagcagagcaagattccacaaagatagtcccccttgggaaagccggcatgaggaaaccagacatgaagcaggaatccattgagtcccgcatgggtgtaccaagttccctgggaggaatgaactgatcgcacgctgaatcacagggggccaaacgtgcccacaagcgtgcggaggcagcttgggcccactctggaaatgtggggggaaagtgtagacgcctgacattggcatacatggaaacccccaaagtggaccacgtggccacccctccaaaggtcgcgatagccatcatggagatgtgcaagtgtgacagcaccgcacctatggagggaccatgaacgcatcgaagcacagtgcgggttgagaccatagtgtcgacggcatgttgcccac

SEQ ID NO: 623678 - DNA, 210 bp, Homo sapiens
aaattagagaactctgattataactgatgacgagtggattctatgatcacatgccgtatacctagcatcttgtgaggcccaggcaagaggaatgcttgaggtcaggagttcaggatcagcctgggcaaatatgctgagacctccattgctacaaaaaatttttaaaaagacaataagctggggctggtagtatgcacttgtagtcctagc

SEQ ID NO: 623679 - DNA, 118 bp, Homo sapiens
gtcaggcagcacatcaggcatctcccattccatcgtgcagtgtgcaatcatttcagttcatgtcccacagatgtaccacaggtgcatgtgcaacaagtccacattgtgccctcaccat

SEQ ID NO: 623680 - DNA, 1229 bp, Homo sapiens
  misc_feature (239)..(241): n is a, c, g, or t
  misc_feature (357)..(357): n is a, c, g, or t
  misc_feature (364)..(364): n is a, c, g, or t
  misc_feature (377)..(378): n is a, c, g, or t
  misc_feature (390)..(390): n is a, c, g, or t
gcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgtnnnggaggttctcactttgaaccttcttgtttacagatttttttgtttgttttttgagaaaaaaaaatgtttactcttccatcatttaaaaaaaatgtaaaagacaaaaaaaaaatggnaggatgnatttaaaagatgnntttctatctctngggaaaatggagcagcatttgggccatgtcctttggtttttctattcctggtcccaaatcaaagagcagtggtttctcaaggaaaaaccaagtttccccaagttttaaaaaaaaaaaaaaaaattcccttggttaagtttctttagagaggaaaaacaagagaaaaaaccccaaattttaagcccacgtgaattactacttttggcctcgtggtaaagaaaatttttttgtgtggcaaaaaaaaaaagaaaaaaacacacaaaaaagaggcttaaaggctgggaagttgtggaccatttgcgggtttcacagaaatgcgcgtggtttttcttattaaggtgaggtgagtgaaggggtggggcaaattacattccaataggggataatataatcttcttgtggataaattcccccattacaggtggggtccccattatgtgtttcccgggctccctctggtggaaggtggtgttaaaggtgttttaacccgcgtggtggtataccctctataaagcgggaaaattggagtataactttagtgccatatagggtggtaccccaagggggttttgtgggggcttataccagaaaggtgtggctggggtggcatatttaaaggaacaaacttcttaaaagtgtggttggggcgccaaaacatctattaccgagagcttctcacccccaatttttttataaacacttttttcttttttccccttccccccccctttttttgtggggccccaaccaaagtgggggctcctttcatctagagggggcgcgtgccattaagcttccaaacgaaagagagaggagacaacttttaacacgagggggct

SEQ ID NO: 623681 - DNA, 491 bp, Homo sapiens
tgtgctgtttccatgggaacacgcagcatttgtgtgaatgcggtgccctccctggctgaggtcctttcatgcctggctttgggttcttccaacgacgcccgagcccttctccggcaaagtgagtctctagtgagtggacgagtcgtctggtgcagcatctttcaagaccagcttcctggtgggtccacaggagttttgcctcaggaagctccgcactcagcctttgggggaaatagaacaggacaaaatagaacagagcagaacagtgtttcccgagatgcagtctggtgcgaggctttatatatctgcagtgaattggagcagactttccaatgagcagcctccaggagaattcagggctctgtgtccgttctcactcaatcagcaagaaacaccctgagttctaatgaacagagctcagatcagacgggacactggagagaaaaatccaagaaataaaccccatctgcggccatgtcgcacgcctcaaa

SEQ ID NO: 623682 - DNA, 292 bp, Homo sapiens
ctgatctgaggtcctggcaaagtgtacacagtgcgttagtacgcaaccttgccactactgtaacagaagagctattagaacaggcatttagtcagtttgggaaactggcccgagtgaagcagtataaaagcttatgcgttcattcattttgatgagcgagatggtgctgtcacggctatggcagacatgactggccacgacttggagggagaaacatcttgcaacattgtttttgccaagccaccagatcagcaacggcaacgaaagcaaccagctcagaggccatcacgct

SEQ ID NO: 623683 - DNA, 158 bp, Homo sapiens
ggtttacatgagcgccgggatggaaagcactataaagattccggagcagttcggcgaggaatccctggagcaattgatggagttgctccaaaagctgaaaggcatcaaaccgtaatattcaaaaaaattggctgaagcctgtccctttttttcacgtg

SEQ ID NO: 623684 - DNA, 614 bp, Homo sapiens
  misc_feature (239)..(241): n is a, c, g, or t
  misc_feature (357)..(357): n is a, c, g, or t
  misc_feature (364)..(364): n is a, c, g, or t
  misc_feature (377)..(378): n is a, c, g, or t
  misc_feature (390)..(390): n is a, c, g, or t
  misc_feature (504)..(504): n is a, c, g, or t
gcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgtnnnggaggttctcactttgaaccttcttgtttacagatttttttgtttgttttttgagaaaaaaaaatgtttactcttccatcatttaaaaaaaatgtaaaagacaaaaaaaaaatggnaggatgnatttaaaagatgnntttctatctctngggaagaaatgagagacagccatattggcgcaatgtttctatttgtgttcttcatatgtgcctgatccacagaactcacaacgcagacataggtgtgctctagtgaagaaccancgtgtaccacaggtttgaaaaagaaaagaaaagaaaataccaacttgcgggcacgccaagacttattccgctttaagtgagggtctaattttagactgagacacttaagc

SEQ ID NO: 623685 - DNA, 116 bp, Homo sapiens
gctatatctgctaccagtgtcatataattctccatggtgaatattgtgataaatgctactgaaaactatgccgtacacagagcctaggcttcttgtcagagctaggtattttacaa

SEQ ID NO: 623686 - DNA, 915 bp, Homo sapiens
gacttatgctgtggtgttcaggatgaccgtgtgtgctctgttgtactggtggcacactgatggtgcactccacatccgaggatgcctcaatgcgcacactaggatgatgctactgaggcgatgatagaggcaccttgtggacatagtcgtactcactagacttgtgatgccgcactctagctgatacccagatgctgagctactcgtcctaaatgacgagtctgagatcgcatagcaatccctggcgtagaacggtggtcgggtgaatcggcacaaggtgacggtcgtccctacctccgtccgattaccgtgactccgaaggctcctgcgtctgcaccggctttttggctgtaccatgcgaactatcaaagacaaggagcatgctggttgacatttgttctgaaggaccgctcggtcctctgcatccttgtctatcagggatggcccagtagggacctgcctgcaacattttgaatttctacaaagaaacaccaagaaaccatgacctccagccggtcttgtccttcttccagtgtccggtgggatgactccgttcacctacatcttccactcaggttctggacatgcgggagccggtgttgtgagttcgtgaggcgaccccttagacacccaagtcatgaagcgcttccccaccgagaatgacccctgcgtcttaacctggacctggtatctaaggacaagtcatgaagcccatctattggcatctactaaggagcgcagagttgtgctgcatttacagaagccattgggatttgatcggcagcaagaagtaaacgactagcagttccggaggacccttctgttgggtcaggaggctggctttagggagccggctgttgggacccctcctgtcaagggcagggtaggaagtggaaggagcaacaggtgcggcag

SEQ ID NO: 623687 - DNA, 1110 bp, Homo sapiens
  misc_feature (450)..(450): n is a, c, g, or t
  misc_feature (462)..(462): n is a, c, g, or t
ggcagttactgagaactcattaagacgaagctatgaattccctcttcggatccatcgatgttcaaccctgctccatgaaacactatcctgctaataaagtcctcacggatgaacaggagctgcgcatggatttcactagcagaaaagtatgcatgctaatctcttctaggttcatctacttgtctgagtgattatcatgcatgtttgctccactatgcacgacttcactgtactgatgtcatggtattgtcccataacatgtcatcggctacaaggagaaatcccaatatctttctacacacagtcacggggtggcccgcaattaccttcagttgacatggagtctgctgctttctctagcaggcatatcgccatctccagctaaaggtcctaatgacagaccgatggttggtgatccaaaagaggcacacccgtgctactcgtcgatgnacgatcctactntagtcttgaatgtaagccgtaaaatccatcatgaacgaggtgttcaacgatgtagatggggggagttttcaaacggtgtgcagaagcatcaacggtcgattgatccaactgccatgattactcttggttgtatattatgcgagccaggacatgctgtgacaattcgtttttgatcccaaagatgctctcgtgctcttgggatggaagtggctggaatttccccctagggaaagtgggaaacacttgatagttggtcctaagcccgttttattgagggttattggctgaatgacttaagagaatcgctccattttgcgcttttacgcattgaacccagcttttgggatagccgcttttggaagggaatttttacctggaaagacttataacttggccttggccatccctgtaatcccttaacattggtaacaagatccatggccaggtccttaagttttcctttcaacccacttttggggaaatttgacattaaccacggcatttattgaagcccttggtgttccccaagttggactaacttttatcaatggccgttctcttaaaaatttccattgccgcgctgcgcaacaaagaccacaagcgacaagggaaacatacactaaagaagacgcctctaatacaacgcaa

SEQ ID NO: 623688 - DNA, 201 bp, Homo sapiens
gttttctgtcccttttatttaacgcgccgactagacacacaaagcaggtgaatttttatatatatatctgtatactgcgcaataataaactcattttgcgtgtggcgccacccaggcaaaaaaggacctgttaaatttatacctgttgcttaataacactatttctgatatccgtcccatagggcaagggccacttgatca

SEQ ID NO: 623689 - DNA, 113 bp, Homo sapiens
actaacagtacatccaagtcatcagagccccaggagaacgcatgagaggagcagagagaaaaccataacagaaaaacaaatgccccccaatatccaaattctatgaacaccat

SEQ ID NO: 623690 - DNA, 638 bp, Homo sapiens
cacgcgtcggaatctagcactttgggaacccgaaaagggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggtgacaatgagaccatggctcaaaaaaaaaaaaaaaaaaaaaaaaaatataaccaggggaggccgaatcagggagggtctgaataccgggctaaggagttcaaggtgtttccaagaaggaacgtgggagcccactgatgggtccaggaggaagaaaagggcgggaccagcttgcttggacaagggaggcgctggtccacgcggtggacggaagaatctcagacaggggcgaagtaaagtacaccttcttccgagcctgcaagaacaggaaaacaaaacgcagaaatcaacagtcgggttcacggcatatgaataatattgctcatttcccaagtgattgtgctaaagctggaagtggaggtacgaggggagaacacagaaggtgagcag

SEQ ID NO: 623691 - DNA, 151 bp, Homo sapiens
tgttgaggctatctagaggattaccagtccttctctaaattctgatatgcatttgggggaggtttcgatgttctaatcttgtagcatgtattaatggagtgttaaaattgtgtgcaacctgatggcgagtatttgcttagaagtcattcta

SEQ ID NO: 623692 - DNA, 343 bp, Homo sapiens
ttgtcctcaaagtgacccaatcgcctatggcctcccaaagtgctgggatatacaggtgtgggccagcacgcctggccggtagtgttatttcaatgtgactatcctgaacaactgaatgactagatatcaccaggtatacctacttgtgtagtatgtgctcatattacagcaactatactctgtaactgattggtatttctccagggaaggcccgtatatctacatgtgtctggtacagggatatgagatagtccaatagtgtcaacttgattcaatcgatcaaacgcaatctctatccttatcattctccagtctgcacagagtactcccctgcaaaaaatga

SEQ ID NO: 623693 - DNA, 150 bp, Homo sapiens
agtgacaagtcgtattatcccagtcgacagtgttagcttgttatcagtgcaaaaaacgaagtccgatctttgcctttaaaacctatattagtttttgcacgatatatcttttttccatccttttactttcaaccattttaaacttttttt

SEQ ID NO: 623694 - DNA, 145 bp, Homo sapiens
ccggagcctgattcggcgcccggcgcggttcgaatcctcttcatcggcaactcccacacgcaaggcgcggccgaaacgccggaagggaattacccggctcaagtggatgctcggctgaaacagctggctcccggcaagcggtttc

SEQ ID NO: 623695 - DNA, 209 bp, Homo sapiens
aaagcccctccttaggcaacctggtggtctcccgctcccggtaggtcaccatattgatgccgaacttaggggtgacactccgatcggcatagcgcactacagcccagaactcctgggctcaagcgatcctcccacctcagcctcccgagtagctgggactacaggcacgcgccaccgcgcccggcgagggggtttgtgggtgagggtac

SEQ ID NO: 623696 - DNA, 416 bp, Homo sapiens
tagagcgcgtccccagccctgaggaactgtgagacggttaaacctcttccctatactaaattatccagtcgctcatatgtccttatagcagcttgagaatggactaatacagaatcctagaagaaaacctaggaaacaccattctggacatcagccttgggagagaatttatgactaaatcctcaaatgcaattgcaacaaaaacaaaattgacaagtgagacctgattaagctaaagagattttgtacagcaaaagaaactatcaaaagaataaacagacaacctacagaatggaaaaaatattcacaaactatgcttaagacaaaggggtaatatccagaatccataagatgcttaaacaattgatgaaccaataataataataataataataaataataatgacatacaattg

SEQ ID NO: 623697 - DNA, 102 bp, Homo sapiens
aaaagcagtgagcaatagaaactgtcctctatcccacagagaaagaggaggtggccaagagccaggacaggagagacaggcagacacccagccctggtctgg

SEQ ID NO: 623698 - DNA, 1039 bp, Homo sapiens
  misc_feature (510)..(510): n is a, c, g, or t
gccagaacacgtggatgctccgacccaccagcgtgacgtcctcatggagcgtggtaacattatggctgatgtggctgtgcactttctctcgggaggagtggcaatgtctggaccctggaccagtagggcccctctatgagtggacacgtgagtgcttgggagcaacgcatcgagtcacgctgatggctcggaatctagactagtgatgtccttcgtgtatattgcaaggcctgcatgtctcgagtctactgcgagcatgtgcagcagagggagaaccagccaatgtgggatcctcgaacctgcaagaggcaagcacgatggtggaccaggagcgcgagccaaaggtactcatcccaagaacagatttctaacgatttacggaccgttgcaagacttgacgtcacgtgccgtgcttgcaggacattggaccatccttaaacattcagaatccatatgtgcgacacgtcgagtcacgaaattctccccgacagaggatctattcgcttcaangaaatctcgtgcgcttcttcgggaccgaccgagttgtcctagagttctagatagtgtcttgaggtttatgaccaacggtcaatcttgggtgcaaggatctcctgtggacgttgaaaaggttgaccaagggccatttctacacgttttgcaagaacaattacaaacgtggcttgggcaccatggacggggaagcacaatggaatgggctatccccaaatggaacccgttttccaaccgccacggaacacgtcgcacacgccacaggtgggcaattcttacatgggtaccgccttgcgggcacaaacggccattcgggcgccccatggtgagcattctggctcacggcgcctcctcttagtaggacatctaggatccaagcggtcatgcagcgaatgtgcctccgacgaggacgagactcaatgtgtctcacaaacactcaggctgatagcaacgcgacaggtgtctgtgacgcaccaagtgacccactactcaatcgcagtcgcgtccatttccacatcaggattagcag

SEQ ID NO: 623699 - DNA, 367 bp, Homo sapiens
  misc_feature (97)..(97): n is a, c, g, or t
cttatgaagcaaaaaataaccccatcagaaaaaggcccaacctgatttaaaaaagaacacattaagaaattccccaaggctggacgtggtggctcanacctgtaatccccagcctttggaaaggccaagcccaggcggaatgcttgagcccagaagtttgagaccagccctgggtaacttggtgaaagtctctaggaaaaaaaaaaaaaaattagccgggcatgatggtgcgtgcctgtggtcccatccacttgaaggctgagatgggaggatcgtttaagcctgggagacagaggttgcagtgagccgagatcatgacactgcacttagcctgggtggcagagcgagactctgtcaaaaaaaaaaa

SEQ ID NO: 623700 - DNA, 739 bp, Homo sapiens
gctagaatactcacgtgtgagatctaacagctccgaccccgaggattaatcgctactgcaaatatctactcatacttcctaataaccaattgattagtctgtagttctcggtaacgatctattccaactgttgcatcgatctagagaaggggccgtacggagactcatactctcgtctacgtgtgcgtacagtgctagtttgccatggaattgtcgacctcggatgcatgagtgcacaaacatttagactagtcccagttcgaaagtcaatcgcatatacatagtccgaatctggctgagtagtcggttgtcattcctcgcccattacgacagtgatttaattccgtacaactgctcaaacatcactgtagaccgcgaaatcgaaactatggcgcctcttcataagagcgctaacttgcaatgatcctacaaccaccgaaataatgttaggaccgttccatccataggccagccatggcacggggcaacatagttcagtcactccaaaatgtgagggtccttcacaagaccgctgtgatattcccgccctacgagatgcgatgatcagaggggatcaacgaacacactcgaggtactgtctgagactcgctgtaagttcgccggctgtcaaaggaacacacctaaattagggtatgggataaggacaagggaggaattcgttccctatgagcattcgattcacagggtatgccaaacatcggcttaagacaggcaaaat

SEQ ID NO: 623701 - DNA, 961 bp, Homo sapiens
ggcttcctggtcaacgaggggccacattgtccacaactggaaaggcgcgatggttcatccattcggcagaacacgctggtgtactacaagcttgaggggggtcggagagtgacccctcccaagggccggagtcctcctggagtggactgacaccatcagcctggcccctgcctggacgtatgaaaaccgaccgctcactcattaagctgaagactcaaacattccacggaatgtacttcctggaggcctgtgctctgagaggtagcgggaatgcctgggccatttgagatcaccggggtctattcactgcaggggcagccggtggaaggtccagcatgctgcgcagcctggagaaagctccttcaagctgcacctccgaacatcagcctgcatcgcattgtggacaagatgcacgatagcaacaccggaatccgttcaagaccccaacatggagcagggaagcacgctatgagaatagacgcttccgtcggctcctccgctggtggactggcttcatctccaacaagcttcagcggtccagccgtctgcgaggcggtagaccctttgcctccatgactcatggagtgagaacgttcctcaggcctgatgggtagtccgaaagcagtgggaagccagttcgcatctggaggatctggctcgagcagtgtcctggatgactctcatcagccctgttacacttttgctgagagctacagaaagcacgataaggcccagaggaagaaccttagccctgaagcactggtggacgttcacgtggccacggtggctgacaccaaggcttaccggggccaaagccagggagcacaacgacgggacaactcgggcaccgtgcgatgagcacatggcacccacggcacggatcccagctgaccggccgtacatataacccttccccggcaccgcgaaacggcccagagcgcgggcaacaacacgcacagac

SEQ ID NO: 623702 - DNA, 467 bp, Homo sapiens
tgaggagatgaccctcaagcagttccttgattactttaagacagagcacaaattggagatcaccatgctgtcccagggcgtgtccatgctctattctttcttcatgccagctgctaagctcaaggaacgattggatcagccgatgacagagattgtgagccgagtgtcaaagagaaagctgggccgccatgtgcgggcactggtgcttgagctgtgctgcaacgatgaaagcggcgaggacgtcgaggtcccttatgtccgatataccattcgctgatctccgtgcattcccctaagccccagtcctccctcctcagatcctttccaatcctggtttccatttggcctcaggcagtggtccatgtagccaagcctggccttccctattacccagcaacctcaagaccctctcaccgctgctttgtaccttgtttggaacctaaatcccaataaaaggataattaccc

SEQ ID NO: 623703 - DNA, 278 bp, Homo sapiens
cccccccccccttttttaagaggggggagggggggtttcaaaactgttttgttaagtgggccctttaaggttaggaggaaaaggcggggggtaagaaaacaagggcgttggaaaaccctcccgaggaaaggggaaagttttgggggcccccttgggttttttttttggggggggggggtttaaggttttgggttttaaaaaaggggctttttaaagggaaaaacttggccaaaaatttggtccagaattttggggcccctttaaaaaggttaatggga

SEQ ID NO: 623704 - DNA, 746 bp, Homo sapiens
gtcagaggcgagagcatctgtgctgacttgtgagctggggtggcctgattctagttcaccaacgatgaggtccctcaggcgtgctggacctacctgagggagcgcgatcaagggatggccctgctttactgaccaaggggctacacactagctgtattctaagcgtgcgatcgctgactatttatgggactacgcttacgtgtcacacatcaagtaggatgagaccattctaggggcgccctgtctcaagagattacggccatggtaagtgctggcagctcatttaatgatctgaaccttcacttcgcgcatgtctatcacatgctttacgagatacccaatacattgactaacgtgtcctggagccttccgctgatgatgatacacctggatgtgcacatacagaccattggtgtcacatgcatgctctgaagtaggtggagagcagatcgtggctcgacctagcatatcagtcacagctgcattccttgagatgagattacagactcatgtgataccatgttatggctaccgatgatgacgatagcgtctgcagagtgctgattcatcgtggggtcgcatatgtgtcacaacctggttcaacaagagatctacaatctgctactgccagtacggagatctgttatgagtaacctgggttacgagggcctactactgtctgtattaagagcgcataggtctaagactatgctctgagtgggacgttttctaccgtggatcggggg

SEQ ID NO: 623705 - DNA, 906 bp, Homo sapiens
  misc_feature (43)..(43): n is a, c, g, or t
  misc_feature (377)..(377): n is a, c, g, or t
  misc_feature (541)..(541): n is a, c, g, or t
  misc_feature (550)..(550): n is a, c, g, or t
cccgggtcgggtgctacggaattaatgaactgatacgcagganagagtaggatgaacgaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccnactgattcgccgcacaggtcgtttagggcaacgccaagttcgaagacgtccccctgtgcttttccgcctcactccgagacaggggggccacacgagctgctcgtggccgaattcgagtttgagtgctggggccagatggccacccagaacacaccttcttttgnatcccccgnccctgctatgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgagccacaggacttca

SEQ ID NO: 623706 - DNA, 80 bp, Homo sapiens
gatgctttttcttttctcttttcaacctccaggtgaattcctgatgcggagatgagaccatgcccttctgtcgtcttctc

SEQ ID NO: 623707 - DNA, 886 bp, Homo sapiens
  misc_feature (607)..(607): n is a, c, g, or t
tgtactccagcctgggcaacgagcaaaaaactctgtctcaaaaaaaaaaaaaaaaaaaaaaaaaaaaaaaaaatgggtttccaggacaaagcttgctctttgggggggggacagttccaaaaacagaccctgttggtccttctactttcccgtgccgtgatttttccaacgcactaaattttataaactttttggaaacaaaattactgtgtgtaattttcccatttggggggcaaactcttatttctgtggtgagcatttatttaaacttctggtcggtacattattattggctctttctcttataaatatttggctcggggctcaggaagaagcgtgtccacgggtgtgactaatactctttagaataggtgcgctccattaattatatgatggcttcatggtcttcctggcttcccctgttgtctggggatgggggtcagaattggcttcctcccagttggacagaaaattccagggatggagatcagaagggatacctgggtggtttcctggacttttacaaatttctctggtttggtttccttttaaaaaaaaacgctttaactcttatgtgtttctctttattctcttttaggattttttnccttttttcacaatttgattctccgaaaaaaaaaaaaaaaacaacaaaatcacaaccatgcaacagatcaacaacaacaacacaacgacgggccagcgaactacaagaaaaacacctcccgcgcgggcagaccacaaagttaacggcgcaacaaaaatcttatcttccccaagcgggcccacaaatggcggcggctataagaaatggaaagcacagcagcgacctaacaagacaagtctgcgcgaaacaacgcggcaggaacataaggagaggcgatga

SEQ ID NO: 623708 - DNA, 200 bp, Homo sapiens
agtatcgtttgccgaactcctcagcgtatgcctcatcgtaggtgatgacggaagttgtcacagatggtgcctgaataaaactgccagaggtcccggcccagcacgccaaagttatcataggcatagatactgggatcgggagaatactcggggttgtcaatttctgggtggatccaagtgcccttgtaatctgggttgtc

SEQ ID NO: 623709 - DNA, 251 bp, Homo sapiens
agtggctggcggagtgcagtgctcatgctataattgtagcactttaagaagccaaggtggaggattgcttgagccaaggagtttgtgaccagcctggcaacacagggagacctcatctctacaaaaagtaaaataattagctgggcatggtggcacgtgcctgtagtcccagctacttgggaggctgaggtgggaggatcacagcagcagtgagctgcattgttgcaccactgcaccccaacttggagaca

SEQ ID NO: 623710 - DNA, 298 bp, Homo sapiens
  misc_feature (167)..(167): n is a, c, g, or t
tccctgtgtacgggacatggatgaagctggaagccatcattctgagaaactaacagaggaacagataaaccaaacactgcatgttgtcactcataagtgggagattgatcaaaggttttcaactggtggccactggtggtccccaggggcacgctgggcagcagcgnacatccctgtgctgacatgacgcgggtggagcgagctcctggctatctggatgcgtgcagcccagggtacacctgttcaacacacttatcactgcaacgggacggctcctgccacagaactgtcatccacg

SEQ ID NO: 623711 - DNA, 313 bp, Homo sapiens
gagcactgtactatatgccgattaatcatctacctgagcatgagtggtatattgattaatctactttttgtataaaagaaggtgagggtctagcaataatggctcaggttgacatcaaactcctggactcaagcactcttactgcctcagcctcctcagtagctgggtataatggtatgtgtacatttttactttaagagacagggtctcgtcctggttgtccaggctggactacagtggtataatcatggctcactgcagcctccaacacctggactcaagcaatcctcccacctcagcctcctaagtagct

SEQ ID NO: 623712 - DNA, 377 bp, Homo sapiens
ccaggctctctaggcggggtgggaatcttaagtagggtacctagggaagtgcttggtaatgagttgagttgtgtctccctagaatttaatatttaaagtcctaatctcggatacctcagaatattacctttttggagatcgggtcttcacagaggtaatcaacctgaaaatgcggttttagggtgagcctgaattccaaggtcagggggtgttctccataacagggacagttgggagacagacacgggcagggagaacacccaggtgacgcatgagggtggccactcaggcggggggtgggggatggaggggagtaccgggagcagacctttccttcacagccctcaaaagcaacagacccggcgagcaccgtgatc

SEQ ID NO: 623713 - DNA, 147 bp, Homo sapiens
tacactatgcgtgcccggatcatcccggattcggtcacttttggaagcggccgcgacctccaggctaagagcggcgccgcagtaaggcggggttctaggagctcctcgaagcttctgggctgcgcaaatgatcctggactggggaag

SEQ ID NO: 623714 - DNA, 327 bp, Homo sapiens
  misc_feature (16)..(16): n is a, c, g, or t
  misc_feature (36)..(36): n is a, c, g, or t
  misc_feature (172)..(172): n is a, c, g, or t
  misc_feature (281)..(281): n is a, c, g, or t
  misc_feature (291)..(291): n is a, c, g, or t
tcaccacaacctccgnctcccaggttcaagcaattntcctgcctcagcctcccaagtagctgggattacaagcatgcaccaccacgcccggctaattttgtatttttagtagagaaggggtttctccatgttggtcaggctggtcttgaactcccgaccttgggtgatccgnctgcctcggcctcccaaagtgctgggattacaggcatgagccaccacgcccagccccatgtgttttctgaggactccttcattatttcacacacacactagagccatgnttttgaaagntacggctgccaaacaaactgcatttattacataatg

SEQ ID NO: 623715 - DNA, 214 bp, Homo sapiens
  misc_feature (205)..(205): n is a, c, g, or t
gtcgaccccggcgtgcagccgaggtcgacgatgacctggcccggcttgataagcttttccgcttcgtcgatctctttcagcttgtaggccgcacgcgcccggtaaccctctttctgtgccaatttgacataagggtcgttaatgtggtcgtgaatccagtttttattgaatttgttcttggccattcgcgtaaaatactactttnatgtcgaca

SEQ ID NO: 623716 - DNA, 371 bp, Homo sapiens
  misc_feature (14)..(14): n is a, c, g, or t
  misc_feature (30)..(30): n is a, c, g, or t
  misc_feature (139)..(140): n is a, c, g, or t
  misc_feature (171)..(171): n is a, c, g, or t
gtaccacttccacntaagcctaaacacacngtccactaggctggactgacttggcaagtgacatcattctgttggttaatcaaattttcttggccaggcgtagtggctcgcctcctctaatcccagcactttgagaggnngaggcaggcagatggctttagaccagaagtncaagacccagcctgccaacatggcaaaaccccatctttacaaaaaatacaaaaattagctggcctggtggcgcatgcctgtagtcccagctactcgggaggctgaggtgggaggatcacttgagcccgggagatagagctgcggtgagctgtgttcccaccactgcactacaacccagacaacagggtgagaccttgtct

SEQ ID NO: 623717 - DNA, 644 bp, Homo sapiens
ggggacacacaagtctggatacatttcaaaagagccacccataaggagacaacaatgtccctgctacccgtgccatacacagaggctgcctgtttgcctactggctctactgggacaatcaaagggcgaccacttgcctgtttcttgaatgaaccatatctgcaggtggatttccacactgcgatgaacgaggaatcagacattgacttacatttccaagtgtgctttggtcgtcgcgtggacattaacagccgtgagtattgggcctgtaagcaacacgtggaatccaataatatgccctttcatgatggacaagaatttgaactgagcatctcattgctgccagattagtaccaggtaatggtcaatggccaatcctgttacacctttgaccatagaatcaagcctgaggctgtgaacactgtgcacgtgtggagagatatgatcctgaccaaatttaatagcagctatttaaagagataaccagacttcatgttgtcaaggaatacctgactgtacgagaacttgggattccaaagccagctaacagcatgatcttttctcacttcaatccttactcctgctcattcttaatcgcatgcggccgcatattgagcttacgtgtggcccgccttggccagtcg

SEQ ID NO: 623718 - DNA, 152 bp, Homo sapiens
atcatgataatatgtagaataaattttgattgggtatacaagtattagaaggtggtataattgcagagtattcatgatagtaactgacacagggtttactttgagaccagtgtagcaaggaaaacatgagttaaaagaaagcaggcaatatt

SEQ ID NO: 623719 - DNA, 400 bp, Homo sapiens
agtctctagaggatcctctatccgtgctcgggggtggtttctgccagtacgggagaaagatgtaggctgggaagctaggccagtctctccttttcacatttttcttctgctttatattcactggcagctgattagatggtgccctccagattaagggtgggtctgccttccccagcccactgcctcaaacgttaatctcttttgacaacaccctcacagacacacccaggatcaatactttgtatccttcaatccaatcaagttgacactcagtatgaaccatcacaagtccacccctcgtcaacttgaacccatacacatctgagatcatacataatcttcaaataaagacaataataaggtcataattatgcctaacatattacaactattctttgta

SEQ ID NO: 623720 - DNA, 328 bp, Homo sapiens
  misc_feature (118)..(118): n is a, c, g, or t
tccctcagagccagaagtgtaatgggaaggacaactgtggagatgggtctgacgaggcttcatgtgacagcgtgaatgtcgtctcttgcaccaaatatacctaccgctgccaaaatgncctcctgtctgagcaagggcaaccctgagtgtgatgggaagacggactgtagcgatggctccgatgagaaaaactgtgactgtgggctgcgatcctttaccaaacaggctcgcgtggttggtggcacgaatgcggacgagggcgagtggccttggcaaggtgagcctccacgccctgggccagggcactttgtgtggggcctcgctcatc

SEQ ID NO: 623721 - DNA, 801 bp, Homo sapiens
agcggctggctcctcctgagagctgttccccaccgcccatgcactcttccggttggaggctctcatgtctctctggggagagctggcagtgtgcggagctgataacattgttcccaagtattgagacagttcacaaggacagtcagcatttctagactgtccacacaatgatagcgagcagaagaaagggaagagaggcaagggaaggagagggaagaagacacagagagaggagagagagagaaagacgaagacaaaaaagaaaaagatgacagatagagataagaccacagaaagaggacaaaaagaacaacggaaaaagaaaacaaacagacaagaaagcaacgaagaaaaaacgcacgcaaagaaaaacaaaccacgaagaaagaaagaaacacagaaggagacaacacacgaggagaacgagaaagcaagagagaagaacgagactaacgagcaggaagcaggagcagagagagaggagaacagagaggaaagcaagaaaacacagagaacagcaagacgaaacaccacagaaaacgaaaacaccacagaggaaggaaaaagagggaacagacagacgcaaagacagaagaacgaaaggaaacaacgaaaaagcgaagaacagaaccaggcgaacaaagaaaggagaagaacggaagggacgaagacaaaaaagaagaaacacagaacaagaagaaacaagagaaaagaaagagaacacgaggaacgaagaaaaaaagagaaaacacaaaaaagaagacgaaagacgaggcagagaggaagaaaacagagaagcaa

SEQ ID NO: 623722 - DNA, 582 bp, Homo sapiens
  misc_feature (51)..(51): n is a, c, g, or t
tggagccaatcaccctctgggttagcccttgttttgagccctaacatgtgnttgggcactggtgggctgggctttttaggtggccctcctgccctaatcagggcccctccccgtttttgtgggcttctcagttgaacaaagcagcaaaacaaaggcggttttatatgaaagattagaggccgggaataatcgggctttttaaatgatgtaattccccctgtaaaagcatagggattttggaagcagctgttggtggcttgggacatcagtggggccaagggttttttgcccctggttcaactgtaattgggctttcccgggtttttccggggaaccccttgtttggggttttgggggtttgggtgggaaaagggccatttgcctaaatgtaacctgatagttctccaaaggcccctgggggcctggtttgtgtgagggtgtggacagtgggggccgccctgggccggtttgtgttgccaaaatgtcccggggtgttgggggggggtttcagccggccccccccccttgtttaaaaaaggccccttttgcccttttcaaataaaaagggagggcaggctccta

SEQ ID NO: 623723 - DNA, 167 bp, Homo sapiens
  misc_feature (17)..(17): n is a, c, g, or t
  misc_feature (21)..(21): n is a, c, g, or t
acctttttcacttcccnatgncaattctaagcctatgtagtccacacatgatatggtgctaaaacaggatgatgacttggtgatatgtattttcttgatatttgagctacaggtctttaatatttttttctcatcgggtaaagcctacaatttatacaagctttact

SEQ ID NO: 623724 - DNA, 374 bp, Homo sapiens
atattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattgggaaggcgtctgacaacctccaccagcaccttttggatgaaggaactgggagtcttgacttggttcgttagtgggattacttctggagcttgcaacatagcttcactggaaggagctgt

SEQ ID NO: 623725 - DNA, 345 bp, Homo sapiens
aggctcactcctatgcccaggctggagtgcacctcgacctccggagctcaggtgattctcccacctcagtctcccaagcagctgggactacaggcgtccaccaccacgcatggcttattttttgtatttttttgtggagacagttttgccctgttgcccagtttggtcttgaactcctgggctcaagcggtcctcccacctcacccttccaaagtgctgggattacaggctaagccaccatgcctatctattatttttgagagagggtcttgctctgttgcccaggctggaatgcagtggtgcgatctcgactcactgcagtctcaccctccctcctcagcctct

SEQ ID NO: 623726 - DNA, 549 bp, Homo sapiens
tcgtgccgaattcggcacgagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggcctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcagagagctgattggtccattttacagagtgctgattggtccgttttacagagtgctgattggtctgtttttacagagtgctgattggagaaactgaaaccagaatacctgccagcactccctgaaatgctgaagctttactcacagtttctgggggagcaaccatggttttttggggacagaatcacctttgggattttatc

SEQ ID NO: 623727 - DNA, 254 bp, Homo sapiens
agatagacagtcccaccctcagacgtattcttatagctttcactgcgtcttgcccttcatgatagcagccctagacagcatcaccacctcctattctgtgcagcgagacgcggatcaaacaatccccctaggaagtcacctcccacttccgataaagtcaccttccaccctaactacacaatcaaagacgcccctcagcatatctatctcttccttctctccttaatgacaattgcaacacggtctctcaggga

SEQ ID NO: 623728 - DNA, 556 bp, Homo sapiens
gctgtctgaagatagatcgccatcatgaacgacaccgtaactatccggactagaaagtacatgaccaagcgactatcttcagaggaaacaaattggtcattgatgtccttcaccccgggaaggcgacagtgcctaagacagaagttcgggataaactagccaggaatgtacaagaccacaccggaatgtcgtctttgtatttggattcagaactcatttcggtggtggctagatcaactggctttggcatgatttatgatatccctgggattatgcgtgagaagagagaattgaacccggaagcatagactgtgctagacatggcctgtatgagaagataaaagacctcaagaaagcaacgaaaggaacgcaagaacagaatgaagaaagtcagggggactggaaggccaatgttggtgctggcatgaaagtgagctggagatggatcacagccgaaggagtaaaggtgctgcaagtgatgttagctgtggccactgtggattttgcgcaagaacattagtaaactaaataacgttccaatgagaataccaaccaa

SEQ ID NO: 623729 - DNA, 205 bp, Homo sapiens
gctacgctgctctacttatatgtagttgccaaactgtatggccaggcgctcagtgacgcagtggaaagtggccggctgcacctacccagtaaggacacggggttgtatgaagagtgctgatgccggttgtagctaggccctgcttcacctccgaatgcccatgggacatgaagtcgttgacaccacactttggtgactgttgttg

SEQ ID NO: 623730 - DNA, 101 bp, Homo sapiens
gtgaccagacccccgtagctgtacatcaccgtagctgtacctcacccgtagctgtacctcacccgtagctgtacctcacccgtagctgtacctcacccgta

SEQ ID NO: 623731 - DNA, 162 bp, Homo sapiens
ccccccccccccccaagccagtgcagttaaacccttgtctctctccaccacccaaactgcatttgctgaagtatcaaggacctctgtgcaaacccagagaaaacatctgagattttccaaagagaaggaagagccaagagctgctatatttaaggtcgacgc

SEQ ID NO: 623732 - DNA, 372 bp, Homo sapiens
tactgcatgaatagaatataaccgatacttcgctatacactgacatgtgagtgacaacctgcaatactttgtaatgacctggtgcattggctaacttcacttaacataatggcctccagtatcatccatgtcgctgcatatgacaatattacagtttcgctggatctagaatacataactagacagttaactaccatcaataactgaatacatccacccacggaacttgtgttcctgaaggttctgaagagaaatccgatgatgatcttctggggaaattataataatagatatcctcctctccattctacagatgttaataatgtacccaattgtgtcttatgcaacagaacatttccttagggtatcatg

SEQ ID NO: 623733 - DNA, 660 bp, Homo sapiens
  misc_feature (20)..(21): n is a, c, g, or t
  misc_feature (107)..(107): n is a, c, g, or t
  misc_feature (489)..(489): n is a, c, g, or t
  misc_feature (499)..(499): n is a, c, g, or t
  misc_feature (518)..(518): n is a, c, g, or t
  misc_feature (524)..(524): n is a, c, g, or t
  misc_feature (541)..(541): n is a, c, g, or t
  misc_feature (598)..(598): n is a, c, g, or t
  misc_feature (613)..(613): n is a, c, g, or t
  misc_feature (625)..(625): n is a, c, g, or t
atgccagccttaaaataccnntaaagccagataattatcagaaataatcattattttagaagtttttaaataattatttctgactttcttagtattgatgaagtgtncttgagattagtgtagtgctaatagatattggtgagtcacatgtaatttaaaattttctactagtcacattaaaaagtaaaaaggtgaaattaattttaataatatattcaactcaatatgtcagaaatattacaacatttactttacatttttttaatgagtctttgaaatcttcaactgaatttgtattttacggttaagagcacatctcaattcagattagccacagttcagttgtgcaatatccgcgtgtgggtgactgcaatggtattgcagccctagtgcattctaggcaatggaaaattttaggaatttggtaccttggaggttggattaatggtaccttttccacctatggccttaaaaaaccactggtatttntggtggtggncccaaaataggtaaatccnggtggnaaggaggggttatggtncccccattcctccaaaccgggggaaggtttattaggaatttgccaatcctggccccncggggttaaaggttnccctggggttanctattgggttattatacccaaccggggtttaggcc

SEQ ID NO: 623734 - DNA, 412 bp, Homo sapiens
tttagaggatccccccgggtgttggctctgctcccaggccggcaagctctaggcctggtgccagtgttgctgaggggcagctgagtgtcccaggctatgtgggggagctctcagagggtcaatcgcagaaattgctcagccccactcctccatctcttccagagaaactcgctcaaccacctgccacaagcaggtggcgagaatgtgggcctgtcaaggcgagagcgtcggcctgtggccgctgatggggaggggtggacggagggccccatgctctgggggacttcacggcagtttccatggaatgagcttcataagaatgaccttaaatagatatttccctcctagtttcttcttctttttttttttttttgggaagagggaacaggggggggggtgtcggagttaaaat

SEQ ID NO: 623735 - DNA, 240 bp, Homo sapiens
tgatatgcataggactaaattctccctgattatattatatgctcatcacagtgaatttgaatcatgatcagcggcattttgcctgttatctcaacaattaaatcacataaacctatactttcaaaggcaaaaactgcaattacttttgcaccaacttaatagtttcatcagacattaagacacatgcatgtatgcatgcgtgctaattctcatggtttgttctgggcatgaatctgcctc

SEQ ID NO: 623736 - DNA, 225 bp, Homo sapiens
gtgagctcctatctgtcaacacagcatcagacactggctatcctcgatcatttgttaccaagcatcttacatgttacacagatccgagtctaggaacacatcagggtcactgtctgtctcgtaaggataagcattcgtgctcacatagtactctaaacacactatggcatgcacacagtcatacagctgatcctagtgtgcattcttgctcgtgccgaattcctg

SEQ ID NO: 623737 - DNA, 118 bp, Homo sapiens
ggtatagcaaaaaggtgattgtagtggtttgggaaaaagcaggcgtccaagagtaacacagcatgaccagtctgtggcaagttaaatctgctaatagtcttataagaagaaattgggt

SEQ ID NO: 623738 - DNA, 1229 bp, Homo sapiens
  misc_feature (171)..(171): n is a, c, g, or t
  misc_feature (179)..(179): n is a, c, g, or t
ggaccgtggactattctctacagaagcacaaagacatcggaacagtatggcctattattcggtcgtcgatggagcgggagtccgtagggcacagcgtctaaggcctccgttagtgtcgagccgaggcggggccagacaggcatacccattcatagggtaatcgagccacantgtacaancgatgtgagtcggtctacgagtccgcatgacaattggataataaatcattcgtctcgatagatagagtgagccgcaatcataatcggaggctcagtgcaactgactagtgcccctagtaagtcggtgcccccgatatggacgatgaccgccgcataaacaacataagctgctgactctgtacctccgcgtctctccgtacatccatgctcggcagtctgcttataggggaggccggtagcaaggaacgaggtgtgacacagtcgtacccgtcgccttagcagggaactactccacaccgctggagcctccgtgagacctaaccgatcgtatctcggttacagcgctagcgaggggtcgtcctctagctgtgaggggccgatcaaacttacgactcagcaataacttatcacagataagaatcgcgcgtgccgataagccaatactgaaagcgccacctgcttcggtctgatccgtcctaagtcagcagcgagtccgtaggtgtactcctatctcttcgccagtcctagctggctggcatcactatactactaaacaggaccgccaacctggaacaccacctggcttcgaccccgcggagggcggagaacccgtttctatagcaaacacctattctgcatttcgagcaccctgaagtccaaaacctaatctaacagggtccggaaatacctcccaaattgggacccaagaactccgcgacacaaggaaccgtgggacgcacctcacggaggccgggcatgcgaacacaagggctcaacagggaacccgggggacccaccccaatctacacacgcacgaaacacacggcagcccaccggagaattccccccgcccaaaaagacatgcgcggcccccagggggtaagaaaacacgaccgccacccgacaagccataaacctacgggggccggccaacacaacaacgacagagcgacgacaagaacacccccgaccagccacgacgaggcaccagcacggacgcaacgataacaagaacccccaacagaagacagtaagacaacaaaaaaagag

SEQ ID NO: 623739 - DNA, 171 bp, Homo sapiens
ttcggctctcggataccacaaagggagatctcagccccaggagccgcagactttttgctacagaagtaacaaccactaaaagcgaaaggaataaatatctgtgcgtgtatacacatacgcctagggtgcccactgcaggaacatgactgggcccgccgtcccaaagcacag

SEQ ID NO: 623740 - DNA, 344 bp, Homo sapiens
tgatggactgtgtgtggcttccagaacccactatctatgcttgagcaccgaaactactcgatcagcacttctcatccatgatcaaatggtcgatcgtggagatatcatgtgtgtactagatgacggcatgccgctttatcgaacaccacatgaatggggtcgcctaatcatcgaatgtacgagtagacttgtcctggagactggcttacgctctgctgataacctgtccttgctgggaaaacccttaccggagaggacggaagtggaagagactgatgagatggaccaagtagaactggtggactttgatccaaatcaggaaagacggcgccactacaatggag

SEQ ID NO: 623741 - DNA, 183 bp, Homo sapiens
ggtcctcccccttcccagggggccaatttttacccgcaatagtgattttgggcttgtttgtttagttttgggtaaaaatggaatgttggggaaatgccccctccctgggcgggggggttcttttcccttttcccctggtccgggctattcatggaagcgggcccagtaagggcccttcgttta

SEQ ID NO: 623742 - DNA, 309 bp, Homo sapiens
gatcggctcggaccccgaagccactgcacatcaagagttctgaaaaagaaaagaaacaataattttatatacatttaaaaccagaggagtaggagatttttatttccttatgtaattcaaaaccagccagaaaacatacttaaagagtaagggtctcaaactcctgacctcagatgatccacccacctcggcctcccaaagtcctaggattacaggcatgagccaccgtgcccagcatggccaacatagtgaaaccccatctctagtgaaaatacaaaaattaggcaggggtgttgcagtgtgcttccg

SEQ ID NO: 623743 - DNA, 291 bp, Homo sapiens
ggcactgctgccatgaatgccttcctgctctccggactgagcctccttggggcctgggccacctgggcaggaggggccaccgctcatgatggaaattcctccttttctctggagtcagcgaagaagctcagagaccttcaggagccccatgagcccagggttgggaaactcaggaactttgcgcccatccctggtgaacctgcggttgccatcctctgtcgcgacccgaactttccagaataactcaagcctctttgcaaggaccccaatgcccaagagatacttcatagg

SEQ ID NO: 623744 - DNA, 728 bp, Homo sapiens
ggtcaatgatggcagaagtagatgcggaagaagatgtcgtgacttccgcaagttcgcctaccgtggcgtggacctcgatcagctgctggacatgtcctacgagcagctgatgctgctgtacagtgcgcgccatcggcggcggcatcggaacctggtggggtcgctgacgagacgtgcaagtccagcaacttctccccatgacatgaaagtctgccttgtggcatatggccaagaaaggtagagtctggcagacactgtgagaaggcccgtgaagtggtcgatagactcatctgcggcgacatgatcaatctgtacccgacgatggtgtgtggagcaatggtggtgcttgtctcacgacgtgtcagagagctttgttcacaacgcaaggtgtggacgtctcacacgcgccctaagaagtgtgtccgggaaccactgtaacgcctagagtgagaagcttcggtccgactccaacgcgtatcaaaaagcacgctggtaaaaatggccatttgggcgcgggacctctggtcacatcggggggagtcgctaacgcaaggtcgctcgccggtgtttctagtccacttcttcaatatgttataattgcgtcatccatgccttacagtgaaaacgggtggtcgaccttttgaaccttccgaaggaaattgcatggaaaggacgtatcgaggtaggggccattcctaagaaggttggaggtgctggagaagaaccgg

SEQ ID NO: 623745 - DNA, 657 bp, Homo sapiens
gtgtgtgtctaacctaagtggtctgcgaaccgtggcctacgagcgcgtgaagctggaaaagcttgaaggagtagtattctggccgactaaatccctggcctagctagaactgaccaggacagcaagaactgcactggcactgggcatgctcagctggacatacagaagattgtggaatttgatgtgtgcaacttggagtgccatgtgaactgatagagacgatgcaggttggtctcctcttcatattgcggcttctgctggccgggatgagattgtgaaacgcccttctgggaaaaggtgctcgaagtgacatgctgtcaagtcaaaagttggctgtactcccttacagttatgcagcttcgacaagaagcaggcatgagatcgctgtcactgttgactggagaggcggggcgtaatccagatgcgtaacggaccagttatgaggcgtacagcaatgcaccgggcagcagccaagggtaacttgaagatgattcatagtccttctgtatctacaaagcatccagaagaatccaagacgctgagggtaacactcctctacacttagcctgtgatgaggagagagtggcagaagcaaaactgctgggtgtcccaaggagccagtatttacgtgggcgcagtgcagaagaaacagacaac

SEQ ID NO: 623746 - DNA, 253 bp, Homo sapiens
caagaggtggaaggtggaagagcctcactgacattcagaccaatttaatgacaggtcttggattgacatatacatattttgaaacgaaattttgctcacttcaacctccacctcccaggttcaagcgattctcctgcctcagcttcccgagtagctgggattacagcatgagccacaacgcccggcttacaagacttttttttccagatggaatctcgctccagcctggacaagagaatgagattccatctca

SEQ ID NO: 623747 - DNA, 1093 bp, Homo sapiens
catctacaaactcaattgtctgctctaccacttcgtgatgtctcgtgcacccgttacaggctacagagattgcctgttgggcatttgcctgaccgcaggtcggtgcgtcctggctgcctgttgagcgggccgaggtcccattttcctaggactagcgacggcgaaatacatcggatgaaatatgtctatgtgttcactctacaattcaactcataatacaatgcccaagaaggggtctccgttggctaggcctaatagacactatatctctcatactgcgttttcattacttttactagccatgagatccatgggatgcttcgttgtcttcagtatgccatggtggtgcggataccaaacatcccagtgctccacgcttcttggcgtcgatgcctgtgcgtcgcgtctggcaaggccaatccgctctgtaatatactctggtaaaccgatagaatctctgtctcgggggcctgtcccagcgaccgtgtctctggggggcagccatccgctcttgcggtggtgcaatggctagccttcgttggtggctctagtagctaggatgcagacgcctagggtctgcactcggtgagagattggttttccctgtgcccccatgtgcttcacttcgtgctacctttcttcgtgatgatctctggaacccccccaaagtgctgaatacatggcgccgcatggtgccaccggggaacgctccctgttctgagtcatcgcacaggggtgttgccttgattggctggcctgctccgaccgtgcctcgcggcacgttgggggctcccccgtggggtacgacgcgggggcctgttctcttgtcgaaggctgctatgctcgtggtgggccctagtaaaggccatcttcactgggatgtggtccacttggtgggtgtagcttatagggtcggtgctttccaccagcggtttggttgattacaaccctcaggttgtgttttaccccggggtgaggttccctaaagaaagattgggcccaaatgttgccggggctccccggtgcgcttccccgggcgcgtaggcctttgttttttttgcccccttgggggtgcccccatatggggcgggcc

SEQ ID NO: 623748 - DNA, 369 bp, Homo sapiens
caactctgtaccgtgcgtaagtttaacactataggaagctgggtaatagatactacaggaacgctactattttggacaactttgaggtaagtctgaaattatttccataatgaccaagcttttaaaaatacatcatgaatgaggccatttatctttagtagtaatacattttaaggaatctttagggtttccatttaggataatatttgccatacctcatgaatattctaatcataatctctgaggtgggagtgaggcatcggtattatttttaagccctttatgcgatccctattgcagtctagtttaataactagtagtatatactataacaatcaaatgaacaccattcgcaatgagtacagatta

SEQ ID NO: 623749 - DNA, 132 bp, Homo sapiens
gatggaacgaaaaggacgcgaagaatcggcagggagaagcggacaggatgtcccgaaaggctcatataaccgaaaaggtgaccattttcgtcagcatggggagggacccgccagcggagacccagcctcaga

SEQ ID NO: 623750 - DNA, 413 bp, Homo sapiens
ggtgactctaggaggatcccaccgtaatatgtacctacacacatcctcccatatacttttttaaaaaatttatttatttttgagacagactctcgctctgtgcccagactggagggcagtgttgcaatcagctcactgcaacctccgcctccctggttcaaacaattctcctgcctcagcctcccgagtagctgggattacaggcatcgcgcctggctcatttttgtatttttggtggggacgggatttcaccagtgttggacaggctgctctcgaactcctgacctcaagtgatccacccgcctcggcctcccaaagcgctgggattacaggcgtgagccaccgcacccggccatagtttgtgtatttcaaggcattgttccgtttcatttaagtggtcacaatattacggt

SEQ ID NO: 623751 - DNA, 1071 bp, Homo sapiens
  misc_feature (1071)..(1071): n is a, c, g, or t
gccaggcgtcgctgtacggcggaggataggaaggtccacagtatgcctggaactcagtgaactctgaactcaatggccagcatggtgagtttagcaagaccttatttacactcagaatggaaagaggaagctggggatatagctcggtggcagaggcgccctgcctacagtgtgcaaggtcctgggttcagtccccagtactgcaaatagaaagaaaaaacattgtcttggactaactataaggtttaagcctcatagtcagttctaactcaaattatgcatgcattgagttcttgtgtgcttatttctgttctaaaattaatgggctttatgggtttagtataagtatgtatatatgtctgtaatatattagaggtaggggattgaggcagggtctcactgtggccttgagctcatggcagtatacctgcttcaactgagtgtttggttcgtcgtgtagagtaaatttactttcatagatttgacttaatgaaggcaaaaacctgttatcaacctacaagacattgatgtgtcacttcagtggtggatttactccctcttaataataaatcccccagaagctgaggaccaaaaccagggctttgaactggctaggcaggcagctctgcaactgagctaaatcccaagaaccacaccacactagacaaaaataagagacaggggccaaacaaagcaaagaatggcgataaaacgcaaccaagacaaagaatgatagagaaaaacaccatggccgaacgacgagtagacaagagcatagtcaaaaaccaaataaacagaccaaaggagctaacaaaacaacaagagatgacacaacaccagagggcaccaaaacacagacaaggaacacaggaggaagagaaaaaaagagaaacagaagagccacggagcctaacaacacataggttaggacagccacgaaaacaaggaagtgcgaaaaaaacagcagagacaaacaagcgagcacaacaagaaaacaaagaaaacaaaaggagaaaagccacatgtgctaagaaaccaaaaacaaaaagacaaccccctctcatgggcttn

SEQ ID NO: 623752 - DNA, 286 bp, Homo sapiens
caggcggtatctctcacccagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 623753 - DNA, 379 bp, Homo sapiens
atataagatattttggtgcttactcgaccagcggcaaacaccctgcacacattgtatgagttcagcattgaacaatacagatgaattttcactcacctggagctcatgttctcatcggaaatcgaccagaaaccatccatacatgtgcacatgactatgtttacaatgtctcagtggttgagacctctgtgaggaaaaataaggcaagataagggaatggacagttagacccttggttgaggacaagggaaccagtcagccattcacagctctgggacagagaattccagggtgagggactcacaaatacaaaggcgggatgtaaggatgcctcttcagaaacttagagaaggaccggtgtagctcgaggaggatgggg

SEQ ID NO: 623754 - DNA, 414 bp, Homo sapiens
  misc_feature (46)..(46): n is a, c, g, or t
  misc_feature (216)..(216): n is a, c, g, or t
  misc_feature (347)..(347): n is a, c, g, or t
  misc_feature (397)..(397): n is a, c, g, or t
gggcacgagcttgatcgtatctgggagttgctgctgcgtgccgccngtgctgtggtacgccggctttgcatctggaccgtgctgccctgatttgccccccctgtaggagcgggcaagctcgctcctacctcgttaaccttaagttacaaacctccttttcgaattgagctatacagacagagcgccaaatagtggctatctgccgccgccctgcgncctcaataaaaataaaagaaaagggagttcacctgtgaagagcttgctcttatcccgccgtcgcgttcatgaaccgcctggacctttcggcattgaagttcagcctttattcagcgtgctgtttcctgttngcccgatggttgggccaccaactacttacctgggtgcgcgatttctgggngttgaattttccagggg

SEQ ID NO: 623755 - DNA, 318 bp, Homo sapiens
  misc_feature (4)..(4): n is a, c, g, or t
ttancccagccatggtggccattaagccaagttgccttggaggccttaggtgattgggaccccttgaaccctgggaaggcctgaggctggtagtgaacccatgggtcaatacccattgcacctccagcctgagcgacaaagtgagaccctgtcctcaaaaacaaaaacaagaaaaaatcaaaaggacaaattaaataattgttatgaagttgaacttctaaaacttgttcactgaaatgttttgacccgcattaatgctttatgtcccacatttatattgaaaatccacatgcaaataaaaatggaaaaaccaccaat

SEQ ID NO: 623756 - DNA, 183 bp, Homo sapiens
tattagagatccctacactcggcccagcgattctgcgacgttagtatctgccacaaacagcgagcagcgtctgacgtctagtgttgacgctccacgcctagacagaaagcggatgtgttctgtgcctcaagtcgtgcgttgagctacagaagttgctatctgggcgctggtcacgaggttggc

SEQ ID NO: 623757 - DNA, 366 bp, Homo sapiens
ccatatattatccagtgtatttacacccaaaaatcctataaaataaacacagtgttttctcgtgtttatatagatgagaaacctcggatagagagttaagttttcccacagtcacgcagctagtaagtgccaaaagctgggatctgaatccaagaagtccaattccaaaatacaggctttttccattatattagagtaggaaaccaatgcaaccaaatggaaaatggaaatgagaaagataaatggatcaatccagccagttcatataggcaaatacacaggtgatccaaaaagagaacacagacacaaatcatatcactcaagatatgtatcagtattggagcacataaatattcagtataagag

SEQ ID NO: 623758 - DNA, 919 bp, Homo sapiens
  misc_feature (1)..(1): n is a, c, g, or t
  misc_feature (249)..(249): n is a, c, g, or t
  misc_feature (274)..(276): n is a, c, g, or t
  misc_feature (321)..(321): n is a, c, g, or t
  misc_feature (344)..(344): n is a, c, g, or t
  misc_feature (369)..(369): n is a, c, g, or t
  misc_feature (374)..(374): n is a, c, g, or t
  misc_feature (409)..(409): n is a, c, g, or t
  misc_feature (433)..(433): n is a, c, g, or t
  misc_feature (472)..(472): n is a, c, g, or t
  misc_feature (486)..(488): n is a, c, g, or t
  misc_feature (493)..(493): n is a, c, g, or t
  misc_feature (495)..(496): n is a, c, g, or t
  misc_feature (499)..(499): n is a, c, g, or t
  misc_feature (501)..(501): n is a, c, g, or t
  misc_feature (506)..(506): n is a, c, g, or t
  misc_feature (512)..(512): n is a, c, g, or t
  misc_feature (515)..(517): n is a, c, g, or t
  misc_feature (519)..(519): n is a, c, g, or t
  misc_feature (533)..(533): n is a, c, g, or t
  misc_feature (538)..(538): n is a, c, g, or t
  misc_feature (553)..(554): n is a, c, g, or t
  misc_feature (556)..(556): n is a, c, g, or t
  misc_feature (563)..(563): n is a, c, g, or t
  misc_feature (566)..(566): n is a, c, g, or t
  misc_feature (580)..(580): n is a, c, g, or t
  misc_feature (587)..(587): n is a, c, g, or t
  misc_feature (612)..(612): n is a, c, g, or t
  misc_feature (681)..(681): n is a, c, g, or t
  misc_feature (736)..(736): n is a, c, g, or t
  misc_feature (776)..(776): n is a, c, g, or t
  misc_feature (788)..(788): n is a, c, g, or t
  misc_feature (811)..(811): n is a, c, g, or t
  misc_feature (828)..(828): n is a, c, g, or t
  misc_feature (850)..(850): n is a, c, g, or t
  misc_feature (859)..(859): n is a, c, g, or t
  misc_feature (918)..(918): n is a, c, g, or t
naacaataacaagagaaacctttatagacacaatatatcttgcattaaatcagagacggtttaaatcagtcttgtaacttctaatattctgggctggcaactacagcatgacaaatgtttagtgcagttacaaaatcacattttactttccttggctagcaaaccttaaacaaatctgaaaaatgcactgttttacaaaggcttttaccatatacccactgctgccagtctcaagtaattatggtttcntcatcccccaggaacatttctaaannngggggatttttctttgatctgctcgccttgaagtgtatgtaaganctcaagagagtaagttgaaagantgaagattaactgagatgccaaganaagtntttattgcaagcacagtgagcagaaagagatgtcntctcacacaaagtggccacaaggnctgccattaactaaatctctttgacaagccttcattggnttaaagcatatgannnagcgncnngcnancaggnggacancannncngccatgtgggacantttcntgggaatatacaagnnanacgccanggngccggacaggtccncaatggncacatcagccacgaagacgcgagcntgcgcagaacaggatcggggagagccagacagagttctggcgtgcagcgactgagagtagtcctcaagngtggatctgcgttctggagccaagggagggacactctgcaggcctgaaaaggaanatacggccagagcatgccagcgcggacacgggcaggccgngccgaggcaggngcatggcgggcccggggggagcngggaaacggagggaaancatataaagcacgggcgggganacggtcggnggggacggggggaacggcaaaagaagcggccggcggacgcgcgtaggggacctgggaana

SEQ ID NO: 623759 - DNA, 403 bp, Homo sapiens
agtcttgcggggctgagccgttaacctgtgggggtctgctggtatctccaggaagacgctgtcagaatagatgactgaattaggatgacagacgacacccagcctgtgtccactgcagaactgacgacctgcgtgatttgtggggagaaaatccccacatacctggtgtccgaaggcatgttgcaagactagtgggagaaactgagtttgtttttactctaaattgtcagactgttagtcactgcggagaggtgctttctgatgattgagtggggattcctgtccaattgtgtgagtttgtgtctcggccctaccactttttttttttttttttttttgaaatgtagtctcgccctgggcaataaagcaagacccagtctctagaaaaaaaaaatgattaggt

SEQ ID NO: 623760 - DNA, 427 bp, Homo sapiens
  misc_feature (363)..(363): n is a, c, g, or t
caaatgaaatctgcagcatcctcagactcaatcaggaaatacttaagcattatgctccagggtggttttcttcccttacattgcaactggactccttgaggcaccttttagaattagtgagccgctaggatttttatactatgctttgacattaaagaaaggttgcttgtcaatatgtgtttttttagtttaccagcatatcagatctcacaaaccaattttaggctcggattggatgtttctaaggtaaaaaccagaaaattcaggcatcccttaaagaatcagaaattcgttgtggcctgaaaggtgccaacttaattatatagctaacagtaacggtcccccactcctgcttttcttggntccagtagataaagtaaatgaaaataggaacccaggtcagtccccaattccttttaaacaaacc

SEQ ID NO: 623761 - DNA, 345 bp, Homo sapiens
tcctgaggttccgtagctgggatgttccctctttccttcaactgtgcctgtatgcatatttgaacggaaggagacatcccaaatgccgattcctattgatcttggtttctgtatggagactggggcttccctataggagccatattcaactacatgccttctaaaacctgtgccctcagacacttcgaatgccagcacaccttctggttctaaaacggggagtgtgtctgaatgaacacatgctagacccttacccgcgcactgacagggcatgagtcatgctgaagggtcacaagggccatgactgtctcaacctctgccctaatcagcagtggttgtggctgc

SEQ ID NO: 623762 - DNA, 808 bp, Homo sapiens
tgcgcgctatctaggttgccattctgtgtgattctcaagtggccttttcgctcgaaaatctcaagccgtatagttgaaatgtctctgtgaggcattgatgggtcagggtgtcaaatcgtcaaggaggttcgccacttgctctaactcctatcccgctgcggtgcaatgctagctcttgtttacgcgtgagacaagacgtggagatctgagacatgagttattgcaagctcagtgtgtctgctgtgtcggatagggtgccaagggcctggtgcacacgctgcacatgcgacactaggcccctgttgtcacgtcaggctctcccattcgtccttcgctgttaatcactgaatggccgcacttacgtgtcacttcgtgctttagaaagaacaattaggtcacgttgtttctctaggtacgatgcggtttcataatgtttgattgcgatgaactttggacgaattgatgctctgttatccctttttacatattcgcttgaatagtgttcctgtttaactcggataggtggatacttcaatccttcaagcattcacacacgtttatgatatacgtaacgttaacggtcatatctcgctggttatataactagtcttaggagtaacgagatcttgtagtttgattcacgattcgggagaatccgttcgtacttttgtgcatcttgggacataagtaacagcagtggagtaagtatttagaagagtgacttcaccgtgaaataggtgacgataaattaaaagatacttaattcccgcctatgcctcagtctattctgtaaaatttaacaagatag

SEQ ID NO: 623763 - DNA, 823 bp, Homo sapiens
agcggggcggcggcggtggcggtggctgaccgcggagggggcggagggagcccgcggtggcggcagctagctactagcgaaatggcgcgagaccgtggctgacagccggcggctgatcaccaagccgcagatcctgaatgacgcctacggaccccccagcaacttctctcgagatcgatgtgagcaacccgcaatacgtgtcgtggggtcgtgccggggccgcttcaccacttacgaaatcagcgttctagacagatatcttcctattttcaatgctgataagagatctacgtgttagacagacagactactgtgagctttgaactggctgctgaagtgtaattaggaagatgatgagagcatgggtctgtagttccctccgatccctgggaaagcgtttttgcgtcacgcgttccttttagaggagatgatggtaatatttgatgacaatttttacttgaggaaatgaaacatgaagggctggagcaggtttatagagacatagggtcgactggtctatcctctgtgcacatgaatgaactgttgtcttgcacgatgttatgttactacagatgaagatagatagatataaatgctatactccatctagaagataagacgatgtctgagaatttgggcaagaatggggcataaatacgttgactattaatgattgataagcagccagtgaacgaagttctaacttttagcatgctgcacggaaactggtattagcatgccttcagtatactaacactcatatgctcagaaggtgagtgatggaagttgacaagaagttaatttgttttagtaaaagtcctca

SEQ ID NO: 623764 - DNA, 163 bp, Homo sapiens
acttgttacgaaatatttctcatcctactacttcatgtttacatctctactgatcttcaaaaagcttagcatgaaatcattcgagaaggaggataccactctgtttttctctcgttgtgagtcgccatcatgtttctgatggatttgaatattctagtaaagc

SEQ ID NO: 623765 - DNA, 323 bp, Homo sapiens
ctgaggcatccatgcgagtggactgcgtatccaccaatactgggtgttctaagagatggagtcttgctatgttgcccaggctggtttcaaactcctggcgtcaagcagtcctcccgcattggcctccaaaagcgctgggattacaggcatgagacactgctcctggactgtgcaattttaaagacttgagcaaataaccccttaaaatgtgagttttaggatggtgggtagggcttcaatttgaaaactgttaccagggaatgtgattataacatgcacagttcccactaagtgtgaaaatatagctgagaagcatgaaaaaa

SEQ ID NO: 623766 - DNA, 355 bp, Homo sapiens
  misc_feature (241)..(241): n is a, c, g, or t
aagaggggaggtctgtgtgcgaaaccttagaaaaaggaaggaatttggagaggtgaagatcagcgctgagaaagaagtttgccaaaagatggttcgaaaggcaaggaggaagttatctattaaaaaggaaaggaatattaccaggaatatagggagatgtacagaactggaattcggatgggcgaggatggcaagaaaagctggcaacttctatgtacctgcagaacccaaattggcgttngtcatcagaatcagaggtatcaatggagtgagcccaaaggttcgaaaggtgttgcagcttcttcgccttcgtcaaatcttcaatggaacctttgtgaagctcaacaaggcttcg

SEQ ID NO: 623767 - DNA, 494 bp, Homo sapiens
catttacaattaagaaaacagacacaaagaaattacaaattttgccccaggttacacagttactaagtggtaaagacagtatgcataattagaagaagaactactatttgaattcatgatttctttattacaattatctactgctgggtaataaatcatcccaaaatataacggtttaaactaacaacaatcattttattagctttcacaatttctgtgagtcaggaatttgtacaagcccagctgaaatgctagtctttgcttcccgaagtctgaatcttacactgggaagaactgcggcaactcaatggcccagggctagaatcacctgaaaccttaggggggtttcaccctccccggaacacctggatggggcccaaccatagggctccttgggactccctggcaccccccaccggtttcccaaagcaagggttcccaaagaaaccaggtggaaacttaaccaccttttattacccctaacttggaagccg

SEQ ID NO: 623768 - DNA, 1432 bp, Homo sapiens
cttgggggttagagcgtcctcctccctcttctctcttctggtggtctcacagagagcccctccagggggtcctcggggggagcacacacgtgggtttcgtcatatgaagcgccccttgtgtgagtattattttatgatgcgcgctcttttcctccttctcataggaatgaacccgcccgggggcggtctccctacgagagcggagacacgcccctctttttggggagagggggggaacatctgttccttacgtcactcccgtgatgctgtggggatgatggctgcgcgcaaggctgtcgcaccccataacccccggggggtttgtgtttggaaaaacccacacagacgccgtgttggcccgcgtggggagggaaaccacagagtgggccaaaacaccaccgtggtaataagggccccccccaatatggcgcctcgtaaaggggcgttttctccttcccgcgcgccagacgccctgcttcccgcccccccccgggggtggggtgaattcctcgcgccacaaagagagtggggcccaccaccgggtggagcacatatctcgcgcaagggaaagaaagtgggggccccccccataggactactcttggggtggggttccccccgggtggggaaagtgtctccaagagaggtgggccccccctgggtggaaaaacaaagaagggatggcgtttctccgtcggtggagcccccgggggcacatgggaccgaaagagtgggctatctttggtggagaggatataaccccagaggtgggcacccccgggggggggcccccccccccgggagacctcttgagataggagaacacacacacatggggagggagaaaagacagagagagagaggagaatcactttgagagagaaccccccggggaaaaaaaatatggagaataaaagggggcggaagcaccccctctccaggaggtcccacagaggatattcgcgccctcatctaagagatgtccgagggagccccccccacgaggactggccacctgtgagactatccacgaatttagatttttgttttaaaccacagcaaaaaatgttttttaaaatttaataaaattcccacatatatttatataaatggttggccaccacacacacttattgagattaattcccttgttcgtggtatacctttataggtaatatttctcacccacatttgttgaaagaaacacacctttaaaccacacgttaaatggtatgtgctgcggaggttttttttttttccctttgttttaaaaatggttggtttaaagagcttgtaccacaatggggaacccccttgtgaggcacatgctcagtaatcacatctgtggaggaccacagagggccttttaactggaaccaagttcatggttgtgaagttttttttttttttttaaataaaattccaaatgtta

SEQ ID NO: 623769 - DNA, 377 bp, Homo sapiens
atcagctcgtccagatgcagcatattaaatcatttgaacaaaaaaaaaatgactctgattaaactagatacagcctgcaggacaccttggcaactagataaactctaaatttcactgtcatcccaccccacgttattccaccccacttcttccttcaccaacatgcaagttctttccttccctgccagccagatagatagacagatgggaaaggcaggcgcggccttcgttgtcagtagttctttgatgtgaaaggggcagcacagtcatttaaccttgatccaacctctttgcatctaacaaagttaacccgctaaaagaagtaaaataagaaggcaatgcttgtggaatgtacagtgcatatgggctgcaccctg

SEQ ID NO: 623770 - DNA, 101 bp, Homo sapiens
tgtcatagtaggcaatgtacttgagcttttactccaggaaatgctatacagattaaactttcaatcgcattagcagttaatgctgacgcgcagaattgctc

SEQ ID NO: 623771 - DNA, 150 bp, Homo sapiens
ctgatgttatgacctgttacgacggcgtggcttcagtgtgctccagctgagttctaccgagctgacttacggtcgactactaccctagagctactacttggttacccctgacacttacttgctggataatgccatatggccaagaggtaa

SEQ ID NO: 623772 - DNA, 237 bp, Homo sapiens
  misc_feature (32)..(32): n is a, c, g, or t
  misc_feature (67)..(67): n is a, c, g, or t
gccccggggggcctgggggttaagtttaaccnaaacctaccctcccccaggtgggtgtgggcctttnaatatacccccccccccccagtgggggagtttgacccgggagggctcccgagtttctgccttcagctcccaaagtgggtggtgggcccccttcacgtgggcccccctttcccatgctggatgggcagaagccattgcttattggagacaaattaaaaccaaaacccccta

SEQ ID NO: 623773 - DNA, 265 bp, Homo sapiens
  misc_feature (169)..(169): n is a, c, g, or t
  misc_feature (176)..(176): n is a, c, g, or t
  misc_feature (231)..(231): n is a, c, g, or t
actctgtctcccagtggcgcaatctcagttcactgcaacctccgcctctcaggttcaagcgactctcctatctcagcctcccaagcagctaggaccacagtcacccgtcaccacacccggctaattttctgcatcttcagtagagacagggagacagggtttcaccatnttggccnggagaatcttctcatgttactccttcagctgtcttccggccgggattttctatcnctgctacactcctcaccctcatgctactcgtgcc

SEQ ID NO: 623774 - DNA, 344 bp, Homo sapiens
ttcacattacattataacaaacttgaatagagattagttcgtacttaagtcgaactcctacaacagactttatacagccgtgacatattgcatttctcgatcctcttactccttctcctactctctatctttgatctacttcgctttctcttaccgaggtggagtgttctagagtctgaactcgcaagttcctcttccgtgcctgcgtgtgtcttatgcttcttatgctatctgatgtttcttgtgttttttcttttccttctttttcttcttcttcttgctgtcctgactttctgctgagctggcactgctactgtggcttcgggtctggcttccagaaggac

SEQ ID NO: 623775 - DNA, 889 bp, Homo sapiens
caagagtgagactccgtccccgtcccaaaataaaaaaaaaaaaagaatttactctccataacggtctatgttatcaccaacatttttaaaaactgtgatttaaattcccatttcaagagttacattaacccgattacttccaaatgggtgctaagcaaaaacccccaatggttttattggacccatgggactggcacctcatggttgaatggtggaatatttatttccatggtccctctataactgggttattactggtcctccctctagctggtattggtatttcagatatgtgatatctggttttcatactctggcctttccatcatgaatgcttaagttatgaacagagattcccttggtagagctcataggcagtacagagcaggtaagtctggcctcagaagggcctggtaatctgggggtagtttttaaatagtggcatagggtatagggtatagtggtacatttggtattggcacatagttggtggccccgaaggggtattttaccaagcctttatttcttccaggtatttcacagctccggagcacaagattctcgttctttcaaattacacaggtaattccgcttaacttaacaacattaaatctggggcttggaattcccaagtgcatgggactgatggatcgtaggggagtaaaaggctgtccaaccatccttagtttggggaaagtggctcctactgcttgtttcataagcgtaacagtacaacgggttgccattgggggtattctaccatgtccagcatgactggtcccaaatgcttgatctggtcaattactagaatgtaataagtcccaatctatgtaaatactctctctcaaacggcctttaaaacaagtgtacatcatctgcatggtattgg

SEQ ID NO: 623776 - DNA, 437 bp, Homo sapiens
atgactttgaattctgtcctttgcccacaagccatttccttgagacaaggaaactccacgtctccaaacactaaaacatcaaaactatgtcaaatctcttatgtgaccaccgtgcaataaactcacacatcaattacaagaggaacatctaaaactctccaaatacacgggagttagaacacatgcctctgaatgaccactgagtgaacgaataaatcaggacgggaattcacaaattccttgaaacaaatgaaaatagaaacacaacctaccaaaacctatgggcacagcacaaagaagtgttaaatggcaaatttatagcaatcaacgcctacatgaagacactcgaaatatttcaaataaacaccctgatgatccacaaagatacaaatctaccaaaagacgaaaaaaccaaatccaaaattagtaaaaaaaaa

SEQ ID NO: 623777 - DNA, 245 bp, Homo sapiens
tttaaatttttgccccccctaaaaaaaaacccgggggggaccccccggttgggggttacccccctttcccctagggggccaaaaaaaggtttgggccccccctgggaaaaggtgggtttttttcccggccttaaaaaaccccccccaaaacctgggttggggaaacccccctttttttttaattaacccccccggggggaaaggggtttttgttttaaaaaaaagggaaaatttttttaatggga

SEQ ID NO: 623778 - DNA, 861 bp, Homo sapiens
  misc_feature (39)..(39): n is a, c, g, or t
  misc_feature (121)..(121): n is a, c, g, or t
  misc_feature (247)..(247): n is a, c, g, or t
  misc_feature (253)..(253): n is a, c, g, or t
  misc_feature (288)..(288): n is a, c, g, or t
  misc_feature (321)..(321): n is a, c, g, or t
  misc_feature (325)..(325): n is a, c, g, or t
gctctataaatgcataccctttatagagtttgcttcatncgaaaattgagggcagagcaatcaggctggagttgcaaggacccaggggatcacctaatgccagaagccagccatccaaaanctctgtttgtcaaacgtgcctgtctgaggataccactgaagagacattaaaggagtcatttgacggctccgttcgggcaaggatagttactgaccgggacaactgggtcctccaaagggtttggtnttgtanacttcaacagtgaggaggatgccaaagctgccaangaggccatggaagacggtgaaattgatggcaantaangttaccttggactgggccaaacctaagggtgaaggtggcttcgggggatcgtggtggacggcagcaggcggctttggaggacgaggatggtggtagaggaggccgaggaggatcaggtggcagaggccggaggaggctctggagggcgaggcaggcttccgaggaggcagaggaaggaggaccgtgcaccacaagaccacaaggcacaagaagacgacactagaatagcttctgtccctctgctttcccattttccactttgcaccgaacgcgactctggcagtttacctgttacctgatcacatgacagagccttctgaggacattccatgacagtatacagtcctgtggtctccttggaaaatcagtctagtcaacatatcaaggggcaaataccgatgttgcgttctgactgcgaatattcattataccaccttataaccagcagtcgagtgatacgagcctaacccttactctgtcaccatcccgacatcactatacggcccctccccaatgctcacaaaaccattactaac

SEQ ID NO: 623779 - DNA, 1473 bp, Homo sapiens
  misc_feature (622)..(623): n is a, c, g, or t
  misc_feature (632)..(633): n is a, c, g, or t
  misc_feature (636)..(636): n is a, c, g, or t
  misc_feature (644)..(644): n is a, c, g, or t
  misc_feature (648)..(650): n is a, c, g, or t
  misc_feature (733)..(733): n is a, c, g, or t
  misc_feature (859)..(859): n is a, c, g, or t
  misc_feature (865)..(865): n is a, c, g, or t
  misc_feature (900)..(900): n is a, c, g, or t
  misc_feature (933)..(933): n is a, c, g, or t
  misc_feature (937)..(937): n is a, c, g, or t
aggacgttcggagatgtggatttggaatgtggtgtatacctgtggagggcgtcggatgtcagtgttttgaaagtctatggctaggaaattaggcttgagtaaatcatatggagaagagggtaagaaggagcgagatgctgggaacacttatggcgtgttatatctcacactgttgactgtgtgattgcaggatgtattgaaatatagatgtatgatctatgctgctggagaatcagattattccgactgcgtatgggcaggcgtaatggggattgcttatattgacttttatagcactagtaccgacttgattgcacaagtaataacctttgagtaataagcagggtcaagcagagatcgatggggtgaatctttgttccctggctctatactggacgagcacgtgtcaatatatgcatagactataggaggtggaaaagaatagcacttggagtggtgaatcaaaaactctgggtgtgtgggagcaacctctcctacagtgcaaccagaagaaactcttcaggaagtatttgagaaagcaacttttatcacagtaccccagaaccaaaatggcaaatctaaagggtatgcatttatagaagttgcttcattcgaagacgcnnaagaagctnnaanttcctgtncctnnnagggaaattgagggcagagcaatcaggctggagttgcaaggacccaggggatcacctaatgccagaagccagccatccaaaanctctgtttgtcaaacgtgcctgtctgaggataccactgaagagacattaaaggagtcatttgacggctccgttcgggcaaggatagttactgaccgggacaactgggtcctccaaagggtttggtnttgtanacttcaacagtgaggaggatgccaaagctgccaangaggccatggaagacggtgaaattgatggcaantaangttaccttggactgggccaaacctaagggtgaaggtggcttcgggggatcgtggtggacggcagcaggcggctttggaggacgaggatggtggtagaggaggccgaggaggatcaggtggcagaggccggaggaggctctggagggcgaggcaggcttccgaggaggcagaggaaggaggaccgtgcaccacaagaccacaaggcacaagaagacgacactagaatagcttctgtccctctgctttcccattttccactttgcaccgaacgcgactctggcagtttacctgttacctgatcacatgacagagccttctgaggacattccatgacagtatacagtcctgtggtctccttggaaaatcagtctagtcaacatatcaaggggcaaataccgatgttgcgttctgactgcgaatattcattataccaccttataaccagcagtcgagtgatacgagcctaacccttactctgtcaccatcccgacatcactatacggcccctccccaatgctcacaaaaccattactaac

SEQ ID NO: 623780 - DNA, 877 bp, Homo sapiens
  misc_feature (137)..(137): n is a, c, g, or t
  misc_feature (263)..(263): n is a, c, g, or t
  misc_feature (269)..(269): n is a, c, g, or t
  misc_feature (304)..(304): n is a, c, g, or t
  misc_feature (337)..(337): n is a, c, g, or t
  misc_feature (341)..(341): n is a, c, g, or t
acattagagcttggatagcaagtagcatcattccatagagtcttgaatgagcatgggcaaattgagggcagagcaatcaggctggagttgcaaggacccaggggatcacctaatgccagaagccagccatccaaaanctctgtttgtcaaacgtgcctgtctgaggataccactgaagagacattaaaggagtcatttgacggctccgttcgggcaaggatagttactgaccgggacaactgggtcctccaaagggtttggtnttgtanacttcaacagtgaggaggatgccaaagctgccaangaggccatggaagacggtgaaattgatggcaantaangttaccttggactgggccaaacctaagggtgaaggtggcttcgggggatcgtggtggacggcagcaggcggctttggaggacgaggatggtggtagaggaggccgaggaggatcaggtggcagaggccggaggaggctctggagggcgaggcaggcttccgaggaggcagaggaaggaggaccgtgcaccacaagaccacaaggcacaagaagacgacactagaatagcttctgtccctctgctttcccattttccactttgcaccgaacgcgactctggcagtttacctgttacctgatcacatgacagagccttctgaggacattccatgacagtatacagtcctgtggtctccttggaaaatcagtctagtcaacatatcaaggggcaaataccgatgttgcgttctgactgcgaatattcattataccaccttataaccagcagtcgagtgatacgagcctaacccttactctgtcaccatcccgacatcactatacggcccctccccaatgctcacaaaaccattactaac

SEQ ID NO: 623781 - DNA, 861 bp, Homo sapiens
  misc_feature (4)..(4): n is a, c, g, or t
  misc_feature (77)..(77): n is a, c, g, or t
  misc_feature (96)..(97): n is a, c, g, or t
  misc_feature (177)..(177): n is a, c, g, or t
  misc_feature (183)..(183): n is a, c, g, or t
  misc_feature (195)..(195): n is a, c, g, or t
  misc_feature (264)..(264): n is a, c, g, or t
  misc_feature (266)..(266): n is a, c, g, or t
  misc_feature (289)..(289): n is a, c, g, or t
  misc_feature (306)..(306): n is a, c, g, or t
  misc_feature (333)..(333): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (372)..(373): n is a, c, g, or t
  misc_feature (376)..(376): n is a, c, g, or t
  misc_feature (382)..(382): n is a, c, g, or t
  misc_feature (386)..(387): n is a, c, g, or t
  misc_feature (390)..(390): n is a, c, g, or t
  misc_feature (425)..(425): n is a, c, g, or t
  misc_feature (436)..(436): n is a, c, g, or t
  misc_feature (456)..(456): n is a, c, g, or t
  misc_feature (491)..(491): n is a, c, g, or t
  misc_feature (512)..(512): n is a, c, g, or t
  misc_feature (515)..(515): n is a, c, g, or t
  misc_feature (534)..(535): n is a, c, g, or t
  misc_feature (537)..(537): n is a, c, g, or t
  misc_feature (568)..(569): n is a, c, g, or t
  misc_feature (588)..(588): n is a, c, g, or t
  misc_feature (595)..(595): n is a, c, g, or t
  misc_feature (605)..(605): n is a, c, g, or t
  misc_feature (697)..(697): n is a, c, g, or t
  misc_feature (735)..(735): n is a, c, g, or t
  misc_feature (766)..(766): n is a, c, g, or t
  misc_feature (825)..(825): n is a, c, g, or t
aggnaaacgacagacagcccatattcttgttaaacagaaaaaaaaaaaagaatacaaacatcacagtgatgaatttncacaaagctaacagatttnnactacagagcaatggaatatttataagcaagaagtcatggttttaatgaccaaattgcatctaactgggttttctaagcncaaaancatttaaaatcncagacttaaaatttaaatctagacatgacaattgtaagcataccactcagtcatttaaaactattcagngngtgctactcttcctgcataaatntttttttcctaacattnttttttctcccaagatttagaatgtcncatctcangtnccnactagtaatcccccccggggttaanngcncacccnaggnngtnttctttttataatatgttcttaaaagaggaaaganaaattaaatgngaacattttgtacaatagtngctgaagaacagtaaaaccaattccgaaatatccngggtactatacagaaaggcanggntcatgggaccaagtattcnncnctacagcatttgaatatcagtctttaaaggnngggaatattacctcctgtnccccgcnctgtgtctcnctacctggctagcgcatgcccagggtctgtctgcttttcagttggtaatttttctcaatatctgacagggcttgagcccgcagctgggcagngtgaagccttttcttcaggtccttgcacttggacttanatgtgagctgactctcagaattctcactccncatgatgttctctttactttccccactgaaatgaactttcttcttaattactggattanttgccagaaaaaggaacttccgttcctttagcaagc

SEQ ID NO: 623782 - DNA, 132 bp, Homo sapiens
ccccagtgctgtgtataggggtccagccagctcagcagctgcaatggaaccttactcagattacccagcagattgctgggatgaacttctattgagcccatggcatgatgaactatggacagtcaatgagtg

SEQ ID NO: 623783 - DNA, 100 bp, Homo sapiens
atagtacgtcggtagccacgcattataaccaaagccataaaaataaaaaataataacaaaccctgagatacacggtaagatatgtggacatgggcgtaga

SEQ ID NO: 623784 - DNA, 296 bp, Homo sapiens
gtcgacctctgcactgaaacccatctgctctgtatttgcatgatgcaatcagctgctcatggcatctggcagtctatagggaagagggtttctcatataccttcagtcctacagagatagtctccccatcagatatgaaagtccatcttctctccgttacaatccattatactttccagcagattatgtttggtccttccattaactttcccaaaggactactctagcaaattttttcttgattatttacaaattttcacagtttccttggacttcaacacaccactttcgtcgac

SEQ ID NO: 623785 - DNA, 337 bp, Homo sapiens
atttttttttccaaaaaaaaaaaaagggggagcccggggaaaaaaaaaacccttttttttttaaaaaaaaaaaaagggcccaaaaaaagcccaaaaaaaacccccccaggggaattaaaaccccccccccctcgcaaaagggggggcccccaaaaaaaaaaaaaggggccccaaaaattaaaagaaaggggttccccgggtggggggggtgggggggggcccccccacaaaaaaaagacccccccccaaaaaaaaaaagcggggagacacacaaggggggggggggggggaaaaaaaaaaaaaaaaaaaacccccccaaaaaagggggcccccccca

SEQ ID NO: 623786 - DNA, 495 bp, Homo sapiens
gtcacacgcacatcccaaagccctcgctctccagattccagtcagagttctatggcccaggaggaagaggaggaagagcaaggaagaactaggaaacggaaacagagtggtcagtgcccagcccggcctgggaagcaacgcatgaaggagaaggagcaggagaacgagcggaaagtggcacagctagctgaagagaacgagcggctcaagcaggaaatcgagcgcctgaccagggaggtggagaccacacggcgggctctgatcgaccgcatggtcagcctgcaccaagcatgaacagtgggcatcacctcctgtctgtctctccggaagtgtacccagcaccatcgcgccagcgccaagcatgtgaccctgcactgcactgcacatgctgaggaggggactgagggtagaccaggagagggctcggcttgcacatagacggtacattgtttattactgtccatgtccagtaaagtgactttgtgtcaacagcca

SEQ ID NO: 623787 - DNA, 155 bp, Homo sapiens
ggtacccattaatcctcccctcaatctcccgactaccattccaggcctctggtaaccatctttctactctctgtagaaagatgagtagatgtagaagatgagttcaactgttttgatttttagatcccacaaataaacgagaatatgtgaaaaaa

SEQ ID NO: 623788 - DNA, 347 bp, Homo sapiens
ccgcagtagctctggttttgaaactatagagcatgcagatactctggtatcaatgttccctatggtttgatatttgtctgggaaatcttaggatgaatcttgtctggtatacttattacagctatgtgttcagctaggtgcatttcgttacagttatgtagacccgccttattcttgtcatttacacagtcactcggcagctcaacgatggttcatccatactggtctggctctgtgtcgtgttaattctccccaatttttgttgctcctctaacaatctttcatataatcattctgtatctgaacacgttggtacggagaacaccagcatcagagttattctacct

SEQ ID NO: 623789 - DNA, 656 bp, Homo sapiens
  misc_feature (400)..(400): n is a, c, g, or t
gtgagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgagtgcggtggctcatgcctgtaatcccagcactttgggaggctgaggcggacagatcatgaggtcaggagatcgagaccatcctggttaacatggtgaaaccccatctctactaaaaatataaaaaattagccaggcatggtggtgggcgcctgtagtcccagctactcggtaggctgaggtaggagaatggcatgaacccggtaggtagagcttgcagtgagctgagatagcaccactgcactccagcctgngtgacagagcgaaactccgtctcaggctgaggcagcagaatcactagaagctgctaggcagaggttgcagtgagctgagattgtgccagtgccctactgggtaacatgagtgaaactctgtctcaacggccatatagaccaaggattctctccattcaccaagctaattaagacaattcgtggtccataatctaacgtaagggtcttcacatcgctctcgatgcattcggtcagtacccactcttttccggctgct

SEQ ID NO: 623790 - DNA, 433 bp, Homo sapiens
gtataacggtggaaggggagtgagcacacactcgtgcgaggtgtcttgagataatcataccgctgagggtgatagagggaatcagcacacactcgggaagctgtcttaaagctcaggaagttatcagttatcgaatgttgttgagttgaacgaggtggctggtggcccatccatgtccccccaaacgtctcagctgtgacgtagggccagtatggcaatcctgaagaatgacgatgctccgtctgccggcattctgacccagttgcaaagagcctttcttgcagaaggggggatgatgcgatcgtggtagtcctctgctcgccgccgaaattcttgcgcacgttgaaccatttgctgtatgctggcggccttcctctttccattgctcttgtcatgatggtggattttcgttgtcagcttcctcttacgggtt

SEQ ID NO: 623791 - DNA, 440 bp, Homo sapiens
ccaacccaaaaaaaaaaaagatttttgaagggtttttataggagatggatttttatcatagtaaatggtccccattttaaataattccttttccaagtcaggtaaaataaaatcgattccccgattccataccttaggagtgcaaagacagggtcatacccatggcttatacccctcctttaaaaattttataggataaaggatttatgggaaggggtttgagattaattatttttgggaaagggccaaatgtgtcaaatgccctagttaatcatgtaatttaattctgggattgggagggggtagccatcaattttgaatttataattttgcttttttaaaaaaaatggagtcttgtagtatgaaataattaaaaattgttaaagggatattttgggtgtattataataaaatgccaacatggctgttttttggtttta

SEQ ID NO: 623792 - DNA, 272 bp, Homo sapiens
tgtaaatttaactgttagtccaaagaggaacagctctttggcccctaggaaaaacccttgtagagagagtaaaaaatctaccccccatagtaggcctaaaagcagcccccaattaagaaagggttcaagctcaaccccccctccctaaaaaatcccaaacatataattgaactcctcccccccaattgggccaatctatccccctatagaagaactaatgttagtataagtaacatgaaaccattttcctccgcataagcctgggtcagata

SEQ ID NO: 623793 - DNA, 129 bp, Homo sapiens
cctagaggctgttgagttatgtaactaatgtatgcaactattaattttgtttaacactatctgccagagcgtaaactttattccctataacttaaaatgtgtatatatatataactcgtttatgctagt

SEQ ID NO: 623794 - DNA, 299 bp, Homo sapiens
  misc_feature (35)..(35): n is a, c, g, or t
  misc_feature (45)..(45): n is a, c, g, or t
  misc_feature (65)..(65): n is a, c, g, or t
  misc_feature (68)..(68): n is a, c, g, or t
  misc_feature (100)..(100): n is a, c, g, or t
  misc_feature (135)..(135): n is a, c, g, or t
gatacctatatatctttcgttactacgccagcagncgcccggatngtctccccccagtcctcggngtnatcccgctgaccaccggcttgatcgcctccancgacaggccgcgggcccgggcggcgcggatcaggncgcaggcgcagaaggtcttgcccacatcggtgtgggcgccggcgacgaacagggcgcgcatcagcaaggctccataagcggtctgaccgcctcggccaggcggtccacatcggcctccgaatggccggcggtgaaggcgatccgcaggcgcgccgtgccggcgg

SEQ ID NO: 623795 - DNA, 110 bp, Homo sapiens
tgagtttagctttattggggagggggtgatctataacactctttacgccggcttctattgacttgggttaattttctaaagccaaagaatcagcttttggcacgcaaaaa

SEQ ID NO: 623796 - DNA, 174 bp, Homo sapiens
aagtatattacagatagttcaacaatgtgatatacaagcgaagcatctgagtctatatcagcatcagatgctcaaatcaccagtgagaacatacctgtatattagagaccacgctgtaaatatcgaggctgattcactaatgagtcctgtatattctgcctgcataaaaactgg

SEQ ID NO: 623797 - DNA, 325 bp, Homo sapiens
cgcagatctacaccaaagagtgcctgtagagggctctagctatgagcacgttaaaggcaagatcgacaccatgaagaaattttatcgaagcattcggggggaggatcacccggcttcttaaccagcttacccttcctgtgtgaagaacccctgggactgtgaagccgcgtgaggctgggactgcgagtgctgacgccacctttctgctgaggtgggacatggccctggacccccttagaccctctgtgctcaatggttggcctcatgggacccaagggcttgaggagaagccgagctgtgccccagatgtttccgcttgtctggc

SEQ ID NO: 623798 - DNA, 756 bp, Homo sapiens
aggtctacaagacgctacttcccctatcatagaagagcttatcactcgtttacatgatcacgccctcgataatcatgcctcttatctgcttcctagtcctgtatgccctttaccttaacaacgtcagatatagaaacttaactaaatacagtatacaattgtcagcacgcgtcaggaaaagtagaaaccgatctgaactagtcctgccccgtccatcagtcctagtcgctcatcgctcctcccatcccatacgtcatcctttactataacagaatcgaggtcaacgtagtcccttctcgcttatcgattcagatagtcaattcgggccatccagatggtatatgacacgctatgaggtagcaccgatctacggcggtactataattctttctaaactcctaacatatcttcccccgttatgcctagataccaggcgagctggcgactccttgacgttgacaatcgagtagatactcgccgatggataagtcgccccattcgtgataataatggacatcacaagacgtcttgcaacgcatgagctgtcgccgacattgaggctttaaaagtcatgatgctattcccggacgtctaaaccaaagcatttcaccgttacacgaccgggggtatactacggtcaatgctctgaaaatctgtggagcaaaacacagtttcatgccatcgtctagaattattcccctaaaatctttgaaatagggccgtattacctataagacccctgtaaccctttagagc

SEQ ID NO: 623799 - DNA, 1323 bp, Homo sapiens
gctgttgtgtgtggtttgttgtctactcttttgtgctgtcgttcgcgcagtagtttgtatgatgcccttgtttgttgtatgtggtgggtggactgcgtggtgtgttgtcgtcgtctctttcttttctctatgtggctagggtggtgggggatctccgttctttctgtcgggtgggtcgtcgcgccgactccactcctcgttgcgatttgttgtgttcttttcccggtcttgtctcttttttctcctgcgtggtagcgcggttggtttgatctctcgtcggtggggtgatgtgtttttgttgggtctcgtctctttatgtatttagataatggagtgaggggaggcggggtcgcagcgctctgtcttccttgtttttctcctctgagtgggggagggtgttgtgtgcgttggttctgcttttctgttggttggctaccccgctcgtctctctccacgcgctgcgtgttggtgggttttggttcatcctcgttggcgtctccggcttcccattggagagagagtgtcgcgcgtgtcgttcgctcgcgcgtcggggatgggttgtgtgtgcgtgctccgcgctctctcctcgcctcgcgccgccgtgggcggggcgccgcactctctctctctctctccgcgcgctctctctctctccgcacgctgccctctctctgctgtgtgtgtgtgtgtaggcggcgctcggtcttatagcgcgcccccgcgcgcgagagagataaggcgcgcgccgcgccgccgcgctctctctttctccttctctctctctctctctctctctctcctctctgtgcgcgcgcgcgctcggtcacatagacagacactgcactctctctctcgattctctttgttgttgcgcgcgcgcgcgagggcgcgactcactctctctctctctcgtgtcgtgcgcgcacgagagcgccgcgcgcgcgcacatattctctcctctcttctctccgcgctctcttctctttgttgctagagagacatgtatatttttttgtttctctctctctctctgtgtgtgtgtggcacgccggcgtactgctgtgagagagagagaggcgcgccgccgcccccctctcttgtttctgtgtgtgtcgcccccgctctcgtgtgtgtgtgtgcctgcggtcgtgtcggagagagagagcgcgttcttctcttttgtgtgtggggagaggagagagagagagccccctctctccccccgccgcgcgccgccgcgcgcgcggcgggggggggccaccctctctctctctctctctttttgtttttttgacaagaagtagggccccccccacgcaaata

SEQ ID NO: 623800 - DNA, 121 bp, Homo sapiens
ccctattactattttccagcttttttctcaagaattaaaaaaaaacaaaaaacatagaacataacaggtttgcaattaaattttgtaggtacttttggttttcagggcagggcgctgacta

SEQ ID NO: 623801 - DNA, 663 bp, Homo sapiens
  misc_feature (663)..(663): n is a, c, g, or t
ggttctatcatttttaaccggctattctgaatgtttttgatagccggaatttatttttgagtagggtgaaaggacccagatacttgagtgattaaaggactggtagtgttctgcttatatgccggagttacatgattttaaaagtcataatatgggaagaaggggtatcatctgagtactcctattaacctaaaaaggatttctaacataacaaaatgagcagggggtttgctacacttaggcaagaatttattttcccatttaaatttggaaaatacacttttctttgcttctacccttgcagttcccttagatcccctaatttccaagtgatctggactaaaattaatattacacttactaagaaactatttttggtaaatatactgggcaaagtttgctccaaatgaaaagtcaattacaaactatgtatagtaccccaagaaaagggcaaaatgagtcacaaagactgtaagtaccacttctgggcgctccaaagaaaaaacctggacacacttgcagggaaccaggtggtggaaaatatgagctataaacagatattatttttagttttgacagctctcgggtggaacacttttttaatgcccgtaaaaattattaggtttaccctttgggcccccccttagtgcgggcggggttccn

SEQ ID NO: 623802 - DNA, 184 bp, Homo sapiens
tgagctgctaccccttctgctcatcaactagcgcacagcacacacataaagacacagcacacacagtcacacacagcacacacacgcgaacacagacacacacacacacagcacacacacaagcacacagacacacaaacgcacagcacacgcacacacatgcatccccgcagctacacacaca

SEQ ID NO: 623803 - DNA, 101 bp, Homo sapiens
acagcaagaaaacaaaagcacactgagagtcatgctgaatgttcttggacagaaaggataaggttttcctagtatgttttataacaactcttttttttaac

SEQ ID NO: 623804 - DNA, 123 bp, Homo sapiens
agcataaatatataatgcggcctataagagttaccgtagccgccttgaatcaaattttcggccatatgggatagtgtcgtccatcaagagaaatttgctcaaaatattcgagagggggcggtg

SEQ ID NO: 623805 - DNA, 322 bp, Homo sapiens
  misc_feature (296)..(297): n is a, c, g, or t
ataaggcaatctcggtagttttcagtaagacaggtttccgcaatattggccaggcaggtctcaaactcccgaccccaagcgatccgcccgcctcggcctcccaaatcgccgggactgcaggcgtgagtcgccacacccggcctggatctgacttttgccttagatggtttgacactgatcttgttcctgctcccagggtgggcagacaacccccactgagcccagcttcattctcctgcttcctccccacagcaggaggctcagagaggtgggatgactttccccaggtcacacanngcacagggttttggcccttatcgag

SEQ ID NO: 623806 - DNA, 502 bp, Homo sapiens
tcaacatcagcatcttttttttttctggaggcaggctctcactatgtaccgtaggctggtctcaaacccctaggctcaagcaatcctcccccttcagcctcccaaatttctgggattacgggtgtgagccactgcaccgggccagggatgtaattgggaagtgaaaaagtatataggtggttgttattcctgagagtagaatataatgatagctatgtttatggagtgtggtaatgtcctaggctctggttatatactgaaaaagaaagaaaaagtcctatcttcagggagcgtacatttaaataggaaattcagaagtagataaattagtaataaattggtggctagtggtaagttctatgaagaaaactaaagtagtaggaggagaatagaggtgggtagatactgaggatggtaggatgatcagtgaagacctcactgagaagaaattatttgaacaaggacttgaaacaaattagacagcaatggatgagtggaaccg

SEQ ID NO: 623807 - DNA, 167 bp, Homo sapiens
ttatcggactaccccgatgcactacaccacatgaaacatccgtatcatcatgtaggctcattcatttcatctagacaggcaggaatattaataattttcactagatttgatgaagccattcgcgtatcggaagcgaaaaagtccgtaagtagtaggaacgaacccgt

SEQ ID NO: 623808 - DNA, 243 bp, Homo sapiens
atgttaaggatacctgtaagacaggccttagtaggctttctaagtctcctaaaggatgtgttcgaacaactgccacagcagcaagcaacttgcattcgagtattcgttgatggtcagtctctcatggctggaacgggcacgaccgttctccaagcttgtgagacggattggcatgcagatccctcgattctgttatcatgaaggatgtctagtagctggaactgcaggacgttccttaatgaa

SEQ ID NO: 623809 - DNA, 716 bp, Homo sapiens
tggccgggctcgatgccgcatacctgatttaaccgagatctgctttaccaaagctagcatggcaaacaagatggagcgattgctaacgcccaggacgacccatttgatcgtgaatcattaatatcaaatccatgcccatgaacgaaccacagaccacttgctatgattccaatacactctatcactgacgaggtattcacgattagtccagtgcagcagacggacgcgtagctcagagatgacgaggtaccaggcattacgaggctaccagctacaacaaccttacaccggttaccttaaacacactggcagcgaggatatggagctacgcataccccaatacacgagcatggccaaacgtattatcgattatgtggcatatactagagtatcacgagctatcaggcgacgcttgtccccctatgaggtctgacactagacctacaacgcgccacgattagccttccatcattgtaaccgcaccactcaccaactctcccaatcttctccccatacgattcacactataccctcttcacccttccctgtacactagcttcacctttgcccccctaggcacccttctcaccctgcccaagcccacctccactccctctctaagactcacacgcattctccccgatcaactttccatctctcatcccatcccacattccctctccccctatcctttctgccacaccaccaccccctcc

SEQ ID NO: 623810 - DNA, 1095 bp, Homo sapiens
tgaagcaggcgctcttggcatcggacgcgggccgctgcaatccgtggaaggaacagcgaccggcgatgtccacacaatcgatggcctgaggtctacttaacagtgagaggcattcagtgctgacgtggatcgaccaaactcgattcagacacagattatttgacgactgaactcggaccccttcgtaggtgtcgtgaatggcagcagagaacaatgaaaaaagaagccggcgggggcggcgtagggggccctggggccagaggagctgctaggtcaggctcgctggcccagatacaatctccaacgtcgggcacggcgaaacagcgtgcgcacaggaagtcccagaaaggaccagcgaagaacccgtatgccccccagcggttggcgatgtgttgacgaaggaaagatggagacgtcagcgcgtgcacagtgagcggctttagacgaagatgacacggaactgaacgacgatgatttggacacgacatggaccgtgactcgagacaaccttacaggtgtgaatgggaccaataacttggataggaatgaccagtaagaggtcgagacacctgcgtgaatcgacagcattcgaaagagccacttgaagacacagggtgaacggacggcgaagtttagcagtatgactagactcgatttattgaaccgtacatattgcgaaggtcagtgggtggtactatggaacgaggtcgagggggccgtggatgtggaatgggccgaggagactggatatgatactcgctggaaaaacggtgaagtctgataggcatagtggaagttgaagatctgggcctgaagcacgcaggacaaactgtggaggtaggggatctcacaattggggaaccggtcagagtagaataactgcactgggttcacatcaatggtgatgtggaaacaccgtcgagcggaaccaggctatcccaagtgccgcacctgcaacataggggacgccaccctgaaacggtcccccgagggccccaacaacacagggccacccgcaggccgcaccaacgcacggcgacagcacacacacgccaacaccagaggaaggcaagcaagagccacacacaaagacgc

SEQ ID NO: 623811 - DNA, 965 bp, Homo sapiens
  misc_feature (297)..(297): n is a, c, g, or t
  misc_feature (323)..(323): n is a, c, g, or t
  misc_feature (328)..(328): n is a, c, g, or t
  misc_feature (345)..(345): n is a, c, g, or t
  misc_feature (347)..(347): n is a, c, g, or t
  misc_feature (355)..(355): n is a, c, g, or t
  misc_feature (358)..(358): n is a, c, g, or t
  misc_feature (366)..(366): n is a, c, g, or t
  misc_feature (372)..(372): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (390)..(390): n is a, c, g, or t
  misc_feature (393)..(393): n is a, c, g, or t
  misc_feature (404)..(404): n is a, c, g, or t
  misc_feature (420)..(420): n is a, c, g, or t
  misc_feature (426)..(426): n is a, c, g, or t
  misc_feature (431)..(431): n is a, c, g, or t
  misc_feature (438)..(438): n is a, c, g, or t
  misc_feature (440)..(440): n is a, c, g, or t
  misc_feature (456)..(456): n is a, c, g, or t
  misc_feature (473)..(473): n is a, c, g, or t
  misc_feature (477)..(477): n is a, c, g, or t
  misc_feature (480)..(480): n is a, c, g, or t
  misc_feature (482)..(482): n is a, c, g, or t
  misc_feature (486)..(488): n is a, c, g, or t
  misc_feature (491)..(491): n is a, c, g, or t
  misc_feature (498)..(499): n is a, c, g, or t
  misc_feature (504)..(504): n is a, c, g, or t
  misc_feature (506)..(506): n is a, c, g, or t
  misc_feature (509)..(509): n is a, c, g, or t
  misc_feature (522)..(522): n is a, c, g, or t
  misc_feature (537)..(537): n is a, c, g, or t
  misc_feature (555)..(555): n is a, c, g, or t
  misc_feature (564)..(564): n is a, c, g, or t
  misc_feature (598)..(598): n is a, c, g, or t
  misc_feature (617)..(617): n is a, c, g, or t
  misc_feature (631)..(631): n is a, c, g, or t
  misc_feature (651)..(651): n is a, c, g, or t
  misc_feature (656)..(656): n is a, c, g, or t
  misc_feature (948)..(948): n is a, c, g, or t
agcgggttgactgcggacgccggaagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttnaccacatggcccgtcacgatgatganaaaanaaggcaggaacttgaananaaaatcanaanaaaggaanaggaanaggcnaanactgtntcanctnctgcagctganaaggagccagtcccanttccantccangaaatananattcactccaccacanaattggatgggcatcangaantananaaannncancctccannccctntnaangaaatggcccatngttcacaggaggcanaagctccaagagcagttnctggtgctnctgaagtccctagggaaccaccaattcttcccangattcaggagcagttccanaaaaatcccgacanttacaatggtgctgtccganagaantacacctggtcacagactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggacgccatcctggagggagaagagcccatcgacattgacaanatcaacaaggagcgctc

SEQ ID NO: 623812 - DNA, 1217 bp, Homo sapiens
  misc_feature (291)..(291): n is a, c, g, or t
cgcaagatgagaactgctgaagcgatccactgagcccgacgacgatgcggtaccacagtgccgtactctgcaccgcgacggaagcactcgtcagggcagcaagactagctgtgtctaggtgactcctggcgtgtggtactcctacgtatccctaggaatatgctatccacatagtcatggatagtgggcatgtcaccgtgtaggtccgtacgggggtccatggggccacggcacggtagaggactcgttggtgttaggccgtaggaatgccactgcgcatagtgataccgnacaagagatccacgcgactgattcaaggtgtgaccctggagagcgcgtgtgaaccgtggggccttgagggtaatcttagctttttctagccatcactaggggttccgcaccaaagcgtatcaagtgtgacttcgggaggagattgcccaagtagacgaaccggaacggcatatgagagcgcttgtggtcttcgcgcttgcgggtgctccctatttgtgggctttagaaataacggtgggcataaataggacgctcacccacggttaggggcgacagcatcacaataaacattatttggtaaccctcgtgtagcatgttggttacgtttaacacctttggaatacgggggcagccttcgcatataggcggtcctgcggggaacccctggcattaggtgcgtttggaaggcgggtacgcctaggccagaattcgccggaggatacactcgcgggaggcgactttaggcacgagcgccaaagccggggggaactcgggcatgggaacgccgcggttgatactcggaaatataccaacaagccgtcgttatgcccagtgtgtggtgagacagcggccgtcgcggagaattggcgaattataggtgcccttccgtatagcacgtgcgcgttgccgaccgaaaattagggtgcggatcgttatacactttcaacaatatccgggggatggcatagaacgcgctaccgagtgggagaacccgcgtatgcggcttaaataataacgccgccgaagatcccgacagattagaggccctttgcgcaatcgattatacaacaaacgctataaacataccgggcgaccgccggtgggtgaaccccataacccgggagccgccgattaacaaatcgaacgcacacggggcgttaccacaccttcgtagcccagccgcggcgcatagcgccacttggttg

SEQ ID NO: 623813 - DNA, 342 bp, Homo sapiens
  misc_feature (150)..(150): n is a, c, g, or t
agcccggggggccccccgggggggccccgggttccccgccgccgcccccggtcccgcagtccgaagggcccttgcctgccgacccgttgttgtctttccacctggatttggggccttccatgttgaacgcggtgttgggggtaatgaaangggggggcccgaagggggtttcccccaagcccaacggggaaccccgccccgggaggaagcccccccaggcccgttgccgccccaacggggacctcaagttgaaagaggtcatgggcctttaggttccctcattccccgggcccttcccgcccggccccccatttttgtaaaaataaacggccaaggggtgta

SEQ ID NO: 623814 - DNA, 526 bp, Homo sapiens
  misc_feature (2)..(2): n is a, c, g, or t
  misc_feature (10)..(10): n is a, c, g, or t
  misc_feature (48)..(48): n is a, c, g, or t
  misc_feature (57)..(57): n is a, c, g, or t
  misc_feature (62)..(63): n is a, c, g, or t
  misc_feature (122)..(122): n is a, c, g, or t
  misc_feature (125)..(125): n is a, c, g, or t
  misc_feature (140)..(141): n is a, c, g, or t
  misc_feature (170)..(170): n is a, c, g, or t
  misc_feature (175)..(175): n is a, c, g, or t
  misc_feature (196)..(196): n is a, c, g, or t
  misc_feature (201)..(201): n is a, c, g, or t
  misc_feature (237)..(237): n is a, c, g, or t
  misc_feature (264)..(264): n is a, c, g, or t
  misc_feature (339)..(339): n is a, c, g, or t
  misc_feature (364)..(364): n is a, c, g, or t
  misc_feature (391)..(391): n is a, c, g, or t
  misc_feature (395)..(395): n is a, c, g, or t
  misc_feature (406)..(407): n is a, c, g, or t
  misc_feature (411)..(411): n is a, c, g, or t
  misc_feature (417)..(417): n is a, c, g, or t
  misc_feature (424)..(424): n is a, c, g, or t
  misc_feature (430)..(430): n is a, c, g, or t
  misc_feature (446)..(446): n is a, c, g, or t
  misc_feature (454)..(454): n is a, c, g, or t
  misc_feature (456)..(457): n is a, c, g, or t
  misc_feature (467)..(467): n is a, c, g, or t
  misc_feature (482)..(482): n is a, c, g, or t
  misc_feature (486)..(486): n is a, c, g, or t
  misc_feature (496)..(496): n is a, c, g, or t
  misc_feature (519)..(519): n is a, c, g, or t
  misc_feature (525)..(525): n is a, c, g, or t
tntcgagatntggtgggtgcccatgaagtttccttatttcccttttcnacatggaanacttnntgaaggcagggattgtatcttcctgacctttgtatctcccatgatgtatgtcacacacnaantgaggaaggcttcannggaaaggaaccagtttgactgcagctacnacccnagaagagatggaaagactgtnatcanccgagtagctacactgggaaggtgattaaagagctntcattttaaaaggctcgaggtccaganggtttcatgggtgtcctctgtctgacctttaatgaacaggtggctccagtgtatttaaactattccggaccatanagaagacggaaatttctataactcntatcatgaatccaacacaagcttaatngcanaagatgacatnnaganattatngacgatnctcctnaatgaacatagacacnaatactancnnactgcatgtntcagtgtgtgaatanaacnattaagactnattctaggactataagggtaganatctcna

SEQ ID NO: 623815 - DNA, 102 bp, Homo sapiens
  misc_feature (24)..(24): n is a, c, g, or t
cctgagatctgcagtgaagtggancaatgatgaaactagccaaatctgagcatcagaagtctccagtctacctgatgcatgatctctacagttctgagaagc

SEQ ID NO: 623816 - DNA, 507 bp, Homo sapiens
gccccactggctgctctgaaaagccatctttgcattgttcctcatccgcctccttgctcgcctgcagccggcctccgccgcgcgcctcctccgccggccgggaactccgggcagctttatcggccagagtccctgaaactctcggctttctttttaatcccctgcatcgggatcaccgggcgtgccccaaccaatgtcagacgcagccgtagacaccaagctccgaaatcaccaaccaaaggacttaaaggagaagaaggaagtggtggaagaggcagaaatatggaagagatgcccctgttaacgggaatgctaatgaggaaaatgtgggagcaggaggttgacaatgacggtagaccgaagaagaggaacgaacggttggggaggacgacggaggaggaccgaagaacggtgatggtgaggaagaggattggcgattgacgactgaggaacgctgagtcagctacgggcaagcgggcaagttgacgatgactgaggatgacgatg

SEQ ID NO: 623817 - DNA, 162 bp, Homo sapiens
cgagagtgatcttgaggatcccctgtctgttcagcagtgtgcagagtgtgtggcgtgtgcatgtgtgtgcacgtgtgtgtacgttgtgttgtacatacacacgttgggacgggggtatgaggggcagcgggtaaagacaaaagaggagtgagtgagcaagtt

SEQ ID NO: 623818 - DNA, 359 bp, Homo sapiens
gcaaaaccagtttacgtgcagcggtccaaggcttacctggaggaggagtgccctgcgactctgcggtaatacctgaaatacagcatatcctggaccggcacgatcctacctctgtggtggtcaccagtcaccaggccccaggagaacagacgaaactgaagtgcctggactacgacttctacccaggggcagatggtcttcacaatggtggcacttaccagtcctggacggtggagacagtgacatcgaaggacacagtcctctactcctgccacgtgcagaacatcagcctgacccagcccctcatggtgccctggaaggccagctatgaagcatgggttggaggctgtgggatctcg

SEQ ID NO: 623819 - DNA, 211 bp, Homo sapiens
cccccccgggggggttttttttccctcaggggggggagacccccccccccccaggggggtttgggtttttgggccccgcccccctttttttttggcccccgggggggcctttggtggggggacgcctttttttttggggggggggggcccccccccctttgggttttgggggggggcccccccccccccccccttttttttttttggggga

SEQ ID NO: 623820 - DNA, 1428 bp, Homo sapiens
  misc_feature (1311)..(1311): n is a, c, g, or t
tacaaaaaacccccccccttttttttttttttggctagtggtcactaaaaaagaacttcttcttcttctctctctatcctcctctttctccgcggaaggaggcaaaaaaaaataaataattacaaaaaataactcttaagaggaagacaacatatatcataaacagaacactccccggtggtataacctctcttttatctcccccgaggggcatggagagcgaccacccctcaattagaggggagaacatatataagtgagttgccccaccacacacacccatttatatacaccaccccacacttgtgtgtggtgaggagcacaagagaggtgtcactctctccaaaagagacgcgaggagaaggagtgtgaggagagaaccaacgagagggagacacaaacaactgtatataaaaaatataaacaactgttgttgttcccagccgagggagaacacacattttgtgtgcgcacccacgtgtgtgcgcaccccccccacagtgtgtgtgtgctctcccacccccaagagagggaaggaccacccctcagagagagagacgctcctgtgcagtgcaaccagtcgtgcgggcgcgttgtagtggaaaacaaactgtcgcggaatgaggagtgagtgcaaaaacaaaacccagccagcgacgagttcagtggagggaggggaggaaggacgcgacccccaaacgaacgagcgggcaaaaataagagacgactctctctcaccaccaaagcggtctcgatagagaaagagaaagaaacaccccacaaaaaagaaagaaagaaagcgtaggcaaggatgcacacaccgcccgcggcgggagacaaaagaagcggggagaaaacaaaaaacactcccctcgatatgggtgggatcacacacacagcaaggcatactagccgaggagaagaagtctatcttttgatgcgggcagacagaagaaaaaaccaatttcttggtatacagcgcgactagcttcgtaattaacatattgagtgggggggggaacacacacatcccttcagtatgtaagcaacaatcaacacaacaacacagagcgtgtactttatgtagacaacccccctcataatatgatatgagaacaagatagtgggggggagcaaacaacacgaccagcacatacaataagaaatacctacgtagaaggatgcgcggacaaaaaaaattatttcaacgtagaggagaggactgacatatgacttatatataattgaggggtgaagttagaggggggatgatagtagataaaaacaatagtctgagggtgtgtttctccnccaccaggagatgattatacaatcgcgccgcaccgttagtgtgtgtgttggtatgcatacggcacacacgtgaagcgctccccgtagctgagaaagaagagagggtgggactccacg

SEQ ID NO: 623821 - DNA, 334 bp, Homo sapiens
gcccgagaactacccgtattagagcccaaagtgacccctgatttttatatgtctttaataatggtgttttatctagtgtttttaaattatcctgtgtagtatttagattccctcattgcccattttgactcatgttgtttccaagtgaaaataaaaacccttgacctgtgtttttaaaagccaaaaaaggggtccccccctggaatgggtttcactcgcatgcagtcatttggagggactgaagccctgtttccctttctgtacactttgggttttatattctcatttcatgcctaatgttttattctgtcaattatggatatgttgaggttta

SEQ ID NO: 623822 - DNA, 1464 bp, Homo sapiens
acagctagcttgtaggtctctatgtttgctggctaaccataagggctgtgacggtgataggtaggcataggatagcctcaggagacgcagagtagatacttccagcaaggttaacagagtaggtactctacatagatacatgacagactattagataagttgcggatgctgtctggtctggagtatgtcccttctcctatctggaggctccatagctattagagctggtcattagtcggctacccctagcacgggtataccctatgagatacaggactacactactatctatatatcataccataggcaaggcactagggcactataggagtacctagcatagccaaaattcatatgccagctcataaaccattgcctgcgcgtcgcatccacgctcggctgcgtctagacgaacacatgctaaacatctcggcaaccaagagctcattaccgcacaaatgtgcatccgagcaacacttcgcaccctatcaactactccttcgatccgcacaacacctggcagcccgcgcgttacgatcttcctgtggcttgtctgcccttttccccgtgtgcttgtccgcctattcatgtcccttctagcctctcctcggctgtggcgtcgcctgcgtaccgtcacgcgctgtccgcctcgctcggactctcggccgatactcctcgcccgctcccatttccggccgcggcaccttctcactacaccagttatcctcgctacctagcagttgggtccaggaatgcgttactagtcgacttgagccagaactactatgcgggagccccatttctgtaaggctacctgtgccaagacatatttctagccgtcccattgtcagtgaaagcaattcgtagaacaacacagcatgaccacaggcaccacccttggtgtacgagttccaaacacgcgagacttccgcctggccacctatacggcaacactcgtggacgccactccatgcgccgagccccacaatgcatttccagctcttagccaagcgcaacgcgcatgcacccatcaacgcttgatattccctaagcgcactacctcggtagactggtcttcactgcaccgtctaaacgctttcctcccttaacacacaatggttctgtcctacttgggtgcaccactctcatgcgtagtgagagaaaatataggcccagagggtaaccgagtcacacggtctggtgttgaagagataagtagtaatatagaatatggagatcagctaggcttcagatagccgtccctaggtgtaacaaaatagaggtgaacgtgtgaggctatttgtaactgtaaagggtgctgccagatggaatcctgacacgcagactaacgctatcgcccataccctgctatgaagacaggatgtacctttgacatccatcactcatcgccttctggttcagaacacactcagggcgcgattatcctagagatcgagcttgcgc

SEQ ID NO: 623823 - DNA, 128 bp, Homo sapiens
ccggcccgtgttgttatatcagttagtcatgtaaataatatcccatcctagattaaaggctagaagagtctttcacatgatcttaatttacagtataactgtttaatacacaccattaatcgttacat

SEQ ID NO: 623824 - DNA, 185 bp, Homo sapiens
ggaaaatatactgactgatgtccacagttgctgcatacttttgactagtaggctgcattctggtatgctcatgaatattgctcccattggttgatttgtctgcttaccatgatttgtttctgtccccaaacttgtttatgccagttattgtatttctgcattttaatgtttcatatactgacttg

SEQ ID NO: 623825 - DNA, 436 bp, Homo sapiens
  misc_feature (1)..(1): n is a, c, g, or t
  misc_feature (89)..(89): n is a, c, g, or t
  misc_feature (102)..(103): n is a, c, g, or t
  misc_feature (110)..(110): n is a, c, g, or t
  misc_feature (269)..(269): n is a, c, g, or t
  misc_feature (289)..(289): n is a, c, g, or t
ncctgtaatcacagcactgtggaaggcagaggtgggtggatcacctaagcgcaggagttcgagaccagcctagccaacatggtgaaacnccatctctactannaatacanaaagttagccgggcatagtggcaggtgcctgtaattccagctacttgggtggctaaggcaggagaatcgcttgactccaggagtgtggaagttgcagtgagtcgagatcgcaccattgcactccagcctgggcaccaagagcaaaactccgtctcaaanaattaaaaaagtagaaaganaaagacacacagagaacacaaggttcttctctacctctatcctcttagcatctctgggaggagacacagcttgtgcttccctgtatggaggtctgggaggttctcacctcagccctgcctcagcagagggggccgtagagctcgtgc

SEQ ID NO: 623826 - DNA, 186 bp, Homo sapiens
cgggaccaaagcgcatacacaccggatgctctaagatgattccaaaatgttatcaggattcatggaatctcccgagactacctcccatctggaaggacaaatggattcacagagcaggacaggattccatggaacacagacgcgcagtacagagagagtaccagagactcgaaattcagtaatcat

SEQ ID NO: 623827 - DNA, 297 bp, Homo sapiens
  misc_feature (195)..(195): n is a, c, g, or t
  misc_feature (285)..(285): n is a, c, g, or t
gtctacacgtacgggagcataaattatactgtgaataagtctcagaatgtgaacagactggaattagatttgaataataaaaatctaagctttgagcgatcagaatccacaaatgataaaagtggaaggctaacctggttttttctgtagccaaggcaatcattaaacgttttgtctaatgatctttccccaggnaaacatatgaccagccagagagagagtagcagcaggcaaaccaacagagaagatttatattcgcgataaatacaattcagggtttacagnccttgcttttgc

SEQ ID NO: 623828 - DNA, 167 bp, Homo sapiens
attgattgaagcaaatcccaggcccgagtcctaagtgattggagtgaagaccctgacaagagtgtgctggggcatataaccatgaagagataataccatctaccttaatctgatagctcggccagttatttgcctcatgatgttggataaattagttaagtctcagt

SEQ ID NO: 623829 - DNA, 238 bp, Homo sapiens
cagtgcacagtgagctgagattgcgccactgtacttccaggctgcgtgacagagcaaggctccatcaccccccccaaaaaaaaaaaattgacagctggatcagaggtttgatcctttgggtaagactatcggtagcattatgttctttcagcaagagctatctaaagtctggttattttggccccatttggctatgttagcagccgattgatcacttaatgccaagatttaatgacat

SEQ ID NO: 623830 - DNA, 428 bp, Homo sapiens
cggcgggcctgaggtaagaatcctctgaactgagtcagcactaatctgagcgatggagcctcatatatgagggaatggagcatatagcctggcgtgcagtcacagcgagacccaagggtccctcccagtgacaggaggaggtgagacagaggctgccgcttgctcagaggccccagagcagctccactgcgcacccaaggactcaccacctttaccactaacaagctctgccagtttaatgtacagttactctgtaccacgtcctgtgctgttcactgcagttcctggtaaaatgacgcagtccaggccctttagtggaagcctgggaagagggaactcagggtgattgggaggatgggttgtttgaggctcactccctgttaagctgggcaaagctccgtgtctgagaggcaggcagctaaccgcta

SEQ ID NO: 623831 - DNA, 288 bp, Homo sapiens
gtcgaatctaaaggatccaaccagcccttcggctcctcactcttgtaggccaagccgcctgggcttgctgtaaccggctatctgtcatctctctggggcctggcctcagtccaacctggtggcaccagatgcaacctcactatggtatggtggccaggaccctctccttgggggtggcaggcacacagcagccccccagcactaaggccgtgtctctgaggacgtcatcggaggctgggcccctgggatgggaccagggattgggggatgggccagggtttacccagt

SEQ ID NO: 623832 - DNA, 190 bp, Homo sapiens
tcaaaggcaagtgataacaggtttagtcccctcaaagccggtggggggatggcatacgggcatggagaggagtaaggggtgattaggtttgaaaggggagggtaagggggtgcatgatcggtcaccaaggaaggagcacaggtatcctatactggtggattaaggtagagagccgggcagggtaccgagc

SEQ ID NO: 623833 - DNA, 599 bp, Homo sapiens
gaatagctgcttggtgttaagagctggatcgcttgctgaggggcatatcttatatctgtcattagtctcagtccataaggatctgtccaaggttgaaggctcgtctgggacctagcaggtcgatgatctctatggattccggaagtatctttaccgcaaactattattggagactaggggagatcattgtaatacactcgagcatggttgtcacgaagtgcatggcctctatagcgtcagcttttccatgtcttacacgtgtccttacagaaatattgtcgagggctatcttcaaagaacttcactctatagcactaaatttggagatcagtgcattgaggtgtcacattcaccttacaggtattatgcacaggggacacacgaccctgaactatgcactcattggtcgcgtgatgtatgggaccgagggctaattaggggagcgttaatatttaagctactatttgaaaccgtgaagtcagggggacaaaagacgatcctaaagaagctttaaatagccaaagggggagtgaaagtaggatatattgtggagagggtgttagggagtaatgttggagagtcacctggtagagagtgtg

SEQ ID NO: 623834 - DNA, 1123 bp, Homo sapiens
tggacaggaaagggcacttttaatatgtgggggccagggtgacaggaccaagatgtggggcttggccgtggtgtctcagctcaggaagcctctcccttctttctgcgtgggacagggcctggcggcagctctccttcctccccgcctgtgaggctcctaggccttgccacaggccagcattgccggttgaggctcaggtggcaggagccacccagaaagccccgcaaattgacggagccgaaaacggggacttcacctccacgtgtgtttgccattctcctcacgtggaaagtcctggggaagggtggcgtgggcctcagcctggagcctcagggcctcttcggagggggggttggggcgcacgggcgcagggcgggcgcactggcagggtgggcacagggcttacatcaagggcaggagacacgggagctatcaatcaagggcagggacgccacgaggcgcccgaagccctgggcaggggaaggtaaggctccaggaatggggcagaggccggtgtgtgcctccgtggaaagcggacatcctttctcgtgccagaagaaccgtggttcaccaaagtccctggtcccttcccaagtccccgaggacagccacactcggtgcctcacataaatgaatctaatcccgatatattacaataaacggcattgggctctccccatgtgggaccaaacccgcacaaactgtgaggacaaaagaacaaccacaataccatagaacacataacaaaagaaacagaacacccacacaaaagacaaaaacaaaaacggaaaaaacacaaaagaactggaaacacgacaaagaaagaaaaaaacaaaagaaaaaaaaacaaaaaaacaaaaaacacaaagagaaaaaaaacaaaaacaaacaaaacagtgaaatcaccccagaaagaaaaacgcaggcaaaacaacaacaagaaggaagaaaaagaagaagacacaacaaagaaaaaacacataagaacaaaccacaaacaccacacaagaaaaaggaaaagaagaaacgacaaacagaacaacagaaacaaaaactgctaatacacgagaacaaaccaacaagcaaacacaacgaaagatcatctagattgtcacagccacca

SEQ ID NO: 623835 - DNA, 826 bp, Homo sapiens
gactccagtgcacacacacaaatgataagaaagcaaaacaaccttattgctgatatggagacagttttagtggtctggatagaagatcaaaccagccacaacattaagccaaagcatgacccagagcaaggccctaactctcttcaattctgtgaaggctgagagaggtgaggaagctgcaggaagctgggagaggttggttcacaaggtttaaggaaagaagacagctctaaaagctacaagtggaaagcgaaccaggaagttgctgatgtggaagctgtagcaagttatccagaagatgtagctaaaatcattgacaaagatggctacactaaacaacggatcttcagtgtagttgaaacagccttctattggaagaagatgctatctaggactttcctagctagaggggagaaatgaatgcctagcttcaaagcttcaaaggacagcctgactctcttaagagctaacacagcgtggtgactttgggttaaagccaaagctcattaactgtttcaagaaatcctaaaactcttgtctgcgtagacggtgtaagtaggtttgagaccggagtcttgctctgtcgtccaggctggagtgcagtggcgcaatctcggctcactgcaagctccgctcccaggttcatgccattctcctgcctcaggctccccgagtagcttgacattacaggtgcctgccaccacgcccgggcttaattttgagcatattatgagtacgagatggggttcacgtgtgcttagcccaggatggtctccgaactccaagaactcatgaatcggctggcttcgggcttccaaagtgctgg

SEQ ID NO: 623836 - DNA, 413 bp, Homo sapiens
agactacatgcacatgccaccaccaccagctaattattttggtagagagggagtctgtgtgttgcccaggctggtctggaactcccaggctcaaatgatcctctagcctggacctccaaaagtgcaggggttaaaagtgtgaaccaccatgcccagcagaagacgttttttaaaaaagaaaaattgaggccgggcacggtcgtcacgcctgtaatgtcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggt

SEQ ID NO: 623837 - DNA, 259 bp, Homo sapiens
tgatcgaaccctggaactcttacataagagcctaggagagactgtcgtttgtaccagggaggctgggtggcatgtgtcctcaagtctcgacactactatcgccatctacccaataattttgcctagcgagtcgaccaacttccctgtgtgtatggcgacaagacggtaggagggagaccatcagttatcacgggcaatggtataggatatatgaagcaaggagcaccccgtagttggcagtcctcgcgagactcgggtt

SEQ ID NO: 623838 - DNA, 548 bp, Homo sapiens
tcttactggtcagagaagtacgccgggcctgtcagtaattggctcactaaagggccagcagtttaaatacacaggttgcactaaaagctgcagctttggccaggcaaggtggatcacgcctataatcccaacactttgggaggccgatggcgggcaaatcacctgaggtcaggagctcaagaccagcctggccaacatggtgaaacctagcctctactaaaaatacaaaaaattagctgagcatggtggtgtgcgcctgtagtcccagctactcgggaggcggaggcaggagaatcgcttgagcctgggaggcggaggttgcagtgtgccgagattgcaccagtacactcaagtctgcgtgacaaagcgagactccgtctcacaaaaaacatggtcagtactcctaaatggatgtatgtagtaccaagggatttcctatcaaaatctcagcaatatttagggtagataatggttctacaatttatgcgaatgtacgggacctagaatagttgagagtttggacaaagaacacggtgaatagaatgagc

SEQ ID NO: 623839 - DNA, 1451 bp, Homo sapiens
acgagaacacttcacttctttaaattgaattatttttttattttagaattatttacattatatattttaaatgttggctatttatttgccctttagattaggcttatgcatttttcagcatttcattttcatttcacgtggttgtgaaacgacaagaaattgtgatcctataagtgaatttccgtgattcttattttattacgaacaagacaacttcgtgctacacttcttttagggagcaatttaattatttccatagagtgattagaagcattattcatgtgttctaaacattgcaatttatttcttgtgaccaaggtgtgagggttacatctttcttatatgtgcattacaaggtctcatgttgccccttacaaagaatatagaagtgttctatctacaagaagtcatagccagggtgacatttaaagaacacattgtgcttctccttctatacaacagcattacacattattacaaattttgtcgcaacacatgtgtgattacgccttaaaacccaggttcataaattcttaccaatctattacgcaaactgtgtctcatcttcttaccaaacagtatactcctaagaagggaagggccttctatggccatatatatttcccatattatcggtgccaaaaaacttttacagcacgcaaacaacgtggtttacctggactgcacagggggcaaaacacattatgtcccaccccattgtgggaaacaaaacatatttgtgcacgtggagttactacaatttgtctcacaaggaaaccccttgtaactttcctataattaattccagcgtccaagaaatcgtacatgagctttactatgggtcgcccaaaaaagaactctggaaggaaattcacggttgccaagcggtatgaaaaaacgcccctatggatgtactgccggaaccgttcaccgcggaccaggccattatacaactatttatccaaaatacattggggcaacaacggggattaacatcattactcactacaaaccaagagcgaaaggccgtaactctcccaacgacagcataaactgcccctggagcaattatactaacctaatcaagaaaggaacacactcaaacttagcaacaaagtccactgccacctgcccgcgacctcccctacggcagacaaaccaacgttcaccacagcgacaacatcgccaaaacgccgagccacgacaaacggacaactacagcgcacaaacaacccgcacgcgacaaaaccaccggactaagggacaagcagcacacaacacaacgctcaacacacagcaagaaaagacgtcaagactcaccacacgccctccacacacaatctcacgacaaatacccatacaaaaggctacaactagacgcacaaacgcgctcacatgccattggcccacactccacacacataccggccaagggcgcgcaacacaacacc

SEQ ID NO: 623840 - DNA, 132 bp, Homo sapiens
gtttgccgccagaacacaggtgttcgtgaaaactaccccttaaaagccaaaattgtggaaaggaaaagattcatattcaacattttcgtcattgggacacgtagaattcgggcaagttcaccaatattggcc

SEQ ID NO: 623841 - DNA, 248 bp, Homo sapiens
actagccggtgactgggggctgggttaagaaagacttgagagacactaatcttgcttatcttgagctttctgtgttcatcttaaacaacattgaaaatggcatttgcttcactggtgatgaataaatcatagctagtctgatattgtgaccactagcactcatttcatattaacagaatagagctgtacccttcaaactaatgtcacagttagtgtctctcaagtctttcttagtcactagctcccga

SEQ ID NO: 623842 - DNA, 916 bp, Homo sapiens
tcccttgaggagctagataggtgagagagaataaagagacgcaaaagaagaggagaaataaagacctgtatgcgtccgcggacactaattaggctgttatctgtacgaagggttccagagcggcccttttagtaccggatacctaaaaaagcttgtggttacaacaagctttttggtttccccaggccacaccggggccgccgggttacccccggccggccatttttttagcctgtagtagtcccaatcaaatttcgctgggagccttttcaattttgggcttccgcccggctggtactttttggggccccgcgccctctgcgttaggaattccggtgggtacccgccgtcccagagaaacaagcaggggctgtcccctacccccgcggggaaattcccgcaattacagatgtttaatggacttgttgttaagaacggcctcctcaagcgtgtcaagagacagcacctcgggggaaaacagcacaaaatatagtgaggggtagacacagaacgcaggacaaccccaacatgggaggcagggcgccccggaaaaccgcagcttctgtcaaagatagtgcccttgccccggggcgatgtcagagatatgtcccccccatacgcgctcttcggcggaagatttgcttctttgagaacgaggggccgccagcacaagtcttttgggccgatgatggccccccgacatgaggtttggtcagatcaatagggagccctcctccccacgctcttggggtaagaagagtgcaatgttcattcttgacaagtgtcgagtcatgtcaaaatcttcatactggtggagagtcataaatcagtgacacaaagaagacgattttctaggggtccgtcacaaaaaatggggattttaaaaaaaaacccggctaacccccccacatgacaa

SEQ ID NO: 623843 - DNA, 188 bp, Homo sapiens
tgcaggagcacttctgttcttccatgagcatgcagagtcgagtgttagagtgcatggatccagggcggggagaggctgggcggagtttgggggcctggacgcttgggcgctggttactatggttgacgtgcagcagtctctctcttgggggggctgcagcttcatacttgggggggagctgggactca

SEQ ID NO: 623844 - DNA, 1295 bp, Homo sapiens
  misc_feature (170)..(170): n is a, c, g, or t
  misc_feature (435)..(435): n is a, c, g, or t
  misc_feature (555)..(555): n is a, c, g, or t
  misc_feature (862)..(862): n is a, c, g, or t
  misc_feature (869)..(869): n is a, c, g, or t
  misc_feature (887)..(887): n is a, c, g, or t
  misc_feature (963)..(963): n is a, c, g, or t
  misc_feature (1168)..(1168): n is a, c, g, or t
ccaaacatgttgaacttgtgtgtctcgtaccctgtgctggatgaggccgctgtggttgtcaaagcaatcgtggtaaggtgtgcttcgaagtgttctagcgcgcatgggcagagaagcgcacctctcctcgaacactttctctacactttccctcagagagaggggtgggncctaattgcaaccttaggacacgctattgctgactttgcgtggagtccctcgcacagggggttgtcgcactcattgccataatacccacggagatatcgaagagttcagactcgggagatgcgacgaggatacctccgacagttggacccgaggacttgtgtgactatagaagactggaacagaactagtttcagtaacagacagagaaaagctaattccaatgagctcgcttgtagacccgttgcgacatctcatgactagtgntgtgacacgtggtgttctgccataggctgacgtgacatgtggatcatcgtgtatcaggatagatgagacgcatggagatggtacgaattgagacgcatataaatggtatgcgaccttacnatccgcgtctctcatttcacatgtcaagaactacatgatgtcagggccatatccgcatacatggatgaagggtcttacaccatagaccttcatgacgtgaaagaccatagtcatcagtactctccacgtttgtggtgtccacggggaatagtcattaaggaggagtccagaggcaggtaagtatcatgagtgtagcaaacaagagcatattcaatagacgcctctcgaggatcctcgctagggtcccttatcattgtactccccttaaaacacgcggtgaaagagattattgcccgtagtggctganaactacntccatgaatttcccctgntgtgtgatatatggctggaaatttcgattaacataaagtcctatttctggatgtggcgttgcttcgccccaaattntgcttgtcgaccctgaagggcaatgaaaacggtttcggatttcgggtacattgtggggtagtcacagacagaagactgtgtgaattgagattgtttctcaagagaggggtgtgtgtgagtgtcaaagattcatttaaagagcatatatggaccatggcgaccagtggtaataattatgtagcaaactatgtagtgtctaaaatgnacgcgtgtaagtggggggttggatctatattaaaccacgaaataatatgggaggtgtataatggaggtatattagtatctgttcgttatagacagagagtatgttagtgagtatacacagagagacg

SEQ ID NO: 623845 - DNA, 375 bp, Homo sapiens
gctatcactaccttttctacagacagtactgcacaccaggaaggccaagacaaaacaaatcaaggaatgaagttatcacaaagactgcagtgtgaaccagactataaacagtatgattccatacacatgaatgggtttcattgctataggaaatccaagtggaataaggaatggagatgtgtaaacaggtttcttgacaggaaagaaggatgacaccctgtatggatttagtatacagccccttctgccgcatcacattcttctcctgcactgtctgatgtccaaagtgtaaggtagtctctaagcaactgcatgatgagggtgctgtctttgtatgagtcttcattcagtgtatcaagttcagcaatggcctca

SEQ ID NO: 623846 - DNA, 411 bp, Homo sapiens
gacttatgccgtgggtccaactccgggctcaggtgatcctcccacctctgtctcccatagcagggggtattacaggcatcacgtaccactccaagccatgagttcggcttgggatgtaacaaggttgaggtgttcatgagttgaccagtggaataccagcaagaaagaagttgagtgttaacatactgtggtttgagacggagagattctagcctcaagacaaaagttgaggagtcattaggtgagaaatggtacttagaagatattatgtgaaatggatggagctcaggtagcagacaagtccagagagagcaggagtggggctatacatctggcctaatgctgccctgctcctcccaatccctgtgttatgctggagagggttcagcctctggtgagtttcaccaaacc

SEQ ID NO: 623847 - DNA, 235 bp, Homo sapiens
  misc_feature (235)..(235): n is a, c, g, or t
tcgagttttttttttcttttagagacttgtttcatcatattggtcagactggtctcgaatcctgacctcaagtgatccaccagtctcagcctccaaaatgctgggattacagtgttaggagttttaggaatttaagccacctgggaacatggcaatcccatctctacaaaattacaaaatggtccgggtatggtgggcacgccatagcccagctactaagagcttaggtggaggn

SEQ ID NO: 623848 - DNA, 210 bp, Homo sapiens
cccggatttattaacaaagtacacaacacaactataaaaacaacctctcaaacacattcattagcttcaatgaaattatggtaactacagaaaaaaactcaacttgtcagtcaaaatagtaacctctaagcattttttcccatgatgtttttaaacacatgcacattgcacactaacattcctatgtaactatgtcactcacttctaaac

SEQ ID NO: 623849 - DNA, 243 bp, Homo sapiens
attgtgtggtgttatgccaacacaattgtttgctgagcctggattaaaaatgtcccatgatatcaaatggtcttgattttaatgtccaggaatttgtaaattgtcttctttaacattatgattgatttatgttcttggaaaaagtcaatattattttgaacctgaagaaaatgtgaaatgttttttgcggtttcggattctcttggacataatttgactcttataccataacaccacacaatt

SEQ ID NO: 623850 - DNA, 224 bp, Homo sapiens
atcgtggagtgcctgcacagaggaacaggggccaggtgcagggttcacacctgtgaatcccagcactctggaaggcaaaggcgggaggatgcttgagtccaggagttcgagaccagccgggaaacaaaataagacctcatctctacaaaaaattaaaaaaattagccacacatggcagcactcacctgcagtcccagctactggggggaaagtcagtgcgtatt

SEQ ID NO: 623851 - DNA, 191 bp, Homo sapiens
gtgctacgaacaggactggggtggtttcacaccctgggggccccaaccctgtcctcccgagctcctcttccatgctgtgctcccaaggctctgaggaaggacttccctgtgtcttttgagctctaaacagttgctttttgttcatttaatgctgccgcatgggccatcagcactgggggggaccgatctga

SEQ ID NO: 623852 - DNA, 263 bp, Homo sapiens
tagattctctggtcattgagcatatccaagtgaacaaagcacgtaagatgcgcctgccggaccggcagagatcatggtcttgattaacccatacatgagctctccccagcgtcttgcgatgttctctcgtgaaaagtgtcagcttgttcccaaaccagtattggaggttgtccattacaaagtgatatcccataattttactaaataggacaatggtttcatagcgtgtgaagtagttttaccaatacatcctgaggcagaaa

SEQ ID NO: 623853 - DNA, 118 bp, Homo sapiens
agacacaggtgtcgtgaaaactacccctaatggccaaatgggaaggtaaggactcatatcacatttcgtcattggacacgtagattcgggcaggtcacatactggccatcgattctta

SEQ ID NO: 623854 - DNA, 168 bp, Homo sapiens
ctaaagcacttaaagacgtcgacggggaatggtctggaacacggacctggtgagaccctggagctgcagatatctgatgctgtgtgcgctgcaaacatctacggagcagaggcacggaaggagtcacggggcgcgcatgacaggtaagactacaaggtgcggattgat

SEQ ID NO: 623855 - DNA, 233 bp, Homo sapiens
tcgcgcctctcgatgagattgtggtgaactggtgtaatggcacctttggcaaggtggtggagtgcttggatcatgccagagtgaagtctcaggttgccctgaagatcatccgttatgtgggcatgtaccgggaggttgtccggttagaaatcaacgtgctctaaataaatcaaggagaaggacaaagtaaaactatgttcctgtgtgtcttgatgtctgactggttcaacttc

SEQ ID NO: 623856 - DNA, 1059 bp, Homo sapiens
  misc_feature (281)..(281): n is a, c, g, or t
  misc_feature (328)..(328): n is a, c, g, or t
  misc_feature (339)..(339): n is a, c, g, or t
  misc_feature (376)..(376): n is a, c, g, or t
  misc_feature (379)..(379): n is a, c, g, or t
  misc_feature (408)..(408): n is a, c, g, or t
  misc_feature (411)..(411): n is a, c, g, or t
  misc_feature (416)..(417): n is a, c, g, or t
  misc_feature (419)..(420): n is a, c, g, or t
  misc_feature (424)..(425): n is a, c, g, or t
  misc_feature (430)..(430): n is a, c, g, or t
  misc_feature (446)..(446): n is a, c, g, or t
  misc_feature (450)..(450): n is a, c, g, or t
  misc_feature (460)..(460): n is a, c, g, or t
  misc_feature (487)..(487): n is a, c, g, or t
  misc_feature (498)..(498): n is a, c, g, or t
  misc_feature (504)..(505): n is a, c, g, or t
  misc_feature (517)..(517): n is a, c, g, or t
ctcagatcatccgtgacccttccgcatataattcgcccaggggaagaaatacagaggaggagtggagaacgtctgcagcaattctcgagagaagatatataaccgttcactgggctctactgtgtcatcaatgccgtcagaagactatggatacccaaaacaaactgcagaaacccagactgctggggcgttcgaggccagttctgtggcccctgccttcgaaaccgttatggtgaagaggtcagggatgctctgctggatccgaactggcattgcccgcnttgtcgaggaatctgcaactgcagtttctgccggcagcgagatggancggtgtgcgantggggtccttgtgtatttagccaaatatcatggcttnggngaatgtgcatgcctacttgaaaagcctgnaancaggnntnngaanntgcangcataatatctggaanattngctgcctgcnttctacttctcaaatctttcttgtaanagttccaattntttcanngaaacctgagtncaaaaatcttgatgcatcagcctgtttccataaggaaactccaatcaaggtcaatcttcagcagcacatgtgttatctggagcatcaccagcaaggtctcattgctaggttacactttgaccctccatgacagtttcttctctgactcccaaaaccccatcatcatagtatccccctctatttccaatgctcctactcacaaccgcttagttatctgaacttctctttacaattacagtttcatgacacaagccatattttcatttcacattgggtgtctgaactaggccctcataacaacctcagccacttgcgacacccccaaatacatagtattacactacactagcattcctattgcaccttcccagagacagcagcccctctaacccttgttatccaaccacaaaaccgacgtatgacattcacgcaatttcaatacttacgttgacccctattctaatagcacaatcacggccccacacaacgtctacaccaacacatttgtggacaacaatactgctacctacttggcaccactg

SEQ ID NO: 623857 - DNA, 449 bp, Homo sapiens
gatcaggtggcaactggaacagtcaccatcgtgtgtgtggcgaataaatactttcccgatgtcaccgtcacctgggaggtggatggcaccactcaaacaactggcatcgagaacagtaaaacaccgcagaattctgcagattgtacctacaacctcagcagcactctgacactgaccagcacacagtacaacagccacaaagagtacacctgcaaggtgacccagggcacgacctcagtcgtccagagcttcaataggggtgactgttagagcgagacgcctgccagggcaccgccagtgaccctgaggcccagcctcgccgctccctcccctcagtggacccattcccaccacagtcctccagcccctcccctcccggccctcaccccctccttggctttaaccttgcgaatgttggtgagatggatgaataaagtgaatctttgcaa

SEQ ID NO: 623858 - DNA, 314 bp, Homo sapiens
cccttgccatcctaaaagcccccccccttttttttaaggagaatgggccagtcctttcccaagtccccccaggggaggggatagcattgctttcgggtaaattatggaaagcaaaatttttttaatcttcgccctaaaactttttattttgggttttatttggaaggaagagccttggggcccccccttcccccttttttgtcccccaacttgaaaagtatgaaggcttttggtttccctgggagggggggggggcagccaggggtttcctgtcccctgacttgggaccagttgaataaaagggccccccttta

SEQ ID NO: 623859 - DNA, 385 bp, Homo sapiens
tcataccagacgtagtttttctttccaagagcgtattcttatagttaagtatcgtgcatataaggcagttgcacgaaaagagcaaaggtgtctgggacaaacaggggtatgcattgtagtcctttttaggaacaatatctaaaaaaagaaccgccctcggccctcccccaaaaaagacaaagattcacacagacacatcgggatatatgtacaaggtaataaaccccatcctaaagaagcaacggggataacccccaggggatacagaatcagaatggtaaaaatcacagtgaagttggctggctgtaaagcctgagaattttttttccagtgggttcttctgcaaggctgtgataccggcaaagatatgtaaaatctaattttt

SEQ ID NO: 623860 - DNA, 139 bp, Homo sapiens
aatgatatgatggcctgaaacaataaaaagtgggatgtttgggagtattaactgggacctatatatttctgatatgtccttgattataaacagatggacagattcaatttcacgacagtgtgactaccattcctggtgt

SEQ ID NO: 623861 - DNA, 131 bp, Homo sapiens
agggtattgaggatccgcacggagagaactgttgcggactgtggcagcggaaggactgtggcagcggaaggactgtggccgggaactaggcaaggagagaactggcaaggagaggactgtggccagcggaa

SEQ ID NO: 623862 - DNA, 117 bp, Homo sapiens
atagcgggtttgggtgcctcaaggtgtcctgctggcgctcgtgggatcgaggatcaagcacgggtgacacggaatatagcggggttggggggcctgcctatctccggatggcgtggt

SEQ ID NO: 623863 - DNA, 809 bp, Homo sapiens
  misc_feature (405)..(405): n is a, c, g, or t
cagaggctgggatcatggtacatggaaccctccttttactcctctcgagaggccctgggcccttacccagacctgggacggcgtctcccactccttgaagtatttccacacttccgtgtcccggtcccggcccgcggggagccccgcttcatctctgatgggctacgtggacgacaaccctagttcgctgcagctatcgactagacgacgccgcgacgatccgcacggatggtgtccgcgcgagcggccgtgtgatggagcagcgaggggtcacgtagtattgaggaccgtggagatcacgtgaggcgtccatgggtacactcgacatcagattttccgagtgaatctgcggcacgctgcgcggtactacaatcgatgagctgaggccgcggtctcagaccctgncagtgtggatgccatggctgcgaactgtgggcccgatgggcgcttcctccgcggggtatgaacaggttcggcctacgagggcaaggatcatctcacggcctgtaatgatggacctgcagctcctggatcgcggtaggaacatcaggcgtgctcaggatctccagagcaacaatgtcaaactgatgcctctgagggcaggagcgagccagagtagccgtacctgagaatgacactatgactgtggagtggctccaccaaatacctggacgaaggggcaaggagacgctgcttcatctggagccacctagtgacactcgtgattcagcgacccaatctctgaccatgaggtcactcctgcggtgctgggccctgggcgtctaccctgtcggagatcacatgtgacc

SEQ ID NO: 623864 - DNA, 534 bp, Homo sapiens
tgtacgaaaccagcgcgagttttacagatagatggggttcaagaagaggcacccccttcgcccatatgggtacatgcgccatctccaggcaggttttttttggccaacaccgtgcggctttgctttacagagagaaggggcttctccaggccaggactggccccacaagggggggttgggagtccaaagataggactgtctggactgaatacttgcggcgcgccaaatggggggaaacaattttgtttgtggaaccaaccgggccggtgggcggaaaccgaaggagaagtttctcgcctctaaaccaagcccaccctaaaaagagggccagggaggcacagcaccacccagaaaggttgggtgggactgcccaaaaacaacatccattgcgaggagtttgggggaaaatttgcaaagaaagccatttgggggggcccaaaaagaagatatttgtgcgaaacccggaaagagaacccaatcccaatggaaaaaaagggggggggggcactggcccctcggtgtcgggggggggtg

SEQ ID NO: 623865 - DNA, 220 bp, Homo sapiens
ccacctgtcccaaacactgatgaagcaatagtggatcagctcacactatattttcaagaatattactgttttagattataattgggcataaatttcctaggttttactaggtcatcttgaaagttacagctggtttcaagcagtttttttttgtttttttttttgagacagattctcattctgttgcccaggttggagtgcattggcagatcatggctca

SEQ ID NO: 623866 - DNA, 309 bp, Homo sapiens
tggactcctaggatatgtcgtgctcaggcagatcaccacgtccaccttcttttttatgtttggacaaagcttcaacacgtcctccttgcaggccgatttaaacttgtaagaaaaccgaaaatcctacatctgcaccagctggaagtgcgtaactccgatggcacacttctcgttcatgaccttctggtgtgtgatcgtgatcagacactccatcaggaccccagagtctatctggttatctgccacatcgtcgcagaggttctgaattatggactcacaggctctcatcagcacggcttctatttgaat

SEQ ID NO: 623867 - DNA, 206 bp, Homo sapiens
aaaaaaagggggcccccttttttttgtgaaacccggggaaaaaccaagggggggtttaaaggggggttttttttgcccttaaacaaaggtaattttggtttttttttttgttttaatggctttttttcaaaatttggccgggtttgggggggaagttttttttttttaaattttttgcatttttttaagggtttgggaaattccca

SEQ ID NO: 623868 - DNA, 698 bp, Homo sapiens
aagagaggcggggaccagacgctcgtgcatggcgtgagccagatctggagtgcgagcagatccgtctgcagtgtattcgtaaggagggcttcttcacgtgtgcctccggaacacaggatcgggcccgggacacccagacagatgagacttgtcgcactgacacgacggtgcgcgatggaccacggagaacggatggcatccccattcagcagcttgccggtgagatcactgctgctgctccgtctgcgatcatccgaacactcggtggagctgaaggagggtgtgggacactggagcatctcctgggatggtactgtgagcggactggccacctcggaaatatgcacaccctccggaggctcaggtagtgcatgtgctgcaggtgtccgggctcagtatctgacaggactcattatccacggacctgaggtccaacttgctcatgacgacaagggtggtgaagacgggatcggctggccggctagggtccagtaagcatgacccaagtggtcatctctgtacgagccctgactgctgagggaacacacgcaacaccacatcgacttggctgtggctgtatggccgactgtgggccaggctcttccggattcggatcacaacgtgactccgctgtgggagccatggaattgcgggtccagcgcctgcgcagacgccgagcgcacacctgccatcagtga

SEQ ID NO: 623869 - DNA, 130 bp, Homo sapiens
  misc_feature (33)..(33): n is a, c, g, or t
  misc_feature (55)..(55): n is a, c, g, or t
gagggctgggcacggtggcttatggctgtaatnctgcaaactctgggaggctgangtgggagaatcgcttaaccccagaagtttgagtccagcccaggcaacacagcaagaccccatctctataaaaaga

SEQ ID NO: 623870 - DNA, 339 bp, Homo sapiens
agaacgcataaacaatgaaattacaaaaaaacacaaatcgacaagaagactaaaaaaaaaaaaacacgaaaagaaaacaaatcaacacaaggaacaacatagaatgaaaataacgcataggaataatatatgacaaaaaatataagagcatagaaccggataggataaacgcgagaatagacacagcctataggagcgcccccaaaccagaagcaaggggaccactaaggagccgtccgggaccatacgcccataacaacgggatctgaacaaacagcccccaagcgcaacaggacgcagacgagacgagaaaagagaaacacgagcaggggcgaacaa

SEQ ID NO: 623871 - DNA, 188 bp, Homo sapiens
gtttaaaaaaatttttttttccccggctttacccccccaaaacggaatgggccccccgttttggggggccccaattccctttaccccgttttgggttttaaagggattggccccctttaaaaaccccggggggttttgtttttccccggccaatttccggggggggaaaaaaaaaattctttttttta

SEQ ID NO: 623872 - DNA, 300 bp, Homo sapiens
ccggcaggaaataatcgaaagtagccaagctctcaaagtgttaagtggggcccttaacctggatctcaaaaaatgctctaaacataggaatggttaaagagttctccatgtcttcagatgaacttaaatctctagaagaggcacaagaatggttaaaccacatccaagggcccgcgaaagtaattagacctttgaaaaaatctgtttgtaggaacagtttggggtgggcctgcaaatttagaggctattgtctaagaaaggaaaatataaataagtggtttttcgtgtgatatgttctcc

SEQ ID NO: 623873 - DNA, 104 bp, Homo sapiens
agtattggaagagcagaattgagggagagacctttcttccttgttgagggtgagaaataaataagaattacatgtccaaaaaaaaaaaagtcgacgcggccgcg

SEQ ID NO: 623874 - DNA, 295 bp, Homo sapiens
ttttaaaaaacccccccccccctttttggggggtgggggggttttttaaaaattttttcccccctccctgggggggggggggggggcccaagccccctttttttggaaaagggccccaaaattttaccccccccgggggggggggtttttttttttccccccttgggttgccgcaaagggggggccccctttttcctttttttggggggggggcccccgggggccccgggtttttttttttttttttcccaggggggggttttttttttttaaaaattttttttttttcccccca

SEQ ID NO: 623875 - DNA, 812 bp, Homo sapiens
cgtaggccgtgaaggcgggcgtggagtggccccgagcttcacgagcagctgctgtctgccgagaaggtcgacaccggctacagagacccctactcgggacagcaccatctccctcttccaggccatgcagaagggcctggttctccggcagcacggcatccgcctgctggaggcccagatcgccacgggcggcatcatcgaccccgtgcacagaccacacgacggtgcctgtggacgtggccataccagcgcggcgtactatcagatgaggagatgaaccgcgtccatggcaggaacccagacgaagacaccaagggcatacttaagacaccacaacacagcattgagaaacactcacgtacaggcagctgacatggagcggtgcgtggaggaacccgaagacgggccatgcgccatactgaccactgaaaggggcggagacaggctgagagtggaaggagaccaccgcaggatgctacgacgaggaggacgaacaagaagggcagtagaagagacaacagactcgaaaatccccggcggacggcaagcccacggacggctcaaccatgtacccagatgggaaaaggatggaagcacagctcaggaacacgtggaatccaacaggagcgaagccagacagacgcaacaaagcatgcagtgcgccagatcactaagcagagaccgagccgagagaaacccacggacaaccgccaatgaacaatcatcagtccgaaccacgatacagtcgagaaaaacagcagcaacaacacagacaaccacgaaccgagcaccccaaccacaaagtaaacaaa

SEQ ID NO: 623876 - DNA, 859 bp, Homo sapiens
accggaatgacctagctcccagcctccagaccctctagacaccacccatgctgccccaggtcttacacagtgcgtggaacaaagcagagacatttattcaccttgactccccagggaagccttccacactagatggtccaatcctactggatggtcggttgctgctcacatctgcctgcaagtctttccagtactcctgggatatcctgtaatagactcgggtcctgtccacggccctggccgcccacaatccagcccacaaatccacatggctgttcccagcagtgctgtggtacactgtgacagtggctctaggggaggaggccaggagcctggccacagtgttggctggactctgactcagtggcccagcctgcagctggaaggacacaggttgccggagtccctgacacagctccagcatatctgtgaccatctgctcctgataaccactgtccagcatctcttcgggccagcccggtgccacggtcacatgggggaagacttcagccacagctgtgagcagctctctgccagctatgtggccagggaccacaaaactaccatgtgagactgtggaccccacccacacaggccagggcagatggccaagggtagaaaggtgtgctaacgtggccagggatggccggagagcttcgggttccactatgttcacatggatgccccagcgcctggggtgaacagccagacgcagcagacacgactccagtgtcagagcagggccacctggggtgtgtaggatgggtacagggttcccagcctcaggttcctggaggccaatgtccagcaagatcatgccttctctgtctggaagaggcaacagtttggagatcctgtc

SEQ ID NO: 623877 - DNA, 403 bp, Homo sapiens
  misc_feature (13)..(13): n is a, c, g, or t
  misc_feature (112)..(112): n is a, c, g, or t
  misc_feature (132)..(132): n is a, c, g, or t
  misc_feature (137)..(138): n is a, c, g, or t
  misc_feature (169)..(169): n is a, c, g, or t
  misc_feature (194)..(194): n is a, c, g, or t
  misc_feature (199)..(199): n is a, c, g, or t
  misc_feature (228)..(228): n is a, c, g, or t
  misc_feature (354)..(354): n is a, c, g, or t
accagcccagtgnactgcagcgatacttcccgtgttccttgcacgtctggtcgccggcatcttctttcatgaagggcggcgccctgtgcggcctggtctacctgttcgcgcnctccgctacttccagggctnacgcnncgcgcagctcaggctggcaccctgtagcgangcgcgcgccctctggctgctggtgngctgntgcgctcggcctgctcgcccacttcctcnccggccgctgcgccgcgctcctcggacggctccggacgctgctccgtgggcctgagaccaagcccccgggccgacggagccgggaaagaagagccggagcctccagctgccccggggaggggcgcntcgttccgcatcctagtctctatcattaaagttctagtgaccgagaaaa

SEQ ID NO: 623878 - DNA, 416 bp, Homo sapiens
  misc_feature (18)..(18): n is a, c, g, or t
  misc_feature (58)..(58): n is a, c, g, or t
  misc_feature (217)..(217): n is a, c, g, or t
  misc_feature (401)..(401): n is a, c, g, or t
  misc_feature (403)..(404): n is a, c, g, or t
  misc_feature (406)..(406): n is a, c, g, or t
gggtcccttaatgaaaanccctgtccaagtttccccaaaaggttttaataaaaacaanaagttgaaagtacctttatttttaaattttatttttgaagacaggacctcgcctctgtcaccgaggctggagtgcagtggcatagtcatggctcgctgcagcctcgtcctcccgggctccatccatctgcccatctctccctctgagtagctgggaacncgggcgcgtgccaccacacccagctaatttttgtatgtttggtagagagagggtttcaccacattgcccaggctggtcttgaacacctgagctcaagcaatccaacctccttggcctcccagtgttaaattacaggcgtaagccaccacacccggccaagttgaagtatattttgtgatttttnanntntgtgcagact

SEQ ID NO: 623879 - DNA, 116 bp, Homo sapiens
cttattgatagtactgctaccgcggtatgttggtacacagaaacatacacagtcttctagcatgtacctatcaatgttgttcggtcagccacttagggcagccacttcgtgggcag

SEQ ID NO: 623880 - DNA, 252 bp, Homo sapiens
  misc_feature (34)..(34): n is a, c, g, or t
  misc_feature (39)..(39): n is a, c, g, or t
  misc_feature (58)..(58): n is a, c, g, or t
  misc_feature (92)..(92): n is a, c, g, or t
  misc_feature (241)..(241): n is a, c, g, or t
  misc_feature (247)..(247): n is a, c, g, or t
gaggtgaagttgttctttattgaattgcattatnaatgnataggctgtgcctttttgnactctctatgagttcatgaatttaaccaatacgnccacaaatgctgctgctgtcacagagagatgccgataaaggacacccaccaccaatttttgaacagggaggggagaatcaactctgaatgtgatgcagtgaccaggagagaggaccatgttaacaacaccacacaaatgcaaatgactngttctnaaaca

SEQ ID NO: 623881 - DNA, 151 bp, Homo sapiens
taagctccctcgcaggctagctcaggctgtttctcctctccccccagcatcttccccatgctctttgtggcccctccaagggcctgcttcatgacgaagtcatgccgccggctctggttagcgtgccttagcccacggcagaatttgcatg

SEQ ID NO: 623882 - DNA, 151 bp, Homo sapiens
ctacgagagccgccgcggttctctgttgttgagatgcgcctctgggcgatctgcacatactagaagctgagaggtttcctcgggtttagtcagagcttgatgcaaacaagggaaggagcctctggagtttcttgacctcctctggcatcca

SEQ ID NO: 623883 - DNA, 944 bp, Homo sapiens
  misc_feature (57)..(57): n is a, c, g, or t
atttaaatagtttcttcacccctaaccacccaaaacatacagcccctctcgagtaanaacatttacaacagttgaagcagatgaacactaggagcagcgaaacccacaatcctcataatttatcacctagcaggctgacaacaggtgcatctgctgatgctgcctgggataatggcattgatgacgcttattttttagaagctactgaacatgctcaattaagctaaacctgcacagaacagtcttctcagttataacactgaagtggatgaaattcctcattaactcattataaaacccttactcccagtccctacctctccataaacactactagccaccataaatatcaccctgtctgatctcccgagacgcactccccacctccatcctcccaaccttccccacccctcaaccctacctctcttacctttgcattacccctccccccctcccatctcctccctatcactaccttgtcactacacacatcatgcctacccaagcccactactaatatatcacgattcccacactacctaacaccctcaccacatctcccacacctgacatacacctctgcccctaatcatcatctcatccactccacatcctcctcccccctcagccctcacctcctatatcactccctcctatccgttcctttctccccaaccacacatactccaccacactctcccctactccagacactccctcgccagcaatactcgccattccattaatcatcactcaaccctctcgctccctcaccaccccaaatcgcagatcaatatacttcacctccaccgctcctctcattccttccaattactctcctctcctcactctcatctatctctccttactcccctgtctacacctcccccgctacagaccacacgacaccctcggcccatcacacacttcacctcaactctttc

SEQ ID NO: 623884 - DNA, 323 bp, Homo sapiens
tgtgaatccctcttgctttttcccccttggaactagtcattaacccatttttgaactggtagaaaaacatttgaaaagctagtctatcagcctttgacaggtgaattggatggttttcaaaaccctttcccccagacagcctgtttttatcctgtttaataaattagtttgggttctctacatgcataacaaaccctgctcccatttgtcccataaaagtttgtgacttgaagtttagtcagcccccccccccaactttatttttttatgtgttttttgccacaaatgagggttttgaaaataaaggacccctgtttttatta

SEQ ID NO: 623885 - DNA, 421 bp, Homo sapiens
  misc_feature (201)..(201): n is a, c, g, or t
ggtttcccttttggccttttccccttggttttggggggcccccagttttttgggcccccccccgggggaaaaaagggggttttttcgtttggttttaaaggtttgcctggttttttagccctcccttttaaaagtttggggggttttttagcccccccttttgggggcccaaatttttgggccccaaaaaggccttttaancgggggggctatttttaaatccccccccgggttttaaaacggggggaaaaaactttaaaggttttccccccttaaatttttttggggggccctggacggggggttggcccccgggaaccgggttaataaattttgggccccccccatttggttcttttttttttttttaggggggggggcccccttccggttaaaaaaattttttttttttttttgccca

SEQ ID NO: 623886 - DNA, 366 bp, Homo sapiens
tgggagaacagtctcactctgttgcccaggctggagagcagtagggggatgtcagctcacggcaacctcgacctcccaggctcaagcgatcctccggcttcagcctccctagtagctgaaacgacaggcacgcatcaccatgtccagctaattttaaaatttttggtaaaagggaggtttggccatgtaaccaaggctggtctcggatcccggggcttaagcaatgcacctgcctgggcctcccaaagtgctgggataatgggtgtgctcagctaccatgcccagccgtgtgctactttaatgtggagagggctgagcaggctagcttggtggctctaggacttctcctctttggcttttatattt

SEQ ID NO: 623887 - DNA, 368 bp, Homo sapiens
  misc_feature (25)..(25): n is a, c, g, or t
  misc_feature (87)..(87): n is a, c, g, or t
  misc_feature (98)..(98): n is a, c, g, or t
  misc_feature (158)..(158): n is a, c, g, or t
  misc_feature (161)..(161): n is a, c, g, or t
  misc_feature (233)..(233): n is a, c, g, or t
cccatctcccaaaaagatccttccnactgaaagtcatcttggtcacgattttctcccttcctttatattccccaaactgtgtcaganaggtgtttaanagaaggaggaaatcagcctagcatggtggcccatgcctgtaatcccggcactttgggagntcnaggtgggtggattacctgaggtcaggagttcgagaccagcctggtcaacatggtaaagccccgtctctactnaaaatacaaagattagctgggtgtggtggcacgtgcctgtgatcccagctgctcgggaggctgaggtgggagaatcccttgaacctgggaggtggaggttgcagtgagctgagatcatgtcactgcactccagcc

SEQ ID NO: 623888 - DNA, 297 bp, Homo sapiens
  misc_feature (28)..(28): n is a, c, g, or t
  misc_feature (46)..(46): n is a, c, g, or t
  misc_feature (54)..(54): n is a, c, g, or t
  misc_feature (65)..(65): n is a, c, g, or t
  misc_feature (67)..(67): n is a, c, g, or t
  misc_feature (104)..(104): n is a, c, g, or t
  misc_feature (116)..(116): n is a, c, g, or t
  misc_feature (194)..(195): n is a, c, g, or t
  misc_feature (237)..(237): n is a, c, g, or t
  misc_feature (247)..(247): n is a, c, g, or t
  misc_feature (256)..(256): n is a, c, g, or t
  misc_feature (265)..(265): n is a, c, g, or t
acatgacaaaaccctatctctacaaaanatacacaaactggtttgngcgtggtngcgggcacttntngtcccaactgctcaggaggctgatgtggaggagcctnatgtgggaggtncacttgagtccagaaggagccatgattgcaccactgcagtcagcctgggtgacagaccctgccttaaaaaaaaaaaanncccaaaacgtaacatttttggttccggttcagtctatttaanataccatttntttttttanctgcacaanttaggaaataaaggaaatttacattttttttt

SEQ ID NO: 623889 - DNA, 200 bp, Homo sapiens
taccttcatgccctggttaaccacgtgtatctcattagtccagaaaaaagggcctgggaccatgtacgaaccaatcaagaaatttttagcctgcgggaacaacaaccattttgggcagcggctatcacggggtcaacttatttttgacctcgtcattgatcataggcagggcgccgatttgtaacggttacggattgtcg

SEQ ID NO: 623890 - DNA, 530 bp, Homo sapiens
cctttgtcttccaaatcctagcagtagaagcatttgagttctgcagaaattactgaagtggttcaagtgtgggcagtcaggacactcagcccaccatactcaaccccaactcaacctcaactctcagtacggcagagagacggagaactcagagctataactttcaggaattctcaaaacctcagacaaaatgcatctttgttttaccacctgttaaagtatatcctcatctgcctcagtgcacataagtatacaacactgcagattgtgtttaacttcatttgcaattaatttaacgcattttgtatccaacatttctactaggaaatagtattagtctatccccaaactaaaattcactgcaaaaatgtaattcactcaagaaaaataatgataattcttcaaacaccttgagatgtcattcaacaatcatacccaatgggtaaaatttagagttcaacatttagcttgcatttctttctaaccaaacatctcaagttcaaaaaataaagcagattgttttgtgcaaa

SEQ ID NO: 623891 - DNA, 589 bp, Homo sapiens
gaatgaaagagtggatttgggacctcggacctggcgggggttaaatttttaccttctcatagcggaggggataaggtgggaaagaaaggttctgaatccttgggccacatttggcccggcttctctcagggttaagggttcgggaagaacattaagaatgagatggcaatggaaaatagtcatttggaatcctatggattattcaaaaatgcaggcggattggtctttaatcagaggtaggattcggtttaatagtatagaatctactttatccttccttttaatagttcctttagaccggtgaaatttcttcactacatttaatagttctcctatttcccgctcccccatatcaattttcctttggtctccggggctgagtaaataaacaggtgcggtcacaaatagcagcaccacttgggatggatttggctctccaggacatcagcacagggccctgatcagcactaccagatccaaacataagtcactgaaaaacacttaatatttatgaggtggtacatgaccagggacctggtataaagtactatgtgctagattcatgcctcaaaagttattataaacagaa

SEQ ID NO: 623892 - DNA, 505 bp, Homo sapiens
cagattttagctccaacatgcttcaacacatctgacaggaagtttttagcatatccagtaagagcttgattatctgcttcaggtgtgtttgattagggttggcgctaaactctgtaggacaccggatctccaggactgagtttggacactcctgccataataaaagaagttgggattttaatgctaatgtgttaaaagcaaaaagctttaagtttttttttttctttgtaaatatgctctttaagtgtatcatacttgcttgtcttaaatcaagtcatacgaagcaaacaaatcataattctgtgatgttacacattcatatcagcaggtcagaaatgtagtttaggtcccatagtaagaccagatttgatctgttgtaaacactgacctcagtaaccagttatcaattattatcagtcataatactcaatgatagtctgtcacaaaaacatcaaaacagaaatgaaaacgtgtttattttgtaataaatagatttttcataata

SEQ ID NO: 623893 - DNA, 221 bp, Homo sapiens
actcagacactttcggtctaaccagaagggcagaagcggccttatcttcatatgcattttatcatccaaacactcctgacattaggaacaaacttcacaaattagaatctggcctcaaaccccacaataggaatgaatcaaccttgcattcaaggtgtacaatacatagagcaggaggcttagcagtcagagacagtcaactgtgttgccggggtccgggg

SEQ ID NO: 623894 - DNA, 275 bp, Homo sapiens
gatctacagctactcaggaggcgaggtggatggttaatttgaggtcgggagttcgagaccagcctggccaacgtggtgagaccccacctgtactaaacatgcaaagattggccgggcgtagtggcatgcggctgtagtcccagctactcaggaggctgaggcaggagaatcccttgaaccccggaggcgaaggttacagtgagccgagtatatgccactgccctccagcctgggcgacagagcaaaaaaaaaaaaggaaggtgtgttcaggttgc

SEQ ID NO: 623895 - DNA, 539 bp, Homo sapiens
  misc_feature (223)..(223): n is a, c, g, or t
catgggtgaaaatagctgtgtactagtaattaatagaaaatcattcaatcaagagaagagtcaagggaatatcgttggttgtattggctagtgagtttcgttggtaacgtagattttatataagtgataatattgggttagtatgtcctatgttaataaaaatgaacgaaatgaatatggcgtatggtcaggtgtctggatcacctaagaaggctccagtgtngtggcttacatttagcactaaattttaacgacagggtcagtgagtccaggtttgaacttcttcatgcctggatgggataaagtgtaattcattggttaaatgaattcatatttgtatgtatataatcacggtgacaagattaaccctagggtactgtaccaggaaggggtcagattatcatctgagtgacagttagaggggctaagttaggtatgagatcaaggggaatgtccagtaaacagagaggtaagcatgatggaaataatgaagtggggtacagaggaaaagactgactagtgaggaggagcagctgaga

SEQ ID NO: 623896 - DNA, 320 bp, Homo sapiens
  misc_feature (241)..(241): n is a, c, g, or t
tctagaggatccgtgatgtatcgccacactgtgatgtacttaatgcgccaggtgcgtggtcacacctgtatccagcactttgggatgcgaggtggcggatcactgaggtcaggagttcgagaccaagctggcaacacagagaaatcccgtctctactaaaaatacaaaattagccaggcgtggtggcacatgcctgtaatccctgctactcggaaggctgaggcaggagaatcacttgaanccgggaggcagaggttgtggtgagttgagaccacgccattgcactccagcctgggcaacaagacagaaactctgtctct

SEQ ID NO: 623897 - DNA, 559 bp, Homo sapiens
gaacaatatgtcaggacccacggagcgccgaacaaagtgctgaggtagcaaagctcgcgccgtcagagcggaatgtaaccacgagtccttggacagtagactgagtggctgtgagatacatcctttccctgctgggctgatgtcagatgtgggtctcgatgctatatgcatgaagtgtgtgctgggctcgctgtgcatactgtctccttgcatcacgttgccaatctctcgtgagctcggaggacagagcaaatgatgagtagcttcatgctgtccatctctgccgtgtgatgtcctatctgcagaatcctcagccatgagcccccatgtgataccagctagaagggtcacattttgacctgtctatccactaggccggtttggtgtaaacctgtgccttcagtgcatcctgattccctgatgaggcgctcggtgcccccgtgatgaggaactggcttcctagggacacctaggttaccctctgctccttcctgctgtgtgggggagatgtgccagttctaggtacattgttctcgtgaacgtggtataagtttcatcc

SEQ ID NO: 623898 - DNA, 899 bp, Homo sapiens
ggcgagtctgggcttcggggacggcggggaggggagccggacgggaggatgagctcccctgtgcacctgagatgcgcgggaaagatgcactgcagtacctgatgtgtgaccatccctgctgatgctgcctgtggatgaatgagctgcaggcgggcagcgagaagggctgacccacatgatgcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaagcaccgctggaagtacgtgaacggggaatgggtgccggggggcaagccggagccgcaggcgcccagcatgcgtctacatccagcccgactcgcccaacttcggggcccactggatgaaggctcccgtctccttcagcaaagtcaagcatcacaacaagctcaacggagggggccagatcatgctgaaactccttgcataagtatgagcctcgaatccacatagtgagagttggggatccacagcgcatgatcaccaggcactggattccctgagaccagttcatagcggtgactggttatcagaacgaggagatcacagctcttaacattaagtacaatccatttgcaaaagcttaccttgatgcaagggaagaagtgatacaagagatgatggaggaaccggagcagccaggaactgggactcccaaggggagtggatcaccggaacaagacccgtgaccactgcaatcccagacaaagaggagtcccatcagccgcaagcaagtggacgcgacaacccaggagcaaggcgcacaact

SEQ ID NO: 623899 - DNA, 901 bp, Homo sapiens
  misc_feature (3)..(4): n is a, c, g, or t
tgnntcaaagcaataaaacaaataaaaaagatataaatgatctaagtgtccctgccccgctgttctaaagtggattatttatccatatgtccccacactcgcacaccttcttcttgggtcccttacctctttcgcctttaattccccgccaaaacacacctgggttcaaacccacattgtgtctgccgccacaaggggccccgaattctccaatcctgcatgttaccgttcacgggcactttacaagcgaaggcaaggcccttcttaatcacccttagggcccccagacagcacaaaatgacgtgtttttcaaatccaaaacgctctttatatgggccccccccccaagccttttaaatcggccaagaaaaatggcatgccacttccctcgttccattcaaaatgtttattacaccatgtttcgccaccaataccctctatagtgttcaccacattgacttatcagtttccccaacgttacaacaaaatgtaacaattattcgccccccccttccactctttattataaaaaaggaggagaaataataaacttttcgcgcccgccccacgaatacatttctcatcgcgacaggtagaccaaatatgagttgttggtcaagccattagatttgtggaaacccaactgtagtgatggttgttaacttttataagaacacacctctctgcaaaggtccttaaggaaaaataagacacaccaagtaatgtacacacgtgaattgtcgatttctttgccacagctcataatctcctccaccccctctccccccgaggacttttacacaccacgggtgtaactctccccagaacgttccaccaccactgttgaaaatgcccccttcccccaaatagaaaaaaaacattataaacagcccacataaca

SEQ ID NO: 623900 - DNA, 150 bp, Homo sapiens
ccatatttgttaactttacttacttccggaaaaaaggagcccatttggatacatagggtattggtctgagctatgatattcatttggcttcctggggttattcgtgttgaggcacaccactttttgcagtgggattggcggtggacaaca

SEQ ID NO: 623901 - DNA, 233 bp, Homo sapiens
ggggggccccccccccctttttttttctcccccttaaaagccccgggggggttcccccccccgggttttttgtttggggggggggggggtttccttttttccccgggggccccttttccccttttgccttttttgggggcccctttaacccggtttttttcaaaaacggggggggggcgggggcggtttttcccgggtttttttggcccccggggccccccccggggtcctga

SEQ ID NO: 623902 - DNA, 339 bp, Homo sapiens
aagctcggtaccggtctgggtcgacgggctgcctgggacggccaggcctggcatacccccatactctacactctagtaccgcactgcaagacccgtgggtggctagagggtgcttgcaggggattgcgactggtttggggcatagagatgaagttatggagccagctcccaggaaggagaagccgtggaacattgccagagagaatactgaggatcagaggcatctaccaactccacagtcagggcttgaagagtaaggggctggtggtccttgaagccacagtcttggggcgagtcccatggagctaggaaggggaagaaggaatccagggtgcaggc

SEQ ID NO: 623903 - DNA, 288 bp, Homo sapiens
tattttgtgaaaatatctctatagctctatttcaaaagaggtgagaagagtgagtggggattgattatatttttacaaatttctttattatgtggcttaatagaagatggctgattctccctaatctcaagtaatgagggcacaaacactgcggaaggccgcagggtcctctgcctaggaaaccagagacctttgttcacttgtttatctgctgaccttccctccactattgtcccatgaccctgccaaatccccctctgtgagaaacacccaagaattatcaataaa

SEQ ID NO: 623904 - DNA, 794 bp, Homo sapiens
aggaagggaagccggaaggggcgcgagtgataggcaaagcgaggacagagcaggtcccagagggcgaggggtgcgtgtgcgatgcggtttctcaccgtcaaggttctcgccttcgtgcgcgccgtctggccgctcctctcggcggtctgggttgatcgagcatgggtcgcgggttgccgtcgcgtggctggcatggggatgcgagggatcgacgcagcccgttgttcgcgcgtatggggcttgcacaggcactggggcactcgtggattgatgaacctgaatgagtgcggggctagcgaatctttgaagccactgtcagtgcgatgtgtggcaatgatggagagtagtgaatggggagatctgggtgggaagtgaagcgaagattgtcatggaactgtactgatggagtctggcgatggaattgcgagagcctagcgacgagtatgctggagtcacggctagattaggggtggggatcgggggtctggctataggataagaagagcaagcgatgcgaaattgccgagatacgtggctccgaagaatggcaatatcactaggctgaaaagcgtcgacaaaaaggtacagaccggactgaaggcccgtaactggtaagagcgatgaggaccatgtcatcccgaccggggtgtgcccttcaatacggagaacacaatcacatggagccacctcaacgagaagtacaaaacgagagtagagtgcaataccaccaataggctcaagagcaaagaagtaacgacaggggcacgacaccgcacacacgcgccagagaaaaa

SEQ ID NO: 623905 - DNA, 198 bp, Homo sapiens
  misc_feature (70)..(71): n is a, c, g, or t
  misc_feature (165)..(165): n is a, c, g, or t
  misc_feature (173)..(173): n is a, c, g, or t
gcgcactccgcttgtgggatgtcaatcaacccttgggaaccgtttagtggacccttggcatcacatgtgnntctgcataggtgttgggatccatgaattagattggtccgtttccttctaaaagtcccaactccgaagcttctatccaaactcttccacaactgngcttgtanacactcgcaaagtccaaagcccact

SEQ ID NO: 623906 - DNA, 133 bp, Homo sapiens
  misc_feature (65)..(65): n is a, c, g, or t
  misc_feature (67)..(67): n is a, c, g, or t
tcacctatggtaatcctttggcaacttgctaagataactgaaagcagctctacaaggaggactgncntgcgtttaaagaacaatgagagatatttttttgtcgaaaatttgtcaacattacctgcccaacgtg

SEQ ID NO: 623907 - DNA, 117 bp, Homo sapiens
tacgtcagacgtttgtatttgtctctctgtgcctgacttattccacttaacatattctctagcttcatgtatgatgttgcaaatgacagaattttctgtatatagaaaactataaaa

SEQ ID NO: 623908 - DNA, 444 bp, Homo sapiens
cttctcctcctccctccttcccatccctactcattagctctttgctcctggggtgcttcccgagcagcgcaggcctctcccctccatgggtgatggcctccgctttcccactgctcaggtatgtgttcccatactgcagccccatcccttggcgcccctgaagccccctgggggaatcccgtagggtcttgttcccctttccggagtgggggctctcacagtgtattttcccgcatttaaaatattttttttttgtcagcctgttggggggggcgctggttttgaagcacctttgttccccgattgtttcttatggaaggaggaagggtttctcgcccctctaatttccagccccaccaatgtgtaatgtaatcaaatgaaaataaagggagttataacaagcaaacacagtcacagcctttaataaaaatgtccatcataaaa

SEQ ID NO: 623909 - DNA, 260 bp, Homo sapiens
cacggacggccctctgcctgtctgagtgcagataactgttgacttgatggaacgcaacaggcgctcagtggaacaggtatcgatgaacagaaaagtgcgggcatcccagctctacccgggagggcaggggcgactggaggccaggggatggaccaagcaccctgaggagagggctctgctgccagagcggggcctgcgagctgtgggactgagagctggcggcagcacttcagtgcttgtcgctcttcctgctggaggag

SEQ ID NO: 623910 - DNA, 801 bp, Homo sapiens
gtctaaagctttctgaatgcggtttttggaggaatcgcgctagtttataccttttccaactcttctaactctggacctcttcttaccgagcttgttaggtgaaatcaggctgactgtctcttgtgcccctcgcctgtcctgtccaggaatcccagttagtatactgcatgataaacacaggaactcaaatggatttagaggttaaaggagttgctgccacttctaggagccaaattcagccattctttggaagaaagaagcctctacaacaaaggtggacttctgagtcatggacaaaccagaattcttgcccaccagtggtcccacgacttgatttgggaagccttgttgactctgatgatgaggatcagaacataatacctgaaaattttccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaacaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctaggggctgtcatcagtgatccagagcaaaatttagccattgagcaaaaagaacgtgatcatatctttcc

SEQ ID NO: 623911 - DNA, 332 bp, Homo sapiens
agttaagttaaaaactcttataaacacttaagaggctgggtgtggtggctcatgcctgtaatcccagcactttgagaggctgaggtgtgtggatcacttgaggtaaaacttcatctttactaaaaatacaaagattagccgggcatggtggtgtgtgcctgtaatcccagctactcaggaagctgaggcagaagaattgcttgaaccagggagacggaggttgcagtgagccgagattgcaccactgcacgccagcttgggtgacagagtgagactctgtctcaaagaaaaaaaaaatgttcatagcagctttatagcaaaaactggaaaca

SEQ ID NO: 623912 - DNA, 1142 bp, Homo sapiens
gggcagtaacaggcggcagctacagcggggacgcgatcggggcgttgacggtgtgggaggtggtctcactcttgggaaaactgctgggctaccgtcgtcgcgctgcaatgtggttctgtacctgctccgcagtgtgcttatcgtatggccctggaaagtccggcggacgccagctcactcggtagctaagtctcacaagtactctcgcaagaaatggaagtcatcaagcacagtataaatgtattctgaagtgatgcgtgtgctacaagacgctgctcctcgactagtgcatagaagtgttacaccgcattgactaatggcatatctaccaacagactctaactatggctttccgaatgcgaagcgaagtcatgtgctccacacatgcatgcatatgcgctagaacttctatttgatcagttgcatgaaggagctaagagctcttgatgtaggatctggcaagtggaatccttactgcatgtttagcacgtatggttggctgtactgtgaaaagtcatccgcgaattgatcaccattaaagagctagtaatgtcaggcacaggacgatccaacacttctgtcttcagggagagtacagcttgtagtagggcgctggaagaatgggctatgctcgaacaggccccttatgatgccattcatgtgggaactgcagcccctgtagtaccccaaggcgctactagactcagttaaagcccggaggacagattgcatattgcctgctggtcctgctaggcggaaaaccaaatgttggcagcagctatgacgagttactaagatggcatgcttcaaactgcaagccctctgatggtgggtgactatacgttgcctttaacaggatcacggaaaagacgtgggtacccagggtgggaaacgttgaattcatactctttcctggatcattatcttctttccacaccacttggcaagcgggattgacacttgttaacaacggcacatatcacgttggcacccagcatattagccgttcaacactggcatttggcattcactctcaccgacctccacagctgttttgttggacaaagccgaaagcccaacccaacaggtcttggtttcgagacactgtggtcaaccacctgatgattactcagcacatagaa

SEQ ID NO: 623913 - DNA, 179 bp, Homo sapiens
  misc_feature (6)..(6): n is a, c, g, or t
  misc_feature (15)..(15): n is a, c, g, or t
ctggancggtatggnctggcagagctgggtcagaagtcccaaaggcagtgacagttctagaagagcccagcgccacctctctcccaggccagacacccctcctgctcccccatccccctatggctcccaccccttgcaccctcattgctgttcagattaaacctctgttttgcacctgt

SEQ ID NO: 623914 - DNA, 181 bp, Homo sapiens
  misc_feature (6)..(6): n is a, c, g, or t
gggtanagctactcgggaggctgaggtgagaggactgcttgagcctaggaagtatacctgcagtgagcccctgtgattgcaccaccacactgataacagagcaagacagtctcaaaaatgaaatgaaattactttatagacagccatttaggtatagccatttaggtacagccatttaggt

SEQ ID NO: 623915 - DNA, 1246 bp, Homo sapiens
gagcgggggtgctgaaggaggcgggctttggccttttgccctagggagcgcagtgcggagcgagtgggagcgagacggccctgcagtggacagtgtctggactacccctgtagaggaccttactgtacgccccgccgtccatgagctcgttctactacagcgaacagacgccgatcgattaaggctggcgtctgtagcctacgtgcattaaccctcgtggacaggatccacgcctcgccagtggacgggggcagcccgatcgacggacgcctcccatagagtcagacggtcggcgctcagcgcatgctgacccagggaacgcgggacgccgatcgcgagctgacgacggacggacgcatccaagatggccggccgggggccgggcgaggcacagcgagcacggcgcggcagccaagcactccaagacacgacgtccagccacggccgggcaatcggaggtgcaccgcagcaacacatgggcgcacgacgcccctcggataacagcgaccagtaggtccaaattactggcgtggggacacacaaatactggaactcgtgttccctatgccggcatcaacggtgcaacgtatagtaggtgggtatatcaattgtggccttaccaataaatttgaacgttgttgtgatttgcaccgaggcacagccttggccagagcacaaccaagaaattatctcgactcccaaaaagtggtctaggcgccattggaactttgccagttcatggtcgtaccacaggtcggcacaactaggcctgcagtctcttgggcgcaccagacctatggcacttccttcgtgtcgacaacagcggctcgtcaacgttgtgggggcaccacggtcacatttcacatgtcatccaactcttgggcggccaggacacggcgcgcttcacgcgtcaagcccacaagcttgtccatcagtggccggtttgcgtgtctcagcccgacgctagggcgctcacgtctttggtgagcttgtaccccggttgatctttcagctatctgggcaatgtctctaacactaagggtctgtgtcaacaaatgcatggcatatcgcttaagcccccacacacggtgcgttacaagtaacagaggaaagcccgacagtattggtttaccacgtcaactataaagccccgccggtatacagttggtgagccgccacgtttaaacaccacaacgtcttgtaacgatttctatcaactaggtaatatttacgaccgctgtgacac

SEQ ID NO: 623916 - DNA, 388 bp, Homo sapiens
cggattaaagtctctataatcatttaatatattaagcaatgagaaatgattatatatcgtgaaacctttcccataaaggaaccaaaggtttaattctatattattgtctaatatttctttaaaaaatttagtgtaaaaactgctggtttattatcactggtagtaaagtgaaaactcctccaccaggagtataagcagcagtattcactgcttataaccacatactttacaatgtaccttccaacagtaaggaaataactgatttcttgatcactgtaagaaatgagtgccataatactattatggttataaggtcctccctcaaatactttctggaaggatgttcattgtgtattgttcttagagatattaacagtagtacatagtc

SEQ ID NO: 623917 - DNA, 156 bp, Homo sapiens
acctatgtcctccgagtgagcggaccagatgggagtgcagctgcatccggaaggcccgaagaaaatgattactgcttgatttgtaaaatcaagtttttcccaatggcgtgtcctttaatcttgagatctacaaatatatgtccatttaaattgata

SEQ ID NO: 623918 - DNA, 617 bp, Homo sapiens
  misc_feature (56)..(56): n is a, c, g, or t
gtaaaaaaatcggaagagacgatccgtattgaaggtgaatggttgataataaaacnaacgttgagtagtcaacctgggggtcgattggagttaatttgattggttttaataagttaggtgtttggaactttatatggaagaggaagtagagctgcagcccttagttaatcctcccagaaattaggctacataggaagctgggttattaacaacctaaaatttattattgataggtgcaaaaaatgttcaatgagggttagatttcaatgaagagctcatctaagggtttaggatggacattgaataaggataaatattgatgttgggcatcagttatcacagttatggtatgttaacactctacggatcaactgtaagcaatatttaggtatagatgggtgcgatattttagctgttttaagaaagaggtagtggtcgagtgtatcgtagaaatgagtctccatgaggaattactgcaaggtaatttttaggcagaaggtatcgggagttagtgctcgctatataatgtttgatatagaattatgatcgtttcgatctggaattacgtatatcgatccacgtcttttttatagggcttatgcgttattgaagaagag

SEQ ID NO: 623919 - DNA, 490 bp, Homo sapiens
  misc_feature (50)..(50): n is a, c, g, or t
  misc_feature (62)..(62): n is a, c, g, or t
  misc_feature (73)..(73): n is a, c, g, or t
  misc_feature (84)..(84): n is a, c, g, or t
  misc_feature (96)..(97): n is a, c, g, or t
  misc_feature (107)..(107): n is a, c, g, or t
  misc_feature (109)..(109): n is a, c, g, or t
  misc_feature (116)..(116): n is a, c, g, or t
  misc_feature (119)..(119): n is a, c, g, or t
  misc_feature (121)..(121): n is a, c, g, or t
  misc_feature (127)..(127): n is a, c, g, or t
  misc_feature (129)..(129): n is a, c, g, or t
  misc_feature (132)..(132): n is a, c, g, or t
  misc_feature (144)..(144): n is a, c, g, or t
  misc_feature (148)..(150): n is a, c, g, or t
  misc_feature (154)..(154): n is a, c, g, or t
  misc_feature (158)..(158): n is a, c, g, or t
  misc_feature (161)..(162): n is a, c, g, or t
  misc_feature (165)..(165): n is a, c, g, or t
  misc_feature (167)..(167): n is a, c, g, or t
  misc_feature (175)..(175): n is a, c, g, or t
  misc_feature (201)..(202): n is a, c, g, or t
  misc_feature (209)..(209): n is a, c, g, or t
  misc_feature (215)..(215): n is a, c, g, or t
  misc_feature (230)..(230): n is a, c, g, or t
  misc_feature (235)..(235): n is a, c, g, or t
  misc_feature (238)..(238): n is a, c, g, or t
  misc_feature (241)..(241): n is a, c, g, or t
  misc_feature (245)..(245): n is a, c, g, or t
  misc_feature (247)..(248): n is a, c, g, or t
  misc_feature (250)..(250): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (272)..(272): n is a, c, g, or t
  misc_feature (274)..(275): n is a, c, g, or t
  misc_feature (279)..(280): n is a, c, g, or t
  misc_feature (289)..(290): n is a, c, g, or t
  misc_feature (300)..(300): n is a, c, g, or t
  misc_feature (332)..(332): n is a, c, g, or t
  misc_feature (335)..(335): n is a, c, g, or t
  misc_feature (347)..(347): n is a, c, g, or t
  misc_feature (386)..(386): n is a, c, g, or t
  misc_feature (389)..(389): n is a, c, g, or t
  misc_feature (423)..(423): n is a, c, g, or t
  misc_feature (440)..(440): n is a, c, g, or t
  misc_feature (442)..(442): n is a, c, g, or t
  misc_feature (449)..(449): n is a, c, g, or t
  misc_feature (453)..(453): n is a, c, g, or t
  misc_feature (457)..(457): n is a, c, g, or t
  misc_feature (462)..(462): n is a, c, g, or t
  misc_feature (465)..(465): n is a, c, g, or t
  misc_feature (474)..(477): n is a, c, g, or t
aagaagcatcgttaaagtctctcttcaccctgccgtcatctctaactcanactctcctaaanacccccaacanctcaccaaccncttcattggacnnttcacctttnanacaactnatnanaccctnanganccattttcaccnatgnnnaacnctcncgnnctntntggtaatnacagatccaaacaccaacccctccannggctttnggtttntcacatatcccactntcgangangtngatncnncnatcaatncnangccacacaacntnnatgnnagacttgtnnaaccaaaganacctctctccacacaacattctcaaacaccangtncccacttaactntcaaaaacatatttgttcgtcccattaaacaacacactnaanaacatcacctaacacattattttcaacagtatcnaaaaattcaactcattnanatcatcnctcncccncgcantcncaacaaaannnnctttgcctttgta

SEQ ID NO: 623920 - DNA, 390 bp, Homo sapiens
  misc_feature (221)..(221): n is a, c, g, or t
  misc_feature (223)..(223): n is a, c, g, or t
  misc_feature (334)..(334): n is a, c, g, or t
  misc_feature (387)..(387): n is a, c, g, or t
tatgaactccatggcccccatgagcccaatgaatgaactgccttccaggtcctacccactccggggcagccacagccttgatgacctcttggaccggccaaggcaatcccacagcgtcttcggaatactgggatagtcagtcccgctcgcgaccccgagccgtgtccccagccgtgcccccagccccgcacccccgcccttacccaggcagcatggcgcanangtggtgggcatgcattggggggcagccaccgacgtcaagaaacttatgtcctgggaacagaaccccccagagctctttccacggggtacaaatccctttgccaccgtgaangcttcgtcccacagtcaccaacgaccggtcagcacccctcatccgctgagggnaaa

SEQ ID NO: 623921 - DNA, 897 bp, Homo sapiens
ggatggcggcgctgggggtgctggagtgcgacctgccagtgtgccgttactacttctgaaaaatctccaggcatacaagtgatggctggtaattgctcctaaactgacatcactgacacgcagagttccagctggtgcctatcctacagaaaactggtctcgagctgtctatggcagaggtgtacacagaccagactgctgcctcatgctacctgttatggaatttcagacgccagcatcaattctggcatcacatagcctcaggtaggtatcatctgtcaagggacagtgagtgcaagtatcgaggactgggtagagattcggaacgagttttggacacacagcttcgtcccttgagagtcacagcagctgaagtatcacagattgactacatgccttgaacctccaatagggaaaccttggccattctgtacaagagcgaacggccgttaaggtagtagaagtgacctcaacttctgtcctgaaaggcgctcattcccagataagtatgcatgaggctcagttggacgcttctgatggatcgcaggagtgcaagatgaatgcgcagtagagaatgatgcacgctcgtgtagtgtctgtcagggtgtcctgagagatttcttgtcgacaaggggaagtgggccgtagaggaaaactagtggttctgtgcgtttgcctctggctttgcagtcaacggtaatgaccttacatcaccgaaagctgatggccaaggaaacgaccagcgtggaaaaattgatcccaattgagcaccagggcctcgcaggccatttctgctcctctgtgtagactccctgacgccgtccctccgtactgcacccgagaaaactccgggatgctctgaatgccgcctttaatcgtgaacgaagtaggacgtct

SEQ ID NO: 623922 - DNA, 334 bp, Homo sapiens
taggagtttgccgggcacggtggctcatgcctgtaatcccagctacttgggaggctgaggcaggcgaattgcttgaaccccgagaggcacaggttgcagtgaggagagattgcaccactgtgagacaaggagagactccatctcaaaaaaaaaaaagcaatatgggcccagatccttcattttctagataatataataaaagtggagatgattggctcatagatagagttattatttaccaatataattaaggtgagctataatggtggtactctcgagggttctaggtacagtaatcggcagattagattatatcggtaaagcaatacggaca

SEQ ID NO: 623923 - DNA, 851 bp, Homo sapiens
  misc_feature (173)..(174): n is a, c, g, or t
  misc_feature (349)..(349): n is a, c, g, or t
  misc_feature (388)..(388): n is a, c, g, or t
  misc_feature (424)..(424): n is a, c, g, or t
  misc_feature (428)..(428): n is a, c, g, or t
cacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggcctggggagcgctgagtgnngctgaggcacagacctggctcagctgagcgctggggtggcgagccccgagtcccgagagcctggtgggctgcgcccagccctgggctgccgaccctcctcccgctcccgcgccctcccctcggctgggcacggtatttttatcctgtgctgcgaacagccctcctcctcctctcngccgcacagccctgccgccttgccggggtgagcccagcnacagaccgccgccgggaccccgagtcgcgcaccccnaggncccaacacgggccaaacacgcaggggagccaatggaacccccgagagggaccccgcaaaggagaggatccagagaatcctcggggatggcgaccggcagcgcacaccatagagccgagacctacggagaagcccagaagcaggggagggcagaactggaatgcaccgagtccgacacaaatgccaaagaaactcagaaacaggcacatgggaacacgattgcggacagggatgaccaaggggcgggctcataacgataaaacaccagcgtccccatatcaacacccagaaaaagacgtacactgcacaacggacatcactaccaagaccgtaaagtaagagcaaagtaacggacacgataacagaggtaacaaaggagagaccaaaccaacaaatcaattccatctcgactacgaaaacctga

SEQ ID NO: 623924 - DNA, 152 bp, Homo sapiens
agccaagtcagccttctgttggttaatatggtataatgcatggctttgtgcacagcccagtgtgggattacagcttttggatgaccgcttacaaaggtcttttttggtaggatttggctaggttttctatagtatggcactaaatgcgctat

SEQ ID NO: 623925 - DNA, 188 bp, Homo sapiens
cacagttttgttgactaaactctacagaagtcaggtattgggaaggagaatcgtttcttctttagaggagtaggttttaaccatgttaaatttccaagaataaatttatttatcacctctacacagcgcagaccatttcaggaaaataaataattttcgattcaagtactatacaaacttaacgatgg

SEQ ID NO: 623926 - DNA, 632 bp, Homo sapiens
  misc_feature (632)..(632): n is a, c, g, or t
gtcctagcctcctccgctgtatccctgcagttattgcaagtcgggcagaatgactcattctgagtttcagaaagctgcagaggaggttaggcaccttaggaccaagccatcgaatgaggagatgctggttatctatggccactgcagacaagcaactgtgggcgacataaatacagaacggaccggcatgttgtacttcacgggcacggcctggtgtgatgcctggaatgagctgaacgggacttccaaggaagatgccatgaaagcttacatcagcacagtataagagctaaagacaaaatacaggatatgagagactggatttggctactgagccatgtgtttatcctaaactgagacaatgccttgatattttctaataccgtggatggtggaaattcgcgaaaatagccagttaaaccagctgctcaaggctgctcaccatacggctctaacagattagtggctataacgattactgactttccttgagctagtgttatctggaatcaattgtgcattcgatactttaaataaggatggtttgtacatctcacttgccggcgtttaacacgtcgagacttgtccttgtcgtacccaacttccgcttgagcactcccccttttgccggn

SEQ ID NO: 623927 - DNA, 846 bp, Homo sapiens
cgccgtgctatctcctcgctagctctccctctcacatcacgctcatcacccggctcgagatggcggcggcggcgtctgtgtgcggtgggactcggactcctgcggtgatcgcctgatcgtctttctccttgtggtaacgacccagtgtcgtgcaaggtggggtggcggcggtacttgcctggcggggaccgcttgtggaaggccgaggacgagggacgtaggactgtcataggcatcacgtggtgatgacgagtgcattatgagacaatagaatatgaaccaagtaatgtaaacacctacgaggtcaaaaatttcagaaaagaaaaaaattatgcatgagagatataacaacgatgaccggacacgggctacactatcataggaacatagtgcaatgaggatgagaatttaatacagagacgatgggttatgaaagaattcctgatagatacctaagaggtgctaacgacccatgaacgaatcgaattaacgctcgaataaacgttgcgggctaatgtgaatttacaggggacacgatgctcaagaactcctctgtagaatttatgccacaatgtgaaaacctatctggtagtgtgagactacagtgctgattgttataggaacataaagatgcgtatgaaaccgcattcttcaggagattgaacttgtaccacgacgttgtggcgaagatgtttactcataaaggatacacacattgacacacaatatgtagaaacgtccacgtatattaatgcccagttgtcctggaaagtctgtacgttcgcagatgtgtagtatttcattggggcaattgatgacttgaaaaggagattaccaatcccctga

SEQ ID NO: 623928 - DNA, 207 bp, Homo sapiens
ggtgccaaggacagcgtgctataaaattagacttctagatgctgggtccagttcaattctcacaggtcatcgatccttcatccggtagagcagttgtctgagcaacctctaagtcgtgctcatactgtgctgccaaagttgggtccatgacaacttctggtggggcgagagcagaccattggcaatcaaaatcccaatgtcagggtc

SEQ ID NO: 623929 - DNA, 237 bp, Homo sapiens
tctgcggggctggaggtcaacatatataaatgcttcatcaatcacatgtgacaagggaattcccttttaatagggggcagggaggatcgacaatgataaaattctggaaatacgttcattcaaagaaatcatctgtcttcagtactacagggactggataaacaagacacccagataatgaatcacatgatagaggcaagctgcttcatgaattcttgtctgaatcaagagctaaat

SEQ ID NO: 623930 - DNA, 315 bp, Homo sapiens
  misc_feature (5)..(5): n is a, c, g, or t
ggggncaaagcaaaacgtttaataattttttttggaacccccggggaacagaattcaaatgggaaaagggggagggggggtttaaacaaagggatccccaaggcccttcccagttgggcctgaacaatgggggggggcaaacctttttttccacagcatggggggttaaatcagggaaggcctggaaatttattccccaccctaaaataccccaacccattaaaagcccagatttaggcttttacaaacatttactaaataagcaaaacccttccaaatttgttcccgtcggcaatttttcccataccatggact

SEQ ID NO: 623931 - DNA, 116 bp, Homo sapiens
ctgcaggtcgaactctagcagcgatcccccatcacgccgatgggtacggggttgccctgccggaggctgccgcaacttcccagtatactttctggagccaaccctctagataccgt

SEQ ID NO: 623932 - DNA, 290 bp, Homo sapiens
agtaggtagttatatctcaccccaaatcacatactcccgctccttcccagtgtagccacaaccagagcagagccttgattccagcttggggaccaggcagggcttgagctctgtgcaagaggtgagtccaggcaggagagggcaggaacaggccaggtgcttgcacctgtgggacaagtgtgactccttctctccaggggaggaagaggggtggagaaaggagggagtgttagtctcctggaagtacctccccgtggagacagcagaaaggcacgtgtatgtatgtagga

SEQ ID NO: 623933 - DNA, 902 bp, Homo sapiens
ggtcccttcccctactcatcggcactaattgtacagtcagcaacaaccctgaggctcacttaaacattctactactcacgtctcactgcccagagaatctatgcgaaactgcctgagccgaacaacgttaagtgatggactagcgttacgacaagtagcttgatatagtgaagagagtagcctctattacggactccacttatgactccctaatagtcccatgtcgaaggcccccatcgctgggtcaatagtagcttgccgcagtagctctgtgaagactaggcgggtatggtataatactgcctcgacactcatgctcaatcccctggcaaaagacgtaggctagcccttccttgtactatccctatgaggcataatgtataacaagctccagtcggcctacgacaaacagacctaaaatcgctcattgcatactcttcaatcagccacatagccctcgtagtaacagccattctcattccaaaacccctgaagcttcaccggcgcagtcattgctcattaatcgcccacgggacttacagtcctcattactattgctggctagacaaatcaaaactaagaacgcactcacaggtcgcatcataatctctctcaaggattccaagtctatccccactaatagggttgtgaggactctaggaagctccgtaaacagggcgtagcccccccattataaacacgggggggaaactccggccgcggcaccggtgtcccgcggcaaaaaaaccccccaaggaagagaatgagcaccgatgactccatgtacaacagggtcgggcgcccagataacttccagaaaaaaagagcccgccgtgagggtcggtgaggatcagcagaggagcgaacaggaaaccaaccacacgagacaggagaaaagaggc

SEQ ID NO: 623934 - DNA, 358 bp, Homo sapiens
  misc_feature (81)..(81): n is a, c, g, or t
  misc_feature (89)..(89): n is a, c, g, or t
  misc_feature (103)..(104): n is a, c, g, or t
gcggccgcctactactactaaattcgcggccgcgtcgacataatagtatttttcttataaaaattaaagtaggctgggcanccgtggantcacgcctgtaatnncccaccactttgagaagccaaggcaggtggatccactgaggtcaggagtttgagaccagcctggccaacctggcgaaaccctgtctctactaaaaatacaaaaattagccgggcttggtggcacatgcctgtaatcccaaccactcgggaggctgaggcaggagaattgcttgaacatgggaggtggaggttgcagtgagccgagattgtgccagtgcattccagcctgggtgacagagcaaaactctgtctct

SEQ ID NO: 623935 - DNA, 186 bp, Homo sapiens
agtagacagccctgacgcaagtgacaccgcacggcactgtcgatctgtgcctcgctgaggaaataactaacatggcaaaggagatcctaagagccgagtgaaaattcatcatatgcattattgtgcaactagtcggggcctaaaagagcaccgattctcgtcaacttctcaagcttctagagtctc

SEQ ID NO: 623936 - DNA, 1335 bp, Homo sapiens
gccatgatggagctagtgagagtgagaacggtggccgcgtgtggtgctggcctgactccggggcccgatggaggaggagtgagtgccgcctcggaagacctgagaacggggcgacgatcagggttttccagtgaagggtgaagatgagctcggggacgaatgaggaagtgcgctgggcgacgatgaacgggcacgggtggagcacgcatgcctcaaccgccgagctgactgcaagcagcaacatgccccaacaagcatgctgcggggccgccaaggagggccgcggggaacgagcaggcggccccacctcgctagttcgcaggtgacggttaggcagccagacccagagggcagaatggcaagggcccatggcagcagtgcgagcgaaggttaagaaacaagcgcgcgaatggctgagcggaagagcgagaggggtacagccacacttgtggcttcccatgtcggtcgggggtgacttggcaaagacaggaaacaagaaaaaggccgggagatcaaacacaggaaggggggttggttaaagaaagaagccaacgaaggaagggattcaagtgggtggacggatgtgagtaattaagtggaagataacgattggaatgagaaagcaaggtagtaggcggaggaagtagcaaaagatcataggataagggagatagcagtgggtagaagagaacagcaaggatagaagagaatatagggaatagaaagggaagaagggtagaaggtatagaaaaagataatataaaattagaatgaaagcataagaattagatgaaaaatatataagaggaagaacgaagagaataaaaaaagaaaaagagtaacgatatacaaaaatagaaaagaggaataaggaaataaaagtaaaaaggaaattagaaaaggaaaaaagaaaatggaaaaaaaaaagtaaaaaaaggaaaagaggtaagaaagagaaaaaaagggaaacaagaagaaagaagaaagagaagaacagagacgaaaaagagagaagaagaaagaagagaaaagaaaagcgaaaagaaagaaaaaaaggaaagaagaaaacaaaaagacgaagcaaggcagaaaaaagaacacacgagaagaagaaagggggacaggagagacaggagaaatagaagacgaagagagggaggaaggagagggcgagagagggggaggggagaaagagagagggggaaagagaggcgaggggagaaagaaagaagaagaagaaggacaggacgagagacaaggagagcggaagagagggagagagcggagcacacagagggacgagaggaaggaggaacgagggaggaggagaagaga

SEQ ID NO: 623937 - DNA, 295 bp, Homo sapiens
aattttggggccaaatccggtttttttttttaaattttataaagggaaacccttttccaaacccgggatcccaaagggggttttgggtgaggaaaaaaaatgtgtttttggggtaagggaccccctttagaacccggggggttttactttggggtaaaagggggaaaatcccccccgggctgtttagggccccccatttttgtttgggttgttgggcaaagggggtcccccggtttcattaaaccaaggatggttgtttttatttgaattaaaaaaaaaccgggtttttccctga

SEQ ID NO: 623938 - DNA, 786 bp, Homo sapiens
  misc_feature (10)..(10): n is a, c, g, or t
  misc_feature (90)..(90): n is a, c, g, or t
  misc_feature (99)..(99): n is a, c, g, or t
  misc_feature (116)..(116): n is a, c, g, or t
  misc_feature (121)..(122): n is a, c, g, or t
  misc_feature (135)..(135): n is a, c, g, or t
  misc_feature (145)..(145): n is a, c, g, or t
  misc_feature (154)..(154): n is a, c, g, or t
  misc_feature (181)..(181): n is a, c, g, or t
  misc_feature (214)..(215): n is a, c, g, or t
  misc_feature (228)..(228): n is a, c, g, or t
  misc_feature (289)..(291): n is a, c, g, or t
  misc_feature (351)..(351): n is a, c, g, or t
  misc_feature (367)..(367): n is a, c, g, or t
  misc_feature (379)..(379): n is a, c, g, or t
  misc_feature (473)..(473): n is a, c, g, or t
  misc_feature (489)..(489): n is a, c, g, or t
  misc_feature (557)..(557): n is a, c, g, or t
  misc_feature (579)..(579): n is a, c, g, or t
  misc_feature (583)..(583): n is a, c, g, or t
  misc_feature (597)..(597): n is a, c, g, or t
  misc_feature (607)..(607): n is a, c, g, or t
  misc_feature (620)..(620): n is a, c, g, or t
  misc_feature (636)..(637): n is a, c, g, or t
  misc_feature (639)..(639): n is a, c, g, or t
  misc_feature (643)..(643): n is a, c, g, or t
  misc_feature (646)..(646): n is a, c, g, or t
  misc_feature (659)..(659): n is a, c, g, or t
  misc_feature (661)..(661): n is a, c, g, or t
  misc_feature (673)..(673): n is a, c, g, or t
  misc_feature (676)..(676): n is a, c, g, or t
  misc_feature (691)..(691): n is a, c, g, or t
  misc_feature (694)..(694): n is a, c, g, or t
  misc_feature (769)..(769): n is a, c, g, or t
gctgtaaaanaggacagaggctgttccctatggcagaaggcaaccacagaaaaaagccacttaaggtgttggaatccctgggcaaagatntcctcactngtgttttggataacttngtggnncaaaatgtactgnactggaaggnagaggatanaaaagaaattttacgttgctaaaactnaagacaaagttcgggtctatggcagattctatnnaagataagcaacntatggcaggacaaattcttcttcaatccttttttatcatataccaaatatcccccaataannnagctcatccgaatatgtgaggctggttccacctgtagttcaggatgaatctacagatgcnctcaagctttgtcctnatgaagaattcnctgattatctatgtaaagaaagagctgatgtgatctttccaataaaggagtgaattaatcgcacacgcctggctctcatcattatgcaatacanagtttgaccatctgcntccgtggaatggtgctgactttgtcatcactgggatgatggttctacttttgggtctggattatattnttgatgtagaagagaatctganagcnagggatatggagtnagcgctgagngcatttgctaccngttcagagcacatgtnntntganagnacattcttggttntnatgtctcatggnatncttgagtgaatttgnggntttgtgcattatgagaaaaatcatatgtgctgctttatgtcaccatcttccagatattcaacaaccgcatctgtnttagtctgaagtttaac

SEQ ID NO: 623939 - DNA, 868 bp, Homo sapiens
aaagaactctgttaagcccataatttccgcactcgcggtcaccctggattccaataaacgtttgctgataccggaacaatctgtggtaggcctcactaattgtagaggtctccccatgacccggcaagctggccccgcacaaatgggcaacttgctgcgcaagggcatatgcctgcttcgtggtctagaacacttctagtagcaaaggcttgctcccgcgcgtgtgcagcaaaataaccgccctgtttgcagtagttgacctttcaacctctccccgcaaccgtgttatgcccgccggcacatgtcatcaggtctcattgctgcccctgagaccccgcttgttttagcgaaattgtgcccaccgcagtaaaccattcagcacgacgggtccaacttgtcggagaaaataattatgacccccctcttgcccccacagtccgaaccatcatcaggggggctgtcgtcccaatatgggggcaacctcctgtgcgtgtagtccccgctttttaaaattgagccattctcctgtgtgagacccttccacacacaatgtcctgtgagaaaccatgagcgcattcagacatctacgtcgaatcagggcccctcccccctaaggttctaaagattccgctctcgacgaacgcggtgcattattccccaggatcctctagcacccgatagtttcttcacgatgtccgtccaccagaaaacattgctgtctatgaagtatacttgcgatcttccgacaatcatgtctagaccccccataaaaatgcttgcctatgcgccacccagttgtccccacgaacagcccccccccagcaaaaattttgttcccaaaaaaaaaaataaccattcaaacaaaaca

SEQ ID NO: 623940 - DNA, 518 bp, Homo sapiens
catttacctatttggttaggaaaagctaatgggtgttcacctcccagtcatcaatcttggctggcaatagtgcctgaacgtaacatctccatagcacaattacatatgctttctggtcttagtatttatcaccatgattatgcttctgtaactgaagtttaccaccctcagaaacctatctgtaaagtggactagacatggtcagaaaaaatgaaggcatttgcttgggaagattgtgtcacatggaaagcagaggtgttgcataatgattcatatggagtcattattgattggtccctaaaggggcatttatgaggctcacctctcaatctgtaagtaatggtcaccctgcatctaaacaaaataatcagatggtggacactataagaagtacagcaagagatcctattatttgggcatgtggtggtatagtggtacctcagccccaaacgatatggcctgctgtaggggcaaaacataaggaattatggaaaatattaacagcactaaaaaaaaaa

SEQ ID NO: 623941 - DNA, 1435 bp, Homo sapiens
  misc_feature (529)..(529): n is a, c, g, or t
  misc_feature (848)..(848): n is a, c, g, or t
  misc_feature (1011)..(1011): n is a, c, g, or t
actggttgtgttaatgtccttcgttgcctgcttgggtgccgccgacgtggttgtccctatagtaacgccgggtgctcctccggctcgtggttttttatgccccggtgcgggtgtatcatgttttttcgcccgcgggcacccgttgtgccttctgctcctctttttggggcaccaatagtggacgacggtgtgtcccacgaagaccccagcgtgtggtcccccggcccgcgaaatttcccccgggatttttcggttggacccccacgggctcccccgccgcccttccggaaaagcgcgcgccacaaaaggggcgccacacgaaagaaaagtgcggtgaacccaacgtttcttaaagagaagagaattggtaagaagatggggacacacacccgcctaagggtcccaataataagagaaatattgggaaagaccccttctgttcaccccacggacccccaacggggaccccaacaatgtgccactcatgatgggttcctcacaagggttccctgttgttttttgaaagatnaaggttcttgcgtgaatttgtgccagacatgtgagtgtaagattcgcaccttttatgaaaaatttcccagcctgagttatctgagagaatggttccagggttaaaacctcgccctgagcttaacctttctccatgggccatggagtctttatccccggtgaccacaaaatggtggttcaccattgggtccaaaagaatatgggccagaagccacttgagatgtgagagggctctcaccgcttgagatgttcccaacgaactaatccgcaatggggttatactctgggctctttcgcttctcgtttcctcgtgttttgtngtttttgagactatataaatactcgctctcacccacacttcacgagtacccgcgagagaggcgcctctttatatgcctcacgccacaccacacacacgggtccgcccccacaatccgcggagaagaaaggatttgatatgtgagaatattcacatgagcaccncgccagagagagggtgtcacagacacacacatatgagactttgaagaaaagaaaggtgggtgcacacattaaattgagtttccacgagccacgccacttgtgagaataagagccactatgagaaaaggggcttgtccacacttctattttatttcctctctcccactcgagatgttctttcgcttatgagaaaagtataaaaatggctgagaagagagcccccacgctttgaaattgggagaaggctcactggaggcttcactggtgaaggcacgtagtttctggagaaaagcccctggggaacgagacacacggtgctataaagttgaaacgaggctgatggagatattgaaccacccacgtcccagaatctgttttaagttccagacttccaatagtggccaattaaaagtgctatttgtga

SEQ ID NO: 623942 - DNA, 322 bp, Homo sapiens
gcgcggtcactctagacggatccctgtgaatacacagcgtagatatatttattttcggagctaagatggtgttatttaatgggtggtgatgggtgagcgctctgagccaggctgtgccagcatccctgccaagcatgaacaggaattggcccatctttccaagccctggggaagacatttgcaaatgacttggggaggccacagcttcagtacaggccctcctgagggccaagcggatgcgaactcttcaccaggtaccgtagggcagagggcggaatgcgctgtggccttgttaggggcttatggtgaacttggaggcctg

SEQ ID NO: 623943 - DNA, 111 bp, Homo sapiens
gggcttgcatgtcttgcatgtacggtcgcgcgtggcggagcagcctccatccctgtgagatcactgccctgagccaatccctacagcccttacggaagctgccttttagag

SEQ ID NO: 623944 - DNA, 1081 bp, Homo sapiens
ccgtgtgtggttgctgacttcgcctgtcgttatgttaggtgtgccttcttcttccttggtgttctgtttttcttgtctcatctcagtttatgcctcgttttgaccatctggttttccgccggggtagtggtttcattaattgtgtacctcttaccttcaaaggccttcatgatggttcttcgcgcggctatgggctacagtgtacaaggcgggccctccaatgcgctgagttggtcataagtttaatttttcctctttgggtttccattccatcgcatgttcttcatcacccttggacggtcttggcaagattgagggcttaggctacgaggcgttcccatgtacatgactgtatcaccctgttcacatgagtccggccaagacccttgtcagtcacattttcgctcactcaggtgcgccctctgcccaacagcttccctttcgaggtcaactatgaaatccctacagaaagtgctatggctggttcgctaagcatgttgtccctcctcatgtcgggggaaacagttaccacctcctgcggggaaccgagtccgtggaaagggaacagtcagagctcttctgccctgggtaagggggggccagcaggagatgaccaacagcgggcaggacctggggacactgggctgggaggagaagcggcagaagcttccacaacgctggccgacagccccgggttcccccaacatgttccacgttcactcgtgcccccacccccaaaggctcagccctctagaatctcagacgtccagcacctcggtaatggctcagtccgcctttcacccccagttcacaagtgcccccaggactcatgggtcgctgctgttggcatgaaccctgttctccagaactgtgccccaggctaagggtggcccagagaaggtcacgatgtaccacacaccaaagaagggggtcggcccaggggtgggcgacacaggcagcttcttcggcagcctcacggcagcaaccccagcctatcccaaagcagcaggcgcctccaggctggggcccaacctagaaggaggggtcaatctaacaagacctaacctgattaactccggtg

SEQ ID NO: 623945 - DNA, 118 bp, Homo sapiens
aagcagttactatagactcagttaatttttgggtcacgagacatgcatctggtactgggacgaaatggttggcaccagttttatattcatctgaaccaatgctctttaaattagagat

SEQ ID NO: 623946 - DNA, 208 bp, Homo sapiens
ctgtggaagactgtctgaaggggctcgaaggcagataataacccaaggtcaggtctggtggctcatgcctgtaatctcagcacttaaaggcaggaggagcacttgaggccaggagttcaagaccagcctgggcaacataacgagaccccgtccctataaaaaaatgaaaaaaactagttggatgtggtggtaaatgctgttagtccta

SEQ ID NO: 623947 - DNA, 385 bp, Homo sapiens
  misc_feature (330)..(331): n is a, c, g, or t
  misc_feature (376)..(376): n is a, c, g, or t
gaaaatggtagctcaccaactgaatctggtggcaatattccaaggcgtgagggagcagtaattcataaaactgtgtgaagtgtgttactcaggttcattctttagctcagctagcttgcaaggactcagttcagaatcctagtgagaggctcttcacagaaacctaaacaagctgacatgcagctcccacagctccaggagtcccagctacagcagaaagatgagagagccaagaaccttagcacagacactagtacccttagttgagtactgcatgagtgggtcagccaaatgggaagtcaagcaagtcagtggtagcagcagcactgnnggctgtgcaaacatattaatagaagagaagcttccagaggttganatcaatagt

SEQ ID NO: 623948 - DNA, 267 bp, Homo sapiens
aacgggtgatgcggttggacacacacaggtcagagaggtagtccaggaacctggtctcccggttcttgcgcacaaggctgacgaaggtctccacctaggtcttggagatgtgcttttccaggagcttgcggttgttgcgcagcagggcagcgatggtgtcctcggccaggatgtcagagccaatctgcgactgcatcatcccaaactgcttgtcaatgtgctcgtgcgtcttgcgtgagtcctcctgggaatgccggaacacgcggt

SEQ ID NO: 623949 - DNA, 405 bp, Homo sapiens
ctcggatcttaggttcctcccactctccagcctcatagaatggacttctactgtctactgtctcccttctttgtgtgcatgttgtactcatagtgttgagggtcctatttctatacgtgataacatgctgtatttggtttcctgtccctgcattaataacacttaagattgtgacccccatgctcgttccatgttgctgcaaagaacatgatcttgttcttttttatggatgcacagtattccacgatgtatatgtgccaccttttctttatctggtgtattgatgatgggcatttgggttgattccgtgtctttgctattgtgagtagtgctgcagtgaacatatgagtgcgtgtgtctttatggtagaacaatttattttcctttgggtactacgctttggca

SEQ ID NO: 623950 - DNA, 233 bp, Homo sapiens
tgctactgggcgtatgtgtatagtgtcctatcgtgtgagatctttgtgtaggatgttgtaatatagtctggtgtagtgtgtgtagatgtgtgtagtgtgtctaggtgtagtgtgggtggctgtaacatagtcagtagctatacataggtagtggcatagatagtgtaggcatagtgtaaggtaacatatatgtaggatagatagtaggtaatagtattaagcatagtagtaga

SEQ ID NO: 623951 - DNA, 332 bp, Homo sapiens
  misc_feature (18)..(18): n is a, c, g, or t
  misc_feature (40)..(40): n is a, c, g, or t
  misc_feature (67)..(67): n is a, c, g, or t
  misc_feature (100)..(100): n is a, c, g, or t
  misc_feature (168)..(168): n is a, c, g, or t
  misc_feature (181)..(181): n is a, c, g, or t
  misc_feature (266)..(266): n is a, c, g, or t
ctgacctatatgcttatnctaattccaatagcaaattgtnttcattactgtaactttatagtaagtnttaaagtgaagaaacaagtctcccaactttttncttttgttacaaagttatttggctatcctatgtccttttaataagtgattacatcagtttagtttttncatttatactttngctttcaatcaggttaactgatgtaatttacatatgctaaatttcaaacaacattacaaaagtttatccagcatgttcacaaaangaaatattttaaatggtatcaggcttacaggttatcttcaaacttggttttcatgtatattattaa

SEQ ID NO: 623952 - DNA, 285 bp, Homo sapiens
  misc_feature (76)..(76): n is a, c, g, or t
  misc_feature (94)..(94): n is a, c, g, or t
  misc_feature (106)..(106): n is a, c, g, or t
  misc_feature (144)..(144): n is a, c, g, or t
  misc_feature (192)..(192): n is a, c, g, or t
  misc_feature (197)..(197): n is a, c, g, or t
  misc_feature (206)..(206): n is a, c, g, or t
  misc_feature (223)..(223): n is a, c, g, or t
ctaacagttctagcatgcaacaaaccatctactatctaatgtttaatcttcttaacatgttattttcattcctatnaatttccataagaagctngcaatgacaatnaaggaaaataagtcagttgtcccttggatccatggggnattgggacctgggaccggccccccaacccacagataccaaaaatccangtctnctcaaagtncctttcataaaatgacnatattttgtataaaaaccaaacgcacaatccgcctggatacttctatccctaggctaatacc

SEQ ID NO: 623953 - DNA, 256 bp, Homo sapiens
acgctcaggatccccgtgcagaatcacactcataaaaaaaaagggaaagaaaatcaattaatggtagtacactacctttgctttaaagaatgaagggggagctgggcacgatggctcacacctgtattcccaggtacatgggaggctgaggtgggagaattgcttgaatccccgaggcggaggttgcactgagccgagatggtgccacttgccccattctggacaacagagcaagactccgtctgggaaaaaaaaa

SEQ ID NO: 623954 - DNA, 148 bp, Homo sapiens
tgctgatctagaggatcccgtactgtggtgtacgtcatatacatttttttctatctcacatcatgttctagcccaagagattgaacatagttccctgtgctgtacagtaggacctcattgcttatccagtctaaatgtaatagtttgt

SEQ ID NO: 623955 - DNA, 135 bp, Homo sapiens
tcgacctgggctcagaggttctttgagtcccttggggatctgtccactcctgatgctgttatgggcaacctaaggtgaaaggctcatggcaagaacagtgctacggtgcctttacgtgattggcctggctcacct

SEQ ID NO: 623956 - DNA, 251 bp, Homo sapiens
taaattttattcctttaagtcagaattttgatatttgaaataaggctaccttcccctttttttctatttataaaaaagacgaggcaggggtgctgggttttttttgtccaattttaaatgtggtttttgcccttggttatttgaattcaagaaaggtatactttttcctcccatataactccccggttcctttttgccttggtgggttagacttaataaaacctaaaagggaaataaattccttaatttta

SEQ ID NO: 623957 - DNA, 483 bp, Homo sapiens
gatctctacaggatccccggtgctgccacaagattacatcccaatgcagctattcacacgtattatgaatcaccttacaggacccctccaccctcaagcgcgcaattccagagaacgtattaatgccttaatagactactgacaggttaacttatttacatacattctaaataatattttaagctgtattacagtgctataaatttctccttttaaggaaaaaagtaattagattgtttccttaccgtgtttgacaggaaaaaaaataaatccatagtaatctaattggtctgccgattttttccctgattttttacactccaacaaagcattattttgcaaaaagtcctttatcccatagtcagtgtctctgttttgatctctttgtataagaactctctgttcatccattctctttccctgggaccgtgtaataaggctgaaaaagtcttcatctggtactgtcggaccctttgtggcagc

SEQ ID NO: 623958 - DNA, 1023 bp, Homo sapiens
gtccttgttataaggtattcaagggctgcatcggggccgccctggcctgcccctcacagcgttgcaagaacccgctgtgtcttgtctgttgccttgctcttcgggggcttgagaggaatggccgagggaggaccaacttatctggggagagagaaggcccatcttgtggggctaagaccagtgtggtgcggaagctagaatttagaggaggggtaggggcatacttatggggctgtgaaggggatggggctgactcctgtgcagtgtggtggtcacagaggtgttgggtgagtggcagggagaggaaagggaggcaaatcaacgaaagttcaggaaaggagtggcatgtggacggtgcttacactgggacactgaacttgttgcatcatggaccattggctgtgagggatcgacgggatgtaggcaatggtccgagcagggtgatgttacttcagagtgcaaacttcgacaagatgttgcgtagagagtgcatgaatctcgtatgggggggttggtactcgatccagatacccagggggtaccctgacagacccatggccagaagaatgcaggcgatgcttctggccagtttcccaggtgtgcccgacgcaccctgggcatagcagggagagtgcaaggaatgcccaggccagggcagcccctgagtcacggtcagggaggcaaatgggccggtatccaggtgtatgcactcagggcgcgtcacaccagttgaaggctaggctgatggaccaggaagatacaggccgaggtgcaggaggctccaagctgaggcggggcaagcatgaggcagtgagggcaaccctagaagttagttcccgtcataggcccgggaggtcagccgagccggaaggcattataggccagcggcccgggaggatggggcctgaatacggagggcccgcaggagggggaggggagtacccaccacgggggcgaggcagaaaggcgaagaagggcggacacggaaggggaacaaggaggaagacaccgcgggaggacaag

SEQ ID NO: 623959 - DNA, 230 bp, Homo sapiens
tcatagctgactctagaggatacactctccctactggatcctagtttggtgctgatagaaaaatattgcattccgccgggcgcagtggctcacgtctgtaatcccaccactttgtgaggctggggcaggagaattgcttgaacctgggaggcggaggttgcaggaggttgtggtgagctgagattgggccactcactccagcctgggcggcagagtgataatccgtctac

SEQ ID NO: 623960 - DNA, 188 bp, Homo sapiens
gcgctgggtggttggttgcgcggtgggtcttgatcagggtggatcctgcgatagtcgatctgttgggctctcacgctgtgcgcgtgctcggtcggacttgtacgtcgtgactcgtgcgagacatactgtttccgtgtgagacacctcagagccagtggccttatgctattgaaacttctaaaactagg

SEQ ID NO: 623961 - DNA, 201 bp, Homo sapiens
gggccggggaattttttttttattttatttaaagggttttttttttaggaaaaccccccttttattatggcccataaaatttttccttgggttggatgggatggatttttaaaaattcaatgaaggcctgttgtttaatttttttttaaaatccctggtgggctttgaaagccttgggaatataatatggaattttgccca

SEQ ID NO: 623962 - DNA, 1356 bp, Homo sapiens
  misc_feature (5)..(5): n is a, c, g, or t
  misc_feature (14)..(14): n is a, c, g, or t
  misc_feature (16)..(16): n is a, c, g, or t
  misc_feature (26)..(26): n is a, c, g, or t
  misc_feature (221)..(221): n is a, c, g, or t
  misc_feature (234)..(235): n is a, c, g, or t
  misc_feature (245)..(245): n is a, c, g, or t
  misc_feature (247)..(247): n is a, c, g, or t
  misc_feature (407)..(407): n is a, c, g, or t
  misc_feature (482)..(482): n is a, c, g, or t
  misc_feature (495)..(495): n is a, c, g, or t
  misc_feature (552)..(552): n is a, c, g, or t
  misc_feature (554)..(554): n is a, c, g, or t
  misc_feature (569)..(569): n is a, c, g, or t
  misc_feature (601)..(601): n is a, c, g, or t
  misc_feature (643)..(643): n is a, c, g, or t
  misc_feature (710)..(710): n is a, c, g, or t
  misc_feature (714)..(714): n is a, c, g, or t
  misc_feature (861)..(861): n is a, c, g, or t
  misc_feature (972)..(972): n is a, c, g, or t
  misc_feature (1003)..(1003): n is a, c, g, or t
  misc_feature (1066)..(1066): n is a, c, g, or t
  misc_feature (1106)..(1106): n is a, c, g, or t
  misc_feature (1110)..(1110): n is a, c, g, or t
  misc_feature (1125)..(1125): n is a, c, g, or t
  misc_feature (1127)..(1127): n is a, c, g, or t
  misc_feature (1202)..(1202): n is a, c, g, or t
  misc_feature (1209)..(1209): n is a, c, g, or t
  misc_feature (1239)..(1239): n is a, c, g, or t
  misc_feature (1286)..(1286): n is a, c, g, or t
ccccntaacggcgngngacttagccntccgggacacccaccaggcgactactagaaagagaaagagcgctgcgatcacgaggacaggtggaggatatggcgtataaactgcagcgagacacactcacacaacgtaagcagaacgcgtaagaagaagcagagtgcaactccgtccacaatcgacgacacagccatacgacataagcacagatacaatgtagnttataatccgaanntataatatangngccggcggcctctcctctccgcggttatcttgatgtgcggccgagcagcgactcaacatgcactcggcgctcgcggggcggcgagctggaccggagagtggggagcggtcagcgcgtgcgtgttcgtggcgtctgttctgtatctccgtgaggggtgttntgttctgtatgcaagatgaatgaggactacgaccgcgcacgccgtcgcccgcctccagccagcgctcgcaccgcncgtgataccctcnggtcctgcttcgctctcgcacctcaccagcatgcacccgtcgcgacagacaaccgangngtcatgagtcgtgtntcaggactgtgatgtagagcagggagtaaagnacgctacgatgcgctgttgtgcggtgctggatgttgatattnacagtaagatacactacactacgtccactcatcttgttgtcgcccgccgtgtgacgggcgacagtgntatntgatagtatgatgaggagatagggagtatgaacgggcccgctagcccgctcctcgcgatcccggacagtcacgaaatatacaataacgtggtactatgagagtatgtaaatataatgagtatttgttgtgtgtatagattgtgacgntatatagtggtttattatttgtagattgatattgtatgtttgtacgaggtcagcgacgactgaacgccacgctgttttgttgtccgttcctctgaggtgtctggtctcgcntgtcccgcgtgggtcggagtagtgtgcgagntcacctcagaaacactcatcgcgcacgtcgccacgcgtcatgatagctgttgcgacgcctcantagatgcactacgacatctgtagatatgagctatagagangtgnatgagtctgtagcgntncgtcgtacgtgctcgacctcggtagagcgcagagcagacttcatgttatcaagacgcatatacgtgcgcaggtgnttgcggnatgttagcagtttgcgtgtgtctacgtcgnctcacacgatcgtcacacgcgagactatagcgaccacacgacacaanaacaatctctagttcgatactcgcactgtgcagtgtatccgcgtcgtcagtatgctgcgagtcgcagtaa

SEQ ID NO: 623963 - DNA, 116 bp, Homo sapiens
tcagcagaatcccagaacaaaagacgagagtcttggcactacagttcagacatcatgagctttgagctctcagtgaggagatacgttactccttccacaccatgcaggaccgtgtc

SEQ ID NO: 623964 - DNA, 210 bp, Homo sapiens
  misc_feature (1)..(1): n is a, c, g, or t
  misc_feature (168)..(168): n is a, c, g, or t
nttagagacctggtcagtatctcggagtggcggtcagagctgtggggtggctccggcgtctctggcgagtcggggaatcggatacaggcgagaggactcggcaggaaggagcttggggcgggggttgggccgaatttacgtgcgcgaagcggagtgaccgtgagctgntgacgatggcggggccgcagcccctgggtgctgcaacttgga

SEQ ID NO: 623965 - DNA, 225 bp, Homo sapiens
agtcagggcatccaacacagagctcttctggctcgcgcacttccatccctgtgtccctctcaggactctaaggtcacattcctcacaccaggcctttggtgtgtgcacatcacagctttctctaaccacaggtcgctctataggcacaaaactctgtcttctcaggcttatatgatgtgacagcaactcctcgcgtgcaatactcgtacagcccgggggacccac

SEQ ID NO: 623966 - DNA, 517 bp, Homo sapiens
  misc_feature (63)..(63): n is a, c, g, or t
gagccgtgcgtcaggcgatgtgccagctgtagcgccagcccggctgcgtcatggtgatgtccntggggtcgatctcggcgccctgccgcaccaggatgtcgccgagggagcgggtgctctcgatcagttccaggccccagggcgtgaaggtgtccgcgttgtagacgtgctccgacaggagcgggttggtcagggcctgggtgaaggcgtcgaccccgaccatgcgcatcagaaggcccggcagcggcgatttgggatcccggtcctcggcgaagagcccgggatagaactccacgtcgtcgggggtgggatagagaacggcgagcttctcggcgatcgtgggatcgctcgtgatctccgcgaacgtcgtcgcccgcgacatgccgaaatgctcgcgataggcgttgtagctggcgagccggttggagcgggcctgctcgatggcgagcctttcgagaccgaggatcggcttactggtgttgcagacgcccagggcgccggcgggctgggcggccgc

SEQ ID NO: 623967 - DNA, 346 bp, Homo sapiens
  misc_feature (196)..(196): n is a, c, g, or t
ggaatagaaaacaagggctggaagcagtttatataacaaggtcgctggtcatcctctggcacagaacgaacgttgtcttcacatgttttacagatgacataatagataacaacgcccttaatttactccatctaaaataagacatgcctgaaatttggcaagaaggggcaaaagacgtgacccttaatttttacantgagttgataagcatcccaagggttggaaacgaaacgttctaacttttagcagtgctgcacccagtaaaaaactggtataacatgccttcagtatactaacactcatatgctcagttatgtttcttgggtttttttttggggcagttgac

SEQ ID NO: 623968 - DNA, 777 bp, Homo sapiens
ttagacattagttgagcggtgcaagatagataggtgaatatggtatagatgggtctagaatgatctgacatgaatagtgttggttcgggaatagaaaagccggaggaaatggacggtatatgaataacatccggactagagtacgggagggtgcataagctggatgtactcaatagagagttcatgcggcgctcgagatcaatgttagagccccgctcttgtttgatgttagttctaaattttaagtcctttgccatgaggaaaaagtggtttcttgtttcattacggagaagtctatatcatgacatattggactgtttgcaacagataatggtgcaacaagcatgcttcccagggaaaggagtgtatcatggcataattgacactataaggatctcttcattggatacataccttgaaaaaatagcacaagcgttgtgccttacctggaatatatagggcaactaatacactggaagggggaaatatctttggccaacatagacgcatagtaaagtagacatgatataggggccttgaaaattatttgaaaaaaccacccgtggtccttcaagactaggttgaaaggggcctgcgcgattaattttaacggtgagaacccggtggagaattcacgtcacattgaggcattgttggttggttaacaaataatatattctgggttaaagaaagtaccccgtgcaaaaaataaggggggttggtattaccaacttttacgacgacatttttaataacctgctcattggaacatattgg

SEQ ID NO: 623969 - DNA, 512 bp, Homo sapiens
gaagagagttcctaatggtgtccatccctgttttttgacaggcagtcacacaggtgagcagtgccagaaactggttctcttttttgtgttggggaaaggagcctgcagtgaaaggatcagttggattttttgtcattgttagtttgtttaaataaattataagacagtatattaagctttagtctctgtaactcttatgtttgtgccccattattttagtgctttagagcaacaccttgtttttcctctattttatactagttcttgctccagaggcatggctttgaggctagaatcatgagcaatctctcataaacaagtctgttatgcacctggagatactcaagatttgcctctgttagcatggccacttagagattactctgttctacttcagagaccctccactatggcatccatgcagggtgtgtgcttggggactaagcaatcttgttcagtttaattattgtacttttttattaataaaaaggtcttaaacttccctcgtgccg

SEQ ID NO: 623970 - DNA, 767 bp, Homo sapiens
ggagaactagtctgagtttgtttctatttattttcttgagggcaaaaagcaagtcccatttttgggaattcattgacaaaaatttgaaaggaaggtttccccctccctctgaaaaatgccatcctttttgccctcggggttcagcacgggttataaaaaccccaattcctgtatattgtccccaagaagggcacgccactccacgggggcgtggggcgtgaagggaagaggtgttgcctctcatccccaggtttgtggtgcgacgtttgcgacacagaggaggcaacgacaatgttgaacccctcacctctggtgttcaatcccgtttccccggaacgctgtgggtgcttgctccccagcccctgtggtgccgtggcgtctgtggccaaacatggggttctacattgcgacaccaccgtgacgatacgaccacggaggtgtggccacgggaaaaactggtgccacttgtggattgccccttatggcagataggacgcgagaaggaaccatacagagggggcccaatgccgtgtggggccacacaaggaggggtctcccaaagagggcagcgaataactcgtgcaggggtgttaccactcaccaggaaagggttggtccacacaaaaagagacaaatccttataccaaccaataagagctgataggagccacgggggaaccaagccacgaagacagggagggcaaacaaaccagagtgagcacatagccccggaccagaacggcaacacagggatcacaaaggacaca

SEQ ID NO: 623971 - DNA, 194 bp, Homo sapiens
ggggtgaggggtctccatctctgtttcaacttcatggggcactgagctggaactttttccttccctattaaaattagaaccttaggataaatttactttctcaaattcttgccatgagagggtgatgagttaattaaaggagaagattcctaaaatttgagaggcaaaataaatggaagacatgagaaccttca

SEQ ID NO: 623972 - DNA, 833 bp, Homo sapiens
aatatagttaagcatagagccagatttagcatggagccaaatttcacatagatgttgcatgcttgtttcacaccgtatctgctattctgcatgtactaaagtacttaccattcacatgtctgaaatatgtttcttaattgcatgaagtgtatagtggtgttagtggacttacagacattaacttgcatatcaataaaaaaaaaatccatcctggtgtttttttttttaaggccctaggtaacacttagcctccaaggttaaacggggtaggtgaaaaatggggagtggattaacgggtaaattgggttgggttctaatcttaattaattggatggttgggtcccccttgggattgttacttatatatacacttttaaaaccatttaggtttttaagttctaattgggaagggctaatatcgggtcgctatggatagtcatttgcatttcctatggcatttccaaaaattcatcattggtgctatttacctaaaatacctaagtaccttgctcagcatttaaaatcgggatgcttgcgctatctctatatagagagctgtaagtttcctggttaaaaactagcggtttctaatttctgagccgaaactagtctcatatttctcattgagaaactaggtaccgtaggaatgtcagggggttatcccgggtacccattttacaaaattgggggtaagatcttctcatctgagaaccttggggggcacgtcatatccgaggatcgccgcctccgaattcgggggtgtcccacttggccactgacaacgatctcggagacgtgaaatgatttgccacaagatcgggccccaggtttag

SEQ ID NO: 623973 - DNA, 105 bp, Homo sapiens
  misc_feature (83)..(83): n is a, c, g, or t
agatgtaagtatatactagatataatttatgctgtttcttttttgtttgtttttcttttttccccaggatggagtcttacttngtcacccaggctggagcggtgg

SEQ ID NO: 623974 - DNA, 114 bp, Homo sapiens
atgggattcctagttctgtaggttgagaagtccaaaatcaagaatgcgggcatcggggaagggctttttggtggcatcatcacacaaaggaaggtggaagggtgacagaaagag

SEQ ID NO: 623975 - DNA, 546 bp, Homo sapiens
ccccccccaagaaaaaacttcctccccccgggggggaaaaaaaaaataatacccccccccttttttttttcttctcccccccacaaggggggggccccccccaaaaatttttttttttggggggggttgaaaaaaaagtccccccccgggggggggggagaggtccccctccctcggtgaggaaaccccccctcccacttaaaaaaaggggtgaaaaaaaaaaaaacttttccccccccccctttttttttggcgcgcccgggaaaaaaaacacccctaaaagcccccccaaaaaaagagggggggccccccccctttttttttcttttttttgaaaaatttcggggaaaaattcttttaaaacacccccccccccaaaaaaaagtttttttaaccgcgctttttccccccaaaaggggggggcccaaaaaaacccccccaaaaaaaaaaaacccaatattttttttccctaaaccccttggaaaacgggggcccctgtctaaggcttcagggcaggggcccccaaacagtaaagattgtttaatc

SEQ ID NO: 623976 - DNA, 806 bp, Homo sapiens
ccatctgcaggccccgaccggcccgctcaccatcccgtggacccggcggggctcggtcctgagatcttcaccttcgaccctctcccgtgagcccgcagcggtccctgccgggcgcctcccagcgcctctcgcgggcaccgaaagcgcaggcgagggttctctaccctcgtagtggtccggcgccagctgccagtcgaggaaccgaacccagccaaaaggcttctctttctgctgctcaccatcgtcttctgccagatcctgatggctgaagagggtgtgccggcgccccgtgctctccagaggatcgcccctaacgcgcgacatccctggggcccacccctgtgtccgccgtcctcgagcccgtttaatctgacttcggagcccatcgagattacgctctggagcctcagcactttcctccatgcctagacagcccggtcgccttctaactgtgactccccgcactctccaaataatgaatccgagaaaagcacaatagaaacaccaggcgtacctggtgcgcgagagcgtatccccaatggtgacttccgaggcaacttgaactcagaagcactacagcggagatcgccacccggtggcttgtaggcgggaccgaggcgcacagagagcgaggcgcatagagaccgaggtcacagccagttggggctagggccggtgggaaggagagcgtcgttaatgatttcttatggctcctaattatatcatatgtatgatgtacgtctcctaggtgatggagatgttacgtactattatttttacttttcagggtgtgagatttcccctgg

SEQ ID NO: 623977 - DNA, 651 bp, Homo sapiens
atcccagcactttgggagccccaggtgggcagatcacgaggtcaggagttcgagaccagcctggccaacatggtgaaacccccatctctactaaaaatacaaaaattagctgggtgtggtggtacacgcctataatcccagctacttaggaggctgaggcaggagaatcgcttgaatccggcgggtggggggcagaagttgcagtgagccgagattgtgccactgcactccagcctgggtgacagagagagactccgtctcaaaaaaaaaaaaaaaaaaaaaattttacttactaaagaagcacgcttttacctgttggaaaagacaagggctcgcaggctgagtcagtgtgagggggtaaggaggagggtggtctgacccgggtgaagtcctaacaccgggtgtttgcccggtgttgtggctactttcggggacactaacacgcacggtgtcgagggtgcaccgtgacgcaaagtctcatgtttcccaaggggccccagctcagtggggggacagtttctcgaatatatcaaactctttctttgggaaattccaatatgctctatgggtccctattattcaatcaggctgaaaacaatcctggtttcaaacaagcattacagaagacttaaccctataaaaaggggtccc

SEQ ID NO: 623978 - DNA, 288 bp, Homo sapiens
actagttctagatcgcgagcgggccgcccttttttttttgttttgggattcatttggaaatttaataattctaatagtaataagaaacatagttgatgcgacgtaggttgaaacgagggtccggcagttcgcctgtgagtaataatatcgactacactattaggagtccactctagcttcagagcaccgcgtagtctgtccgtctgtaacgcattgtggacacgtcgtaggggatacgtcataatagcaggcactgcacctattaataatgggaaacaatctcatttc

SEQ ID NO: 623979 - DNA, 157 bp, Homo sapiens
tcgaagtaccgcgggttctgtggatgcccctgaatggaagagggagcccctgtgttccctttgggatatcgagtacccatctctggacctagcttgcggacattatcccttgcgttctgcagttgattagctaacccgccaaactttaaatcactcc

SEQ ID NO: 623980 - DNA, 114 bp, Homo sapiens
agggtaaatgtacgttgttgagtcacaggcctgccagacctctactacctcattgtcccctccggtgaccagttctgccgtcactgtcaggagaatgcccgtgttgaatcactg

SEQ ID NO: 623981 - DNA, 257 bp, Homo sapiens
tagatctagagtatccccacgcgaacgggtgcaaacggatggaacaatctgcttagcaatctcagaaggactgtgcaggtcaatgagtcgcttgtggattctcatctggaatgggatcccatgtcttagaaccttcaccacaaggactttttctgtagtgatcctcaaagtctgggtaggtatacgaacgggtcctttcacttggagagtcttggcctctgctcctctgatgaggtcagcacacacctttttccaga

SEQ ID NO: 623982 - DNA, 134 bp, Homo sapiens
  misc_feature (21)..(21): n is a, c, g, or t
gtactcctcccgagtcagctncctctcctctccagacacaaacagagctttgatatcctgtgcagggagcagccttccttttgttgctggcaggtggtagttggaggaagcctcaaagctcgagttgtgtctga

SEQ ID NO: 623983 - DNA, 167 bp, Homo sapiens
  misc_feature (139)..(139): n is a, c, g, or t
attagggagggttatgccccaaccatgcaatgggaggtggagggacaggctcagcctcctcatgtctaaatgaggcctaaatgtgtgaagtgcgatttctgctttgtgtaccccaccaccccattaccacagctgcctntgtgtgtgtgtgtcaataaaaagccaaa

SEQ ID NO: 623984 - DNA, 684 bp, Homo sapiens
  misc_feature (94)..(94): n is a, c, g, or t
  misc_feature (103)..(103): n is a, c, g, or t
  misc_feature (107)..(107): n is a, c, g, or t
  misc_feature (112)..(112): n is a, c, g, or t
  misc_feature (119)..(120): n is a, c, g, or t
  misc_feature (134)..(134): n is a, c, g, or t
  misc_feature (137)..(137): n is a, c, g, or t
  misc_feature (154)..(154): n is a, c, g, or t
  misc_feature (162)..(162): n is a, c, g, or t
  misc_feature (188)..(188): n is a, c, g, or t
  misc_feature (194)..(194): n is a, c, g, or t
  misc_feature (209)..(209): n is a, c, g, or t
  misc_feature (230)..(230): n is a, c, g, or t
  misc_feature (259)..(259): n is a, c, g, or t
  misc_feature (264)..(264): n is a, c, g, or t
agaaccctttcgtctttattaaataggtgattctagcatcgttcctataaagagaaaggtccatgtggcgcccctttcagtgttttgcagtgtnccattggcnaccnttgtnatagctnntggagaaagcctgnggnttcatcctgtggtgttntccatgtngctagccatttaggtaagggtagggncttttnatttaaatgacttcntgcaccatcttgcctaatggnctagattgggctgtatcaacattgatttnctccnctttttatgccttccattgtgatgcgtcaaacacagtgaaagccttcagtcatgctatgggatttaattgtggatcctccatactggatcatttgtgggggacaccccttccccctttttttaaattaaaaacagctcattcttactgtggcgttggagcattcctccttttttggcctcctgggatgtcccctttattttttacccttgccccccccccccggttttggtggtggtatatttaaaaaagaaagaatgaaagccccccaaatgagtccgtttggggtcagtggtataaagggggtatatgttgccaaccaatgttttagtaacagttggctgtaatccctcctccccgggtttggccctgaaaataaggaaaaaaaaccttcttctgaattaaagtggccaagaatggga

SEQ ID NO: 623985 - DNA, 416 bp, Homo sapiens
  misc_feature (7)..(7): n is a, c, g, or t
  misc_feature (407)..(407): n is a, c, g, or t
cttgccnctggagatgtttgctgatttccgggcagcctgaaggttggacttttccattaacccaagcatgtgggaaatggaagataaagcctaattatatggtttgactgtgtccccaccccaaatcctcatcttgaatagtagctcccataatccctatgtgccatgggagggacttagtgggaggtaattgaattatgggggaaggcctttctcatgctgttcttgtgatagtgaataagtctcacaagatctgatggttttataaaggggagttaccctgcacaggctatcttgcctgccaccatgtaaaacgtgactttgctcctcattcaccttctgccaatgattgtgagccttaccagccatgtggaactgtgagtccattcgtcttctttttctttatnaattaccca

SEQ ID NO: 623986 - DNA, 890 bp, Homo sapiens
  misc_feature (841)..(841): n is a, c, g, or t
acaggcatgagccactgcacctggctgattattcacattttttaaaagaggatttgagaaatacaaacacaggccactttacacaataaaataggcaacaataacatacgtatgtttgcaagcataagcagttctcagctctactaatgacagtcacatgggtatgacagttatgaacagatgagtggtatttataaagaaataggtcaaaaagggaaatgtataagcaatcctcccacctcagcctcttagtagctgggactacaggtgcctgccaccacagccagctaatttttttttttaattattagtgggaaacggaggtccctatgttgcccaggctgggtctcaaactccgggtctcaagcagttctcccggttggggctcccaaaagtgcgtgggattacaggtatgagtcaccatgcctagactccaatgtatgggcgggcttttaataagagcgttggggaggtccagagtcttcaccttacatgcgggacgtaccccggtgtcccctttatgggagaggggccgggcgggcgcaacgggtgaaactctgccggacaatagtctcccgagattttcccaaactttaaattttttcgaaaaaaacttttccaatgtttcactttcaagagcgggagccccactggagagagaactgtctcttgcggcgtggaaaaccaccgcctggggcacatttttgaagcgaccaggcgtggtaagaggaaccactccggtgtggagattacacaaacggggagggggcgaggacactgaaatagaggcggagggggttatggaacaacgggtttgagcgcgcaactgtgattagtgggntctgtctatgttattatattctctttgtgttttttattttgtgtttata

SEQ ID NO: 623987 - DNA, 1844 bp, Homo sapiens
cgaccctacgcacacgagaacactgccctcctcgccaacagcgactcctcccttcacctccctcctccagcaagcaggagcaacgcaggaaacacaacgcaagaaacgccctggctgcagagccccaacttccctaccttcactggcactgctgaaactgcccaggcatgcctactacaacactcaccaccgagctcctcttagccccactgccacaacacgggctagctcttccgctgctgctctgcgcctgcctccatcctgtccctctgccccaagcccataccacgcgcacgcgaacaacgccaacgcgcttaacacgcaacgcgaatgctttcccctttccagccgcaagcgcaacgcccacgccacctaaacacacgaccaccctctctgcacgcctcacacgcactgcacgctgcgcgcacacaaccccactccctccacactaaacaccacccactctccggcacctacacacacacacacacacaccccccccacacccaccccccccacacacacaccccccccaccaatccacacaaaccctagccctcgcatgacctcgcagccagccaccagacgacacacctacagccctcacctcccacacctgcgctaccacagcagccgctcgcattacacgaagctgcagacagacaccacaggcagcagcctgccccccgacgacgcccgttacctcccgctcgcgcggcagctacggtcactcaaagtcactgccctcacagcattctcctagtcccctaacccaccctcctaatacgcccatctgcacgcctctttgctgtccaactctcacataagcgtaccacaacggaaccgctacggtcagacgtctatcacatgcgtcacccatacgcgctctccgcgtcaccaccaccaacgcacactcacactacaccactgctccctacaacgccggaccgaaacaccgacggaccgaacgcagcctgcctccgccccacgcgaccaacactatctcctcgacggcaacataggcccaccgcaaccttcagtcgcgtccaacccccgtccgcacgatccgcgccactctccctcatcctcgtcagctccgatcagacgcacgccggcccacccatcgccgcccccgccgtgcggagacccatacgccagcggcggccccgccgaccccctcctgcccttctcccatcctgcagtacgcccacctcccatactcgcacgcgaggcacaccacgattcgcctctacgcaaccccactagccagtccctctgtctcgtgtccctgcagcgcgcacccgtcacccacccgacgaccgagcagcggagcggcaaggatgacaggacgctgcccgactcacgacctaacccacaccgacagaaacaagcacagacgaacacacacaggacgcagcgagagagtgcaaacccacgaccgagcagacacagaaaggaagcggcacaacacaagaacaatgtaacgagagaagagcagacatgaagacagcgacgcgtatacaacggagactacgcgacgacgacagtagagtacgcagacgccaccaaccacaggacatatcagacaacatatacacacaacgacgtaccgcagcaccggcaaacaaacgacacacagcacaccatcggacacaacaaacgtcacctcaaccatgaacagtaccactcacaacataagaggaattcacaaacatcgtacagaacactacactccacaataccagcctaagtagtgtagaaccacatactactcgactcgagttgatattgtgactctcgtttggctggatgtacgaccgtccgctgccgtttgggtgcgtgcg

SEQ ID NO: 623988 - DNA, 276 bp, Homo sapiens
cgggcactgtagtcccagctactcgggaggctgaggcaggagaatggcgtgaacccgggaggcggaacttgcaatgagctgagatcacaccactgcagtccagcctggacgaaagattcagactccgtctcaaaaaaaaaaaagtgtgatttttcagataatgtcatcgggacatggctttggatggtggcttctaaggagtcagacccggattccctagtgtcccacaagggattggggctgtataggggccccgggcagtatgtgggctaatcg

SEQ ID NO: 623989 - DNA, 313 bp, Homo sapiens
ggtatggtttacttgcggagtctcatcggatttggcagctctgggccccaagctggcgcggactcgaatgtgactgggatggtgatctcgtcggactgcgtggctagcttggcgatgggggcctccacggtcagtgtgccctcagcgcacagggaggaggaaacttgggtggggtccacaccggggggcagcgtgtattgccgcgtgaagcaccgggagatgtagccatgctcgtcctgccgttcctcgtgcttgccggtgatctccaccaggccatccttggtcttgaccgtcagctcgtccggtgcagttg

SEQ ID NO: 623990 - DNA, 613 bp, Homo sapiens
gttatgtttgttattgttttttattacaaccttagggttctttattcaggcagtaaattaaggaacagcaaagtgggagggctacaccatcaccatggcaacagaaagccctcaaaaacattaaagttcccttcgatttattgttcgggttaaacttctttccatagccctcagggaaaaacacatttttaacttggcatgaggacaaggccaggcagccgtggccacacgtggcggaagggcagctgtggacagcgcggccatcgtggttcagactccgtggaagttgctttggatgaagggctttccagacaggcctccgtgctttctttacagcccacttctttacaggacccgataagccccgagcaggcctcttttcagctattggggcaccagtggaatctatggcccacaggtgtaaacctcttggtgggaattgtgggtgttcttcacaggctactcttatctttctgggatataactccacagctctgtggtgggccctttattggtctttaccccagagaaacctcttttcaatatatatacggttgatattaactatctatggggtaaaatctttaccctctttcgaggggattgagtaaaa

SEQ ID NO: 623991 - DNA, 1172 bp, Homo sapiens
cacccccatcgttcaaaaaacaagaaacaacgcagcatcaccagccttttctccttttgtcgttgtccactctcttgttattctctcgcaccagtggtcttcgctaactttttctagctctcaccctgtctctacattcgtttgccccttcctccgtagtttgttccccctttctcatcttttcttttcgggttatacacactgtagacatattggctcccgcaaaaaccttgtgtgagtagtgctctctgctctcgccatgggggaacctgtgggttgcccccttttggggggcaccgcgattttctttcgggggccccgttcccatgtgtcccccgttaatgctgtcctgtcttgagatctccctcagaatcctgcgtctccccaggtccccacttgtgggacccctcccggtgcttggaaccccaggtagataatgcctatcagtcctaagccccacagttgaaactggtacaaaggtactgggtaaaagtccctatataaggaacgggatgggattttccattctgcaacttttggagagggaaatccaggctatttaaagtccctacatttctaagtaaggtccctttcccctttcagcttcaacgggaggtgtcacgccgtattatctcccctttccatctccctccacagctctacttctggaggagatctgtccccactcctgtccaaactggaatccttccccttcccaactcttacctcccgtccactcagcctccctttcccctgatccagagacaagggatcaagaggggtttggagagggggaaagagaacccgccctctggtccctcaagcctcccacggaacgcttctttcttaatgccccaccctcttttcttaactccccacaaacagagattagacaccccctcgagcttctggaagttggtgtataactgccacacactcacgtgtttgaggtcacgtcccccgaggagaggggaaccctccctccactcttttttgcacaaactctcacttttcttcctctttgctgttgcttcccccctcacacaccacacttggtgttgtgtttctatcctaccactttgagatttctattttatgttgaacttgctgctttttttcatattgaaaagatgacatcgcccccagagccccaaatgaatggggattgaata

SEQ ID NO: 623992 - DNA, 1594 bp, Homo sapiens
  misc_feature (726)..(726): n is a, c, g, or t
  misc_feature (730)..(730): n is a, c, g, or t
  misc_feature (782)..(782): n is a, c, g, or t
  misc_feature (1107)..(1107): n is a, c, g, or t
  misc_feature (1347)..(1347): n is a, c, g, or t
ccgtctgcgtggatattttgcttacctatgccgcagcctccgcgtgttctactaatgagccgcgggtctatcctcccgtctgacttttgtcttgcgccggggggagtatatctctccccaagcagcgcctgttttccctttgccgtctttttgtgcgccaacacattaagcacgctggtttgcaccaagacacaccggtggtgtgtcccttgcgttcgcgattttcccccgcgggctttttctggtgacccccaccggcgcccgcttccgcggggttgtttctttcccttccccttttcgtgtaacgccgcccttcccccgggggtttttttgttgtgatcaagacctcttccccggatgcgcggcggcttgtttctcctctttttttaaccctccccggggtcacctcccatggccccccttgcaaatttggtaaatgtgtccgccagagaagttttcttttgtaatgaggaagaggaattattttgtggaaacgtttgaagtggtgtgggaagaaattcgcccccacaaccaccaaatcctcggggggactatttgaggggacgccccttgtgttggggaaggaattttttgggggaaatttgggaattgaatttgataaagggaaggagtgtagtgggaccacccccacgtgtccgcgtgcgttggaccccgcgcaaaagtggtgggaaaatgccaccgccccacttatatttggtaaaaaanaagnggtgccactctacaccaatgggggggccaacccccaccccacacccaacagnggagttgtagcgcccctcccccctctctctctctctctagaaagattgtaattgaagggacctcacataagagatatatgtcgcgactcacgcattgagtattctcccctcgcttttgggggaccccccacgagagttttcctcgagagacgtttggagccccacggagacacacactctttttggagagactccactctttctcgggctcgccacacaactattctctatagagacactccacacaagggtgttttggctctagagaggtgtacacacacgcacacgagactcgttgtgccccacatatatgagatcacacagngggagaaaaacctccctgagaggagagagattctccacacagagccgcttctacaatatatctcacaaaatgagcctttatactgagaagagaggagaggagaagcccacgggtatccgccacaagaggagaacccagctggtgtgtgaagagagagaagatggaaatagttgtgggcgctcggacaccccgtgacaccctcgttaagaggatatgtttcccacaatatactctagattnggccctcggctcctcgttttatataatatgtttaataatattagagaccaacaccagtagaccaaatagccagccagccagatccaattgtatatagccagaataattgtccctccattgccatgtgtagtttgagccaccagatccccaacccttaccggcccagatttttttttagtatgatggaaagattttttttttttttgctttgaataaaactgaactgtgggttttctataagtggcca

SEQ ID NO: 623993 - DNA, 718 bp, Homo sapiens
acattagagtcaaatcagccttgacctgagttgtgatttaacattgatttcaagcattaatgccattaaactgtttatgttaagaggattgcactgggggccatggctcatgcctgtaattccagcacttggagaggcaaagacaggtaggtcactggagctcacgagttgagaacagcctagccaacagatgggagctacttttcccagcctttattttctttttctggttcttttggagatggagtctggctctgtcgcccaggtgggacgtgcagtggcaccgatctcagctcagtgaacctcctcctcccaggttcaagcaattctcctgcctcagtctcccaagtagctgacactacagtggtgtgccaccacacctggtaattttggggttaagtagagactggtttcaccgtgttagccagaatggtctctatcttctgactttatgatccacccgattccactcccaaagtgtgagattacaggagtgagccactgtggcctgggcctgtttttggttcctttaacaaaaagttatagagacttctaattgagtatggtaccggaatctaaaatcacaattgggtattataaatcatgtgaggcgatattcattttccaatcaagtatgcgattaaatcttatccatacctgttttcaatcattggtccactgtttacgattccagggaacaacctccctttatgtttac

SEQ ID NO: 623994 - DNA, 669 bp, Homo sapiens
ggtcagtacgccgctgttctgttctctctctcttgtgtgggcgcgcgcccacttgtgtgtgggcgcgggtctcgctgtgggggttggtgtggggtgatcccgcgcagtgtggttgctggttttttcattcagtaagcaggcgcgcgctctgtgtcgttctctctttctggcgtggcccctcgcgctagatagatctctctctctttgtcggcgctcttctctctctgtgttggctcatcctctttgtgtggtggctctcctccttagttttctttgctccgctctcgtcttctctgttgtatatgggagacacaagcaagaggtgtcttgttgggcgccaccgccgtcggtgcgcgcgccctcttttctccctccgacacccaaggatagttgttgttttgtcacccaccaagagagcggaagttagtcctcctctctttcggtggtgagttatgtcacgacgtctgtcctctcatttcttttgttatacgatcctcttctgtgtggggactataagagagaagagagttaatcctcggcccgggggggcggcagagagatctgtccccctccccgtcttatgtttgtctttttaagaagagagagagagaagagtatcgccccccccccccaacaaaaaaaaaagagaacaaccctcctcagagaaca

SEQ ID NO: 623995 - DNA, 227 bp, Homo sapiens
gagtcgctggctgaaggttgtcggcgtcgttgtcaacgtgtgtattggggaaacctgggttgtctggccaagcaaatacatgcttagagcatagacattgagtcactctgcttagcactcaagtatcaaactggcaaggtttagatttaccctcatgatggccctgtcatctttaacccaacctctgactaggagttttaacacatggcttttgggcaagatggcca

SEQ ID NO: 623996 - DNA, 244 bp, Homo sapiens
gtatcatgctccagagtgaaacggagggtattctgaacgttcgggaggagagcttatcttatttgaatctagagagcagtcttctgcttcctatcagtcaaacatgtagaaattgggggcgggagccttccggaaggatcccctcaaccggactatctctgggaggcacttgtaaagttggtaccggcttaataactgagattcctttgccagctcactggcggcagcagtaacagcttatctt

SEQ ID NO: 623997 - DNA, 222 bp, Homo sapiens
tacactgcagctttctctgatgatctgcgagtcgacgtagctgtatagccggcctgggaggccctctgttgcggccatctgcaggcaatgaatgcttccctcctgcagctggtctctgtgaatccctcttatgctcctgtgctttcttcataaagcagttgggatctccacggtacgtccacatcattcttggtcactgccaagcttgcccaaaagccaatc

SEQ ID NO: 623998 - DNA, 852 bp, Homo sapiens
  misc_feature (6)..(6): n is a, c, g, or t
  misc_feature (66)..(66): n is a, c, g, or t
  misc_feature (68)..(68): n is a, c, g, or t
  misc_feature (75)..(75): n is a, c, g, or t
  misc_feature (97)..(97): n is a, c, g, or t
  misc_feature (101)..(101): n is a, c, g, or t
  misc_feature (139)..(139): n is a, c, g, or t
  misc_feature (141)..(141): n is a, c, g, or t
  misc_feature (165)..(165): n is a, c, g, or t
  misc_feature (213)..(213): n is a, c, g, or t
  misc_feature (268)..(269): n is a, c, g, or t
  misc_feature (290)..(290): n is a, c, g, or t
  misc_feature (307)..(307): n is a, c, g, or t
  misc_feature (310)..(310): n is a, c, g, or t
  misc_feature (327)..(327): n is a, c, g, or t
  misc_feature (330)..(330): n is a, c, g, or t
  misc_feature (347)..(347): n is a, c, g, or t
  misc_feature (350)..(350): n is a, c, g, or t
  misc_feature (355)..(356): n is a, c, g, or t
  misc_feature (359)..(359): n is a, c, g, or t
  misc_feature (367)..(368): n is a, c, g, or t
  misc_feature (372)..(374): n is a, c, g, or t
  misc_feature (387)..(387): n is a, c, g, or t
  misc_feature (391)..(391): n is a, c, g, or t
  misc_feature (413)..(413): n is a, c, g, or t
  misc_feature (429)..(429): n is a, c, g, or t
  misc_feature (439)..(439): n is a, c, g, or t
  misc_feature (444)..(444): n is a, c, g, or t
  misc_feature (446)..(446): n is a, c, g, or t
  misc_feature (451)..(451): n is a, c, g, or t
  misc_feature (453)..(454): n is a, c, g, or t
  misc_feature (460)..(460): n is a, c, g, or t
  misc_feature (462)..(462): n is a, c, g, or t
  misc_feature (466)..(469): n is a, c, g, or t
  misc_feature (474)..(474): n is a, c, g, or t
  misc_feature (481)..(481): n is a, c, g, or t
  misc_feature (483)..(483): n is a, c, g, or t
  misc_feature (487)..(487): n is a, c, g, or t
  misc_feature (489)..(489): n is a, c, g, or t
  misc_feature (493)..(493): n is a, c, g, or t
  misc_feature (500)..(500): n is a, c, g, or t
  misc_feature (508)..(508): n is a, c, g, or t
  misc_feature (510)..(511): n is a, c, g, or t
  misc_feature (523)..(523): n is a, c, g, or t
  misc_feature (526)..(526): n is a, c, g, or t
  misc_feature (533)..(533): n is a, c, g, or t
  misc_feature (535)..(535): n is a, c, g, or t
  misc_feature (541)..(541): n is a, c, g, or t
  misc_feature (559)..(559): n is a, c, g, or t
  misc_feature (573)..(573): n is a, c, g, or t
  misc_feature (647)..(647): n is a, c, g, or t
  misc_feature (668)..(671): n is a, c, g, or t
  misc_feature (673)..(676): n is a, c, g, or t
  misc_feature (681)..(681): n is a, c, g, or t
  misc_feature (708)..(708): n is a, c, g, or t
  misc_feature (725)..(725): n is a, c, g, or t
  misc_feature (733)..(733): n is a, c, g, or t
  misc_feature (740)..(740): n is a, c, g, or t
  misc_feature (749)..(749): n is a, c, g, or t
  misc_feature (759)..(759): n is a, c, g, or t
  misc_feature (841)..(841): n is a, c, g, or t
gggttnggaccttggaatggcagtttggttgggacagccgggccaagggaaaaaaaggtgcaaaantnaaaatgntggcattttaggtgtggccggnaaanagcaaggagcagtgggtgggcagggagccatgtttttntnttggagaaaggtcggccgtgtagnagcgccccctcccagcagcaattaggaaaagttggtgatttttgcaanttattgttgtgcccacaaatcgtttaggttaatgggcacaaagtttgtgggtagnnaaggttgggtagtgatgttgnttccaagggaagtgggnaanttttctttggagttaanaanaagttgtttattcgganttngagtnnggnaggtgttnnttannnggggtttttgcanaagntttcccttcttaattttctggngtgggaattggtaggntttgggttangattntntgggntnntgggtntntttnnnnggganagggttngngggntnattntgcagcnggggattngnngttctctccacntantgcacangncttggnccgccctcaccggctggnccaccatccagctnctgttgcacctgctgccaggattcggacacaaagcggacattctcctcgtgggccactgtgtaggtctcctggntcccctcgaaggatggggacnnnnannnngcccncccgccattcacacgattgaacaaaanccttggccctggactanagccggangtggganccgggagtnctgggctgcnctgctccgcagggactcgcggtccggccggctgttgctttctgggctaggtgcccagcgcgctctcggttctcttagctganaggggactcga

SEQ ID NO: 623999 - DNA, 898 bp, Homo sapiens
gagagagagctgtggtctgccggaagttgagcggcggcaacgaaataatggcggcagctacgggggatcctggactctcgtaaacgtgcagtatggccccattttatagatagatgacctgtggcatgttccgaggcttcaggggcatgtgagtgtgaccccaagaagaacgctgcaaacgacgtatcaggcgtggcattgaacagcttcccctaaagggaaacacattctaaacggggggacttatcaacttataaaattacaccaactttggcgatagaacccatcccttcgaacatgggcagccgtacggcccaatggcgctccagggcaatagtaacaacaacctttagcgagaaacggcttatctccaagcgcatctggaccatatatcactcggggacccccacagatagtggaacaggtattgggcctattccaactacaaacaccccacccccgaaatgggccgcccgacccgaggatatattaagcgacaagtttgggcaccccccgcaaacaggacaaactaacagttcggggagaaaacccaacctgtgtggttctactgtaagcacaacccgccggaatcccgcaactacagctgtggccggacagagtgattcctctgcgctcacccaaccaagtgccaaacccctttcggggcacaacggcgaactcttcaacgacgcaggcaaagaagcgccctcttcccacgatttcatcccgatcgggtgaccaatcaacacgtacacagtgccactcacaggcgcgcaacacaccaccgtcgtcggcaactgacaaaccttctacatttggggcagcgcggcacacatgtttccgccgcagaactatgtaaggcagcgtgcacttaccacaagtcgcgggagccacaccg

SEQ ID NO: 624000 - DNA, 363 bp, Homo sapiens
ggatccggttgcagtgagccgagatcacaccactgcactctagtctaggtaagaagagcgaaacgccatctcaaaataaataaataaattattctccttagtgaggttacagtcacaaaggtgtgttgaattttggttacagagtcactaacccgaggtcaggcatggcggtcacacctgtaatcccaacactttgggaggccgaggtgggcagatcatgaggtcaggagttcgagaccagtctggccaacatgttgaaaccctgtctctagtaaaaatgcaaaaattagccaggcattgtggcatgcatctgagtcccagcttactctgaaggctgaggtgaaagaatcgcttgaacctggt

SEQ ID NO: 624001 - DNA, 389 bp, Homo sapiens
ctaggaatgagtctcgcgagatctgatcgtctcataagtgatatggtagtacctcctgcgcataattctcctatattctgcggccttgagaagagggtatcttgctttccctttgccttccgccatgattataagtttcctgaggtatctccagccatgggaaactgtgagtcaatccctttataaattacccagtctcgggcacttcttcttcttcttttttttctgagactgagtcttgctctgttgcccaggccggagtgcagtggcgcgatcttggctcactgcaacctccgcctcccgggttcaaggaattctcctgcctcagcctcctgagtagctgggactacaggcgcacgccacgacggtctcggaccctcctcgcaacg

SEQ ID NO: 624002 - DNA, 612 bp, Homo sapiens
  misc_feature (348)..(348): n is a, c, g, or t
acatatacccaggctgagtgcatcacacggacatgcgatcacaaccttctcttttttaatatgacacatgtataatctcgcaccttctgctatacggagggcagccacctaatagcggggactctctttcagaggcacgatatccggtgatgctgaccacatgtaccgcatgtcgtacgatacataactctgcacaccaagctctcgatagtgcaccactatacgcttcttcgtacccatgacgactctgatacgtactgcacgacctagtcatcgatcaagtacgatcacactgtgtgacccctacctgataggacctctgaaccaaatcgttatggagacagtaanagcactaacgcgcgatcacctatgcaaccgtaggtatagacctcgaatacctcgctctctctgacctatgaactctctcaaccgcgcgcgcactacactaatggagaacatcgactcttcagaaactcctggagaacatccactacgcaccacggatacctattccctcactacgtacggcaaatcaatctaaccgacctccctaacaaagatgctatatactatatcccgtagctgcactacatgcatccctacactcatcct

SEQ ID NO: 624003 - DNA, 803 bp, Homo sapiens
gggtcgggcgctgtgcctggtgggtgcgccttgcctggaggctgggaggccgccccagccgctgctacccacgcagagccgggctggcttcgctggggtgcgtgcttggtgctgtgccgagccccgtggctgcagctcgtaaggggagcccgcggctgctgggagctgctggcgctggccctgtggtgggatgccctggggctgtaccacactggcgcggtggcacctgcgcgccaggacctccacgcagagcgctccagccgcgcagctctccctgtccagccgcctgcagctgagcctgtaccagtacaagacgtgtcccttctgcagcaaggtccgagaccttcctcgaattccatgcccttgcctaccaggtggtggaggtgaaccctgtgcgcaggggctgagatcaaggtactcctcctacagacaaggtgcccatccttggtgacccaggaaggacgaaaggctcgcaaacaaactaaatgactccttctgtcatcatcagcgccctcaagacctaccttgggtgtcggggcagacccttggaaggagatcattcaactacttacccaggaccatgaaaggcttgtgacacgacgcacgggcaacagaaggttgaacagagttcggcacataagtacttgggctcagtgctccacacgagaacggagggacccagccaaagtggtattggtgcggaacggaggcccgaggaacggacggcagactcaaagttgctgcacaataggaaggatataacatggtatgagtacacctcagtgtacgcccaacgaagaacc

SEQ ID NO: 624004 - DNA, 312 bp, Homo sapiens
tggtgtactgtacatgtacacagtaaaagagttccgttcggccgggcacactgtgctcatgcatgtaatcccagcactttgagaggccaagataggcggatcacgaggtcaggagatcaagaccatcctggctagcacggtgaaaccccgtctctactaaaaaatacaaaaaaattagccgggcgtggtggcaggcgccggtagtcccagctactagggaggctgagacaggagaaccacttgaacctggtaggtggaggttgcagcgactcgagattgcaccactgcacaccagcctgggcaatcaagctt

SEQ ID NO: 624005 - DNA, 237 bp, Homo sapiens
  misc_feature (24)..(25): n is a, c, g, or t
  misc_feature (53)..(54): n is a, c, g, or t
  misc_feature (75)..(75): n is a, c, g, or t
  misc_feature (79)..(80): n is a, c, g, or t
  misc_feature (83)..(84): n is a, c, g, or t
  misc_feature (100)..(100): n is a, c, g, or t
  misc_feature (134)..(134): n is a, c, g, or t
  misc_feature (194)..(194): n is a, c, g, or t
  misc_feature (215)..(217): n is a, c, g, or t
  misc_feature (236)..(236): n is a, c, g, or t
tagttattctgaatatactaaaannatccagctagattgcagtttaataattnnactgtacatactgtgcatatnatgnnttnncatcttatgtaaattnttttttgaacacaagttgggaaatgtggcttctnttcatttcgtttaattaaagctacctcctaaactatagtggctgccagtagcagactgtnaaattgtggtttatatactcnnngcattgtaaatagtctttnt

SEQ ID NO: 624006 - DNA, 170 bp, Homo sapiens
  misc_feature (161)..(161): n is a, c, g, or t
aattcttacaagagcaggccttgtctgtcttattcattattgtatctccagctcttggcactacaggctctggggcctattagatgctcgctattagatgctcaagaaataatgggggttttttggactggccacaacatatggaagttcccccgccaggnattgaacct

SEQ ID NO: 624007 - DNA, 417 bp, Homo sapiens
tttcctccccctgcttaagaaagcaaaagcacagaacatatccagacttatttccatatactcatcattaaccaaccaggtgaccagtctaaaaagtgactcaaaatatttgtgtgcatatgggtgaggcagaagataggcattatgtgaaaagcttggttggttggtgttatgggttaaattgtggctcccctccaccctggaaaaaagatttgtacgaatttttacccctgtccctcaaaaactcgagggggggcccggtacccaatttgccctttagtgaagtgtattttcaaatgaggtgatgctggtaaacaagtgtgcctcaatcaaaaatgactggtgtccttaacaagaacccaatcataatcttttccctaggtctcgtgggtgactaaaaaagaaaaagggtgcatc

SEQ ID NO: 624008 - DNA, 144 bp, Homo sapiens
atctcgagagtagtgcatgcctgtaatcccatgttactcgtgatgctgagcgaggagaatcgcttgaaccagtgaagtggcggtcgcagtgagctgagatggcaccactgtactccagcctgggcgatagagaccctgtctcag

SEQ ID NO: 624009 - DNA, 553 bp, Homo sapiens
  misc_feature (415)..(415): n is a, c, g, or t
ctcctttgtagctgggattacaggcacatgccaccacacctggcttatttttttttttgtatttttagtagaaacagggtttcaccgtgttggccaggctggtctcaaactcctaatctcaaatgatccgcctgcctcagcttcccaaagtgttgtgattacaggcatgagccaccatgctcagccaattttaaatatttttaaaatatttatgcagctctgtacgtagtcaagcccattaagaagatttgacagagacagggggagggatataagtctataattttggagatagagaatttgaggagctatctccagccgcaggaatggtaaagacattacctgcattttctaaagtccacatttctttttaatggtactattctgagtccagattaaaattatattttacctncattttaaaaataaaatgaatattttgtatgtgttggtgtttcagagctgaataaatgtggcaattgagaaaaattaattggttttaaagctgtttgcttaaagagaatctaacaaggccattgtcagacaaatgcat

SEQ ID NO: 624010 - DNA, 173 bp, Homo sapiens
tccttcccccatcaaccctccaagtgttccatatcccatacctcctcctcacccatctgtctccacgtggatgtccccacccctcaccccacctgacattctgtcacactaccttgtatagaaggtgaagggctggtctccctacctgccccagggaaacctaccgtcgacgc

SEQ ID NO: 624011 - DNA, 319 bp, Homo sapiens
  misc_feature (142)..(142): n is a, c, g, or t
  misc_feature (263)..(263): n is a, c, g, or t
tcgtacgagcgcggaaagatggcgtcgcggcagatgagcgactacgctgtgtggcgctaagaagagcgtgcgcgaaggaacggctgagcctacggagaaacgggcaagacagagatggctgtacggaccgtacgagcgcatncacagctgagaatgtctaaattctgctgaattccctgccttatctgctggaacggctcataaaacagcagcgtttcagaaaccactttgtccaaccccagaataaagtcggatgttctcancttgtcgttttccttctgattagtgagaaacggcaacgtcttcagctcgaatgttg

SEQ ID NO: 624012 - DNA, 346 bp, Homo sapiens
  misc_feature (143)..(143): n is a, c, g, or t
  misc_feature (247)..(247): n is a, c, g, or t
  misc_feature (298)..(299): n is a, c, g, or t
  misc_feature (311)..(311): n is a, c, g, or t
  misc_feature (322)..(322): n is a, c, g, or t
  misc_feature (328)..(328): n is a, c, g, or t
  misc_feature (333)..(333): n is a, c, g, or t
aagtaaggcatcctttcttgatcagcaaaggatgttcttttgctgggaaactgttgaaagatggttgcaacttgtctgaaaacatcatcaagagagaatgcacgttgcacatggtgtccgtatttagaggtaagatgaagatntatttaaagaaactgactggtaagagcatcactgtagaagtgaagccgagttacaccattgagaatgtcaaggcaaagatccaagacaaggaaggtatccctcnttaacagcagaggttgatatttgatgggaaacagatggaagatggaagaannttgtttgaatanaacatccagtnagggtnttcangaagatctgcacc

SEQ ID NO: 624013 - DNA, 1151 bp, Homo sapiens
gtgctgcgccgagccccctagcgcgctagcacatgtgtgtgctgccgtgactgtgaagctgtgctgtgcatgctgggcatgtgtgctctcgtgtgcttgcatgtgcttggtgcatgtgtgtccctctctccactgactcctagcctgctagtactacccactgttcccccctatgtgttgctgctgtgccaccatgtgctgtccagctgactgatggactgtgcatccaactgtgctggctgcctcgtgaggcctggcgaggacctgggaggctcccgtgcaatgctggagtgcgcctggggttcttggccacctgcctggctcaccttctacgacatcgccatgacctgcgggacggagactcattctgtcgcccaggctggagtgcattggcgctgatctccgctcactgccaacctcagcctccggagttcaatgcgattctcctgcctcggcctccggagtagctgggactacaagcgtgggccagcacgccccattaatttaagtatttaggtagagacagggtatcaccatgttggccagggtggtctcgaactcctgacctcaaatgattcccccacttcggcctcccaatgtgctgggattacaggtgtgagccatcgcaccgggcctaatatattataataattttttaaaaatagagatggcctctcactgtgttggctagcgctggtctcaaacttcccgagctcaggcaatcgtcccaactacaacgtccaaagtgctgggataacaattccggcttactatttaaaactttcccaggggttatagaacccactgtgcattgaccaaacactttactaaatctttacctattgttgaaacagaaaacaacaacacaaatcatcgtggcgccataattgtcgcgcgcgccgaaaaaagattgctattatacagtggcgctgttcgttcatacactgtcattgatgaacaccagctatttatgttcaacacgatggtaagatactgcaagcacccgctaaagggcggcgtgcacaatatacacaataacgccgttacttactaactatcttacagatgacagtgatatgaactaactcgtgagatgcgtataggagtgacacaaatgttaataacacgtaggctagacagtatcaaacatc

SEQ ID NO: 624014 - DNA, 201 bp, Homo sapiens
gtgacgacacgaacccaaacgaaataacccggacacaataacccggtacgacaatgacccggacgacaataacccggacgacgataacccggacgacaataacccggacgacaatcacccggacgacaatcacccgaacgacaataacccggacgacgataacccggacgagaataaccctggagccatatcaacgcgtga

SEQ ID NO: 624015 - DNA, 169 bp, Homo sapiens
tgagatcagtcccaggtccccatccatgaggttgtagtcggaagaggtgcctggtagacacatgggagctcctcctcctcctccctcctcctcttctttctcttcttcttcgttgtcattgtcttctcttttcttcttcttcttcctcctcttcttcctcctcctcctc

SEQ ID NO: 624016 - DNA, 164 bp, Homo sapiens
ccctgctgtcatagtcttgatcatacaggctatggtcgatggacttgcacttccagtaggagacaggcacgctaaacaagtgcatgcagctcactagatttcatcctacagtttccgaacagtgaccaccacaagtatgttcgacaagcctggcccacggccga

SEQ ID NO: 624017 - DNA, 1111 bp, Homo sapiens
  misc_feature (341)..(341): n is a, c, g, or t
tggaaaaaaaagggaaaatttattaattagacagtatgtgggcatccggtcccacatgtgggaattgagaagatgctataggttctctaagttatggcacagtctgaaaaaataacaaaaaaggggaaggggaggaaaaaaaaaatcacagtgatatggggaaccatctcacattatgaataatctaccagagaaaaccttttaaaaagagaaacacccttgggttctctacgaggagacctctatagagtttctaatagtctcgtgggaaagtgcacgtggtatctccaagtgtgagagacacttcttcgagttacacgagcgaaagcgtggtttaaggnccatagctcccacgagtgtgtgccacaattattgtacactagacagaaaatctattattagacacatatatatgtgccaaatctcacgacctctttctgtggggccttttcaagcccggcgggacaaatctcgagtgacccattttctgcgtggaaaacccgtgtgttctggcctgtggacaccacacgggccggcctatacaagcgcgtgtgaaacgaggcttagtggagcgcccgtgaaaaaggtctacacatatctttccgtgagcaagcccccgcggttatgctggaagctgtgcacaacacacatttccgcactctaagaagagcccttgaaacatctcccagcgtgaaagagactccccaggggggatctagcaagaggctccccagagggaggggcacaaatacggcgcggggagaacgcgcacggtggttgtcgacaccacacagaacgccaacatcctgggggggcaaaaatcgccggcaaaccagtgtgggggtccccaaagaatttttcccccaaagggtggctcccccatccggggggatcaccccttttgaaagaacacaggggtcgcccctgggtgcagaagaggctctttattagggcgcccgcggctaaacctccgggcgaggggacaaaaaaatcccgcgcgggatactagggcgccccagaaaaacgcgggaacccccgaagcctgtggggccacgacaacactcacgacacagggcggggacccaattcctatatcacaaatcggggccca

SEQ ID NO: 624018 - DNA, 680 bp, Homo sapiens
ataactacgaaatgcctattccaaggattcccataatcagcccgccacatccaaagtatgggaaaatcttagacagaccgtattaccaagttgttctgtttcccctccctctctcccaccccatgtctcttttcgcccttctcccgccctcactcacatgaccgtaacaagaccatcaacaaccgctcgatcccgttccgtctcctcatcatccttcaagaccagaccatccacacccaacaacaacaaagacccgaagacctaccccaccctaaaagcaggagactacgactcctcctatacaatacgcagtctagttttctaagagagtataggaggagctaaatttatctttaacgccgcactagtcgtactactttccctaacgactttcgatatcgtcgatataatttcttgcctcgtcctaactcttctctctatcgccgtcgacttcgaagtctgcggatccatcgtccggactatgcgaggatcgaggaggaaccgtccgcttcgggacctgcctaagcatgagcggttgctctatcctcgaggactttccgtgggttgcgtaggtactaccgataatacgcgtcggcgaaaccctagggctcgttggttcatcttctttctaatgagggggtctaattaggctccttagggactaactatcttcgtattaa

SEQ ID NO: 624019 - DNA, 239 bp, Homo sapiens
  misc_feature (178)..(178): n is a, c, g, or t
gtcggaatcgtgtgctgctgaaagcggtctgttcttacttctcacgagtcggacactatggctgcctctggtccagaaccaaaatgaagaatgtgctaccagctcagcctgggcttgaatccggacacaaaccctctagcttggaatgaatatgctgcattaacaagcactgcactanctgactcaggaatcggctctggaaggtgaagctagaggaaccagacctcatcagcccaaca

SEQ ID NO: 624020 - DNA, 202 bp, Homo sapiens
  misc_feature (5)..(5): n is a, c, g, or t
taaantatccactaatctatatatagacttaagaggaacgcttgctctgtcgtccaggacgatcctggctcactgcaacctacaccttccaggttcaagcgattctctcacctcagcctcctgagtagctgggactacaggagcctaccaccacgcttggctaattttcattttttttgctgttgtttttattctgcagaga

SEQ ID NO: 624021 - DNA, 297 bp, Homo sapiens
gaacggaccgaagcacgggcacagagcgatgagactctgtctcagaaaaaaaaaagaaaaagaaaagatattcctagattaggaaaaactaagagaactcacggctagtagacctatccggtaaaaaaaatacgctaaagggagtccatcaggcggcttggaaaaaacactaactagacgatactcaaatccacatgaataaagaacacgggtaaaggtaattacagtcggggcatggtgggctccaggcctaataattcccggggcttcagaaggcctccccgagggcttcagaag

SEQ ID NO: 624022 - DNA, 1551 bp, Homo sapiens
  misc_feature (249)..(249): n is a, c, g, or t
  misc_feature (258)..(258): n is a, c, g, or t
  misc_feature (332)..(332): n is a, c, g, or t
  misc_feature (418)..(418): n is a, c, g, or t
  misc_feature (479)..(479): n is a, c, g, or t
  misc_feature (811)..(811): n is a, c, g, or t
ggccaggatgcctcaagtggaaagctaatgcgccgaagggagaataaggtggctcgcgcgcgccctaggctgtccgcgaaggaacgcccgtcaaggcgtagagaaaagtaggtgagttgcccctcgctgtgcgatgaaaaaggcctcatcggaacattatggcgcgcactatagtgcaccatgtgaacacttcgatgctcgcataagtgaagtacctcacctcagcttgtgtgctgcgacagatgtggngctccctcnagacatagtattgctactagctatgtgccaaagctgagaccaagaagagagcgacaccattgctcgtgccctantacatgtgcgagcgtatagagacacggcttcgaccgtcgcatgacgaggtctagagcacaggatctcgaccgccccggggcgctcntcgagagcccggaaccatatagctagcgcattagcttcaagcgcttgtgcgttagactctntagtgcgctcgaacgagagcgtatcgatagaaccaacctacgtagcgatacatcgcgataaagaccgataaagatacgtctaaagaaggccacgcttggttttgagaccccactggggaaccaagaagcgaaatcaaaaggagcgctctgcctttgcgctcacacgacgttgcgcgcacgtgtgctcgccgagacccccagaagcaggaacgcaaaacgccttggggtccgcatttgcccgcacgaccgaccgcgggaagcgtcttaacacgcaaccccccggtttcccaccccaagccctgctgcgtgtggctctgcccagggtaagacangacacagacagtaccattgccctcccacggcacttcgtgctgcgcgcttgggattttcgcacacggtcccggaaccgtgtgggtgcagtccccccagatgcccggcattgccgtgagcgtgtgtggtgcgttctccttttgggctccggttgggccgccttgggggtggcatcgggtctcacggaaaactcggggccggctgttgtcccccggtttgaggccatggggccaccttttaccctccaccattggggctggtacaccaggggcccaccttggaacctttcggtgcggcactccgggtttcccttaaaggttccgccaaatccccgctgtaccttggcaatccccttggggcagacccccgaaccctgggcttcctcgcccacctttatctccaaccaatcaatgaaggtttggagagatacttcccgtggcggacacacacgacacacagagcacaccgctggcgcggcccctatttcgtggggccctttagaagcggcactcggcccttggccagaaaagggcgtgaaattcccccagggcgggaaaacccccaaaactcttctaacaccacctttgtgggaaccacctggtgaattaaaacctcgaaggtgtcgaatgggaaactgccgcccggtgcctggataacacaagcattggggacaggggctgtgtgtgcgacagattctggtttcccctctggggaggagttacccctttaagaaggttccttg

SEQ ID NO: 624023 - DNA, 268 bp, Homo sapiens
  misc_feature (160)..(160): n is a, c, g, or t
  misc_feature (185)..(185): n is a, c, g, or t
  misc_feature (231)..(231): n is a, c, g, or t
  misc_feature (265)..(265): n is a, c, g, or t
tcagccatggaggatgtttaggttggtcaggctcacttcagccctaggagtcagtggggaagatggaggccatagatggggtgatcaacaggttggtgatgagggacaggccatggttcacaatgtgaggccagtattaaacaggaggtgagaatctccntaatggatacagcccgtgattccanaattcagatggcttcccgtgtgggcaggaagagctatgtaactcantcctccaggggtgctggaggtaccggagctcganatt

SEQ ID NO: 624024 - DNA, 267 bp, Homo sapiens
atcctatagagatatattctatcatcctctcagtatctatcatcagtgatccataacaaatgtctaactgcaaattaacctccagaccctgtccattcttattatatatctgccagacatagtgcagctcaactattgcaaagcgccaggtctagggtagtgatatggtcatgtctggactatacgccctgaatatgcagactttcagtcactatagtcaattcagccagcgcactagcgggaagtgtgcgaccgaattcctcatac

SEQ ID NO: 624025 - DNA, 1233 bp, Homo sapiens
acccccccgaaacacggacgaaaaaatctccggactcgagtcgacgggctgggtggagccttcggacccagcggagcagcagcagcagcagacccacgttcagcgttttttttttttttttttttttttttttttttttttttttttttttttttaccgggggagacacaccccgcggggcaaggaggggggggggggggggagaacagaggagagagcacaacggggggagacgcggggggaacaccacacgcgggggggtggccgcgcgggggagacgcggggggccaagggggagacgagaggggggggggtgggagagggcccccgcgcggggggggtgggacacacacactgctgtgagacaggggaggaacatgggggggtggacacacacaccgggggggcccgcgcgagagaacgacgcagaacagcgggagtacactatgtgtgagacccacacacacacaccgggggcgcacacacacacaccacaacgcacgagtccccaccagcgggcggaaccagcgggggggcgcaccccgggcgaaggacaccagacgagagagactggtggacgcacacacagccgctccaccacacacaccctcaccacagtgggggggggacaagcacacagcgagcgcgacgcgcctccctctcgcacagagcagcggagcgaatcaaccgaggagacccagcggcggggggcagcagagggcccgtagcgccacagccacgggtgtgagaagcgagcgcgcaccgaggggaccacccaacctcctaaagagaggcggcgggctcgtatccaccccgccgtgggggggggcacaaaaaacaacgacaaaaacaacaggagcagacggcgagccccccgcgcgcgacgacaaccaacacaacacacagcgcgggggcgtcctcgcaggcgcacacacaacaaacgggagtgggcgcgcaacccaccccaacgaggggagggaggccaaccacgcggcgagccccccccaaaagcagacaaaacgagaaaccaagcgcgacagcaaggagaggcaaacaaaacaagcgagaggcgcgcgtagtggcagcgcgagaacaaacaaaaacaacagccgcgggggacacccccggccgcccaaaccacaacactcaccgcggaccaaacccgcagggggcaccaactcacacacacgagagcgggcgagggcgccccaaacggaacccgaagggaccacg

SEQ ID NO: 624026 - DNA, 496 bp, Homo sapiens
  misc_feature (57)..(57): n is a, c, g, or t
  misc_feature (271)..(271): n is a, c, g, or t
  misc_feature (374)..(374): n is a, c, g, or t
tctcaaactccagacctcaggtgatccaccttccttggcctcccaaagtgctgggtnacaggcatgagcccccgtgcccagcgactttattccttatactgtgttaatatttgcttctgttcttagtttactctgtcgttttggtggagtacattctgagtagtttcttgagatatggtgcttgaggttttttgttgttgttgtttggtctttcttgaatggtttgccccgggtgtggaattttagtttggaaattactattctgaagatngaccattgtaaaagtatccaagcctgccattctgccattctgttttctgatcctttgtcactttttctttctaaaagcatatagaatcttctctttttccccnagattctgaaatgttactgtgatatttctttatgtgtgtctatttttatctgttgtgttaggccctttcaatctggcaacttattctccagcctgggtgatagagtgagactgtctcaacca

SEQ ID NO: 624027 - DNA, 599 bp, Homo sapiens
tcaagcctatgtgctaacgatagaagaggacatttggaaggaggtacgagatcaagctgtggcaccctgggataggatccacagaaatagaggctcagtgaggggggttccccggtggcattctgaagtgtagtggctccatatccaggatggtccagaggtctgcacagcacgagtggcaccaggagagggaacactcacaggggctgagtgggaccacaagcccatagccaccgtcctaaccacccacatttctctgggaacaagacctcccacagtggcctccccggcagtggaaatagccaaactggctaacatggactttcttcaactgcccgggtcgatgctgcctcagtgccccagggcaggtcaggaagctcccacacccattctggaatgaggggttggaggaaggctgagctgagcaaaggacccatctctgctctggttggtggggagggagcccattatacaagagacccctcagggctcagtgaggggtgacagagacttggcgactcgtgtctcgtcactgtacgaggtgagagaggtttggagagtaaggtacatgcctttaataccaccggggagtgcaccca

SEQ ID NO: 624028 - DNA, 292 bp, Homo sapiens
acacgagtttcatcgcgctggcgtgcagcgcgtggcacacgaagctcgagctgcatggtgctggtgtaggacgtcttagacccttccatcccttcagtcccccgatgcatcttcacctcgggagcccggagcccgtcatccaagtccggtctacctgaggaggcatctgtggcctcggagtcgggaccccggaccggacggcctccagaagttaccatacgtctctgtattcaacggaccgcgctggtgtcagaaccacgacgtgcgactaagttacatacgaattcgcaga

SEQ ID NO: 624029 - DNA, 588 bp, Homo sapiens
tgcaggtgtctttgtctcataggttcacagaacatctttatttctgccttcgttatgtacccattagatcattcagaagcaggtgtcagtttccaggtagttgtgcggttttgagtaaggtttcttaatcctgagttctagtttgattgcactgtggtctgagagacagtgggttgtgatttctgttcttttacattggctgaggagtgctttactaccaactatgtggtcagtttgggaataagtgtgatgtggtgttgagaagaatgtatattgctgttgatttggggtggagagttctgtagatgtctattagtgcagagctcagttcagttcctggatatccttgttaaccttctgtctcgttgatctgtctaatatggacagtggggtgttacagtctcccattattatggtgtgggagtctaagtctctttgtaggtctctaaggacttgtgccgtgaatctgggattagtgttatgaatcttgtgtagctcctgtattaggtgcatatatatttaccaatagttagctcttcttgtcgaattgatccctttaccattatgtaatggccttctttgtctctt

SEQ ID NO: 624030 - DNA, 111 bp, Homo sapiens
  misc_feature (10)..(10): n is a, c, g, or t
  misc_feature (84)..(84): n is a, c, g, or t
  misc_feature (108)..(108): n is a, c, g, or t
gaaaaacctnccgacaccttctgccctctggccctgccttggtgaccaaggacagtgtagcagatcacacaacttaaagatctncctgcgagtgaatggggaagtcgncag

SEQ ID NO: 624031 - DNA, 279 bp, Homo sapiens
caccacagtattacttatgctcttttcaatccatatcctcatggagctaatctaaacagataggtgatctgattttgaattatactcaggtgacagtctcactaattactttgccactgcaaacaatgggcctccttttactagcctccaaatcacatactctaccacctgctgcatcataaataagctgatgtaacatattttaggttattttttcacgcacagcactccacttctatgtaccaatatctggacatagcaatggtcaattctagctcc

SEQ ID NO: 624032 - DNA, 100 bp, Homo sapiens
catgaatcggtttagcagtatagaggcgcccatgtttaaaatttcatcatttaaacaggttcatattaatttccattaaaaaatcggttgtacggtggta

SEQ ID NO: 624033 - DNA, 941 bp, Homo sapiens
gcaggctggtaccctcggggtacgggatcggagggcacgtgtctgcgggcgccgagggggcccctacaagaccgagcccgccaccgacctcgagccgactggcgactcaactgcgagaggggccggaagacgtggacctacctgcaggacgagcgcgccgagccgcgagcagaccggcctggaagcctacgccctggggctggacaccaagaattactttaaggacttgcccaaagacccacaccgactttgagggggctctgaacgggatgacattttacagtggggctgcaggctgaggatgggcactggacgggtgattatggtggcccactttacctcctgccaggcctcctgatcacttgccacagtggacagcatccctcttgacagccggatacagagaagagattgtagcggatacctgcggtcagtagaagactccctgacaggtggctggggcctgacacaattgaaggataacgtccaccgacgtatcgggactgcgctcaactattgtgtctctcagaattctgggatgtagaggcctgaccgatcctgacactggatacgagacccggaacattacttcacaagacaggctggatgctgtcggacatccccatcctggtacggcgaagctcacttggagtgggcatgatccttgaaactggcttatacaaggaatgcgggaaaggcccgtcaagataccactgattagcccaagacgcaaatggatgggcatgggacgacaggaacatggggaagccgggacaaaagccccgaaacaaaaaaacactggagggccaacatggcacggacaagagtgtcaccgggagccaaggaaagcaaacggcatacggcccgacgccgggcatgcagcagcccgcaggaaaaacaccgcacaagagagcaagaacaaacaagggaagcagagaaag

SEQ ID NO: 624034 - DNA, 131 bp, Homo sapiens
tgcagagcgctcaggccaagaaggaggagatcatcaagactttatccaagggaggaagaggccaagaaataaaacctcccacttggtctggtacatactgggcctcggtgataacattagatcagccatta

SEQ ID NO: 624035 - DNA, 113 bp, Homo sapiens
tattctatctccccctactggccaatgagggtgagtatcccaagtagttgtttaaaattcccatatgtgtactatgcccaaatccaagaaaaataattatacatgtgggtgta

SEQ ID NO: 624036 - DNA, 159 bp, Homo sapiens
  misc_feature (147)..(147): n is a, c, g, or t
gagaggtgggacacggggagaggtgggatggattgctagaacgccaggagttcgagaccagcctgggtaacatagctagaccacatctcttaaaataaaatagttaatttagccaggcatgatgatatatggccctgtggtcccacnctctcgtggtac

SEQ ID NO: 624037 - DNA, 261 bp, Homo sapiens
ccttggacttcgtaaagatcatcaccatcctggtcacggccacaacgttcaacctgggggcagcgggcattcctgggtgtaggtgttcttactttctggccgtattcttgaaacaattaacctttccggtggaacatatatttcctgtatatccggctctgtgactctgctcaattggggcccgttctcttacgcgggctctaaaattagaaagtagtacactctttggggggagagatctcgccgacaaggggagagggg

SEQ ID NO: 624038 - DNA, 865 bp, Homo sapiens
tatattccaccttttttatggaattggtttaaagggaggtagtgagggggcggaagccttaaaagtcaaaatccatattaaactcgggggagtgaaaaattaaattaaatcagtaagatggggagtggggaacagtcagagggaacttggcccaccttggaagatcaaatcaagaaatcagggaaagcaaagacttaggagaggagaaagacattctctcaatccatcctccttccccagggcagagatttaaacagacgtcctgagtgagcctctgagcagaaggctctcccatctatgcacagacttcactcctcctccccgaggccttcctgaggacaaggtccagggtctgggccttagccaacagaaatacgaggggtcaagggggtccaggagctggggcaggacgcagacatcagtctcaaatactggagcagccaaaaaacagaagacagatgggcgagaacacaggacgagggaatcctgccagctggaggctgggtgaccctgtcccagatccacactgtaaccccgggggaagggctcaggggcataacgacccacggcccgcttgacaaacagccaaggggaaacggaccaacaccaaatttgagaatgtggaatcccccggtatacaccacgtggtggagaaatccccctctgttctcaggaagatgcactcagggcctgggacagggggggagacccaaatcggcactcggagatcacggtcccctcgcccaaaacaggggacacctcatcgtcgcagccccagtaacaccggacacacagccggtcggcagcgctcacgcttgttgaaactggccaactccgtgggccacacactgccaaggtcaaacca

SEQ ID NO: 624039 - DNA, 897 bp, Homo sapiens
gaacgaggcggatgaaggccattcaaactcctccccacgacactctgaagcagcgacggcacagcgggaagaatggcaaaatgttataggaggccttagctgggacactacaaagaaagatctgcaaggcactacttttccaaatttggtgcaagttgtagactgcactctgaagttagatcctatccacagggcgatccacaggggttttggctttgtgctatttaaagaatcggagagtgtcagcataagggtcatggatccactaaagaacataaatttgaatgggaaggtgatggcattccgtaaacaggggccaaagccatggaaaaacaaaaagaaggcggttaaacaaaattttggtggtggcctttctccagatacaccttgaagagaaaataagggagtactttggtggtttggtgaggtggaatccatagagctccccagtggacaacaagacaataagaggagtgggtcctgctttatcacctttaaggaagaagaaaccagtgagaagataatggaaaagaaatacacaatgtggggcttagtaatgtgaatacaagtagccttgtctgaaggaaccaatattcagcaacagcaacaggtgggggatctagaaggcaggaattgacggaagagctcgggaagaggggggggcacaagtcaaaaatggacacagtgccattagtacctattgactcacggtatggcaacaaaggataaacagcaggtacggtgggatggggaatgcaacgggtcacacacttggactgtgctatagccccaaggggagggaagaacgcaagggaaaaggcgacaaaaatcctgattccagggagagacaccaagataaaggccccagaacaaaaagcacgaggaggccaagacaat

SEQ ID NO: 624040 - DNA, 1184 bp, Homo sapiens
ccccgcttatgggtggtgcccgacgcgtaatatgtgggtgagagaaagtcaagatgtttctgggggcgtagaccacgaatgggggacacctcaattgtaggaccactaaaggagacataaattcacttgtgggagggttgtaacccattggcgaccgaaaaagcatagtcgacctttgtgttttcgagggtccaaatggtattcgtgttgggttgtggtgccgcccccagtgggggccccgaactattttgggggtcaaagatgcggggttaaagggacaccccccgtgaggatcggcattttttcagggggttggttttactcacaacacacagcgggggaatttgttaaaaggaacacacaacagaggttctttggggaacaaatttgttgttgggcccgctgcgctctgtgagaaagagatctacacgatcccccgctggggcgtgcgacttgttcacactgtgttcgcgacggaaagcggggcacccatggggaaattgggtggttggttttgtctctctctttgtgggagagatgggtaggtctgccccgctctcgttacagcggtgccgcacggtggtggtgttgtctttggggtgccccagtgtctccccgtgatcggtctgtctttttctgcaatatattttcgcttatataagtgaacccataaattcccaagaaaaactttctagtacaataccaagacagaaaactcccctcgtagtcgcccttgtgggtgtgctaatatatagtatacacactctactgtattttaaccccaccccctttcctcgccacacccgcggtgaacgcatctcaggcccaccacacacgtgtctgcaaatccgacacacacccacccccatcgttgtggtggtaatgtccaagttttgtggagagttttgggaacatcttaacccctgtgtatggaaaagaccacccccagccatttgtgggaagccagacaggtctcctgtgaatgtaaaccaatggtagcgtcttatgtgggggagagggggagggcctgtccctgtgaaacccatccatcttgtggaaatgaccaccggggaaagtttttatgtgcccttttggttttgttaaaaagggaccccccgagaagactgataagaataccttttagtatctggatttttcaccacaattaagatggctattataat

SEQ ID NO: 624041 - DNA, 744 bp, Homo sapiens
ccctccctccctcctcggtgttgtcgggcttcttttttgtctcgtgttttttttgttcttcctcttcttttgttctttgtgtcttgctctcttcgtctctcggcgttgttttgtgtctccttttgttttgtgtttgtcttcttattttttttcttttagttttatgttttggctcttttatatcggtatattatatattttttgttgttttttatttcttttttgtgatttttgttatacacttttctttgtgttttttttttgtttttctttcgtcttcttgtgtttttgtgtgtgtgggttgttttttttgttttttttgttttgtttggttttgttttttttttttttttttgttcttttttgtggttttaagggggtctttatgggggtattctggccccttttttttattttttgtggggtgtttttttttggcctcttggctccttattcttggtggttccccccccttgttggggctcgttccccgttatgccccccccccgtggccctcttttttcctttttattttttttttggggttgacctctcttttttttttgggttttgaaaacccccctcttttccccccccctcggcgcccccccccccctcttaccccccccctcgtatatatatataatattaaacccttctttttttatatacatctctctctctccccccctctatattgtttgtggtcttgggggggccccccaaaaggagaggtgggcccca

SEQ ID NO: 624042 - DNA, 602 bp, Homo sapiens
catttgggacaggccccggtttattgagcccctgacacgggactttgctccttctgcgtcgaatccccccgccgcccaatgccggttctgtctcccagaacacggaggaatcattcgcttttttctggccaaatccattcctcgaaaagatattccggaagtttgcgtcccccgggtcataccacaagggcccttctggcaaatatctggctttctcacagcgtggtgtccaaagtagacgtttcttccataagggatgttggcgtcgccccctcgcccccacaggcggattcaatgtagtatatcaaccacgggcgaaaataacggccttgcatgaagattctaggaatggtctcgaaccgtctcaaaggctgaatgctgtctatagttctccccccgcctcgggacagtttatatagagttataataagaatgtgacaccacgcccccggactggtaaagatctacggtgtccaaaaacgcccggcacaatcaagagttctgagatattcatatgggggcggacaccacagatgtttacatcccctaaaaactccccccgctcaaagtaccccccatgaacaatttccgcccaaaataac

SEQ ID NO: 624043 - DNA, 899 bp, Homo sapiens
ttcccctcatttttattaccaacaaactgtctgcccaacttcccccaaatgtggccctccccctttgctatagagacctatatctgcgtatatatctccgccgttacccatgggccccccttttccgaaaaaacctgttgtactctccgctccttttaggtctcccccagccatgtgtaagcactctttttacaagggaaacggaacctttttctaagccgtccccgacaaaaagacaccctcgtcataatccaccgcacatatcattatcctggcccatgcccagaggaaaaaagaaaatggttatgctgccgcgaaacaaccttttccggggaagaattcctcagggtccccccccaacgcaataaaaggggcgtaaaaaatcccacgaaacaacaccaaatatgaggggtttaaggaaaaaaattttttggcttcgtgaggaacaaccacgcccttttagtagacgaggggatatcttagtgcaagataccaggcaatgtgtcctcagaagaacaaactgctgaagtttttgagaaacaacagcaggcgcgacccccgtatgggcaaacgatgcagaacaaggttatttttgtgtagttagatagctgcgacccccgaaccccttgtggcaatctttccagggctccaaagccaaagacatcttgtgagataaagagacggtattatcaactggccctcacaacaaccaccacgatagtagccgcttgtaaaagacagcgttgtgaaaccctttgtcagtgttgcctcctagaggaaaaaaaagttttggtgttgtgagttaatagacccaaagtgagtcttggtagaacgtatacgtatccgcgctccttataaaagttgtccccaccccccattaaaaaacaccggacataaca

SEQ ID NO: 624044 - DNA, 286 bp, Homo sapiens
gagattatgatcagtcgacacgctcatatacacaaaggcccaaagtgcatgtgccgagacaaatccaagtgcggtctatgctgaagtgcgcactgaagtccagcggtccgtgcttacagcagtgccacaagtggggattccagggaccaaaaacggtgccctcaagggcaggcccagcaagcagtggcagtgcaagcatccggggcagcagcattcatcacccaaagcaaatcgaagccatttttcatcctgtatgcattctcaagcatgcatgcaggtgtgcagt

SEQ ID NO: 624045 - DNA, 658 bp, Homo sapiens
tccgagtaccccggctgagaatgttggtactaacaagacttctcagctaaaggaggatgttcaaacccatcgcaagggaagctaaaaacctcgaaaaaagattagaccaatggccaactacaataaacagtgtagagaagaccttaaatgacctgatggagctgaaaaccatggcatgagaactacaggacgcatgcacaagcttcactagccgacttgatcaagtggaagaaagggtatcagtgattgaagatcaaattaatgaaataaagcgagaggagaagtttagagaaaaaagagtaaaaagcaacaagataaagcctacaagaaatacaggactatgtgaaaagaccaaatctacatttgattgttgtacctgaaagtgacggggagaatggaaccaagctggaaaacactcttcaggatattatccaggagaacttccccgacctaccaaggcaggccaacattcaaattcaggaaatacagagaactccacaaagatactcctcgagaagagcaaccccaagacacgtaattgtcatattcaccaaggttgaaatgaaggagaaaaatgttagggcagccagagaagaatgtcgggttgccacaaagggaagccatcagactaacagcggatcttcagcaaaactctaca

SEQ ID NO: 624046 - DNA, 1026 bp, Homo sapiens
  misc_feature (810)..(810): n is a, c, g, or t
gcagaaggaggactacgtgggggacgtgccaccagaaccctacttaggggtcgggtatgtcactccgaggtcaaaatctgctccgaggtggacgaaccgttagctccccgacttggggctcacctactattgtggtgttcgacgtctctggaggtgctggaaaacaggctccgaggttgatccatagtggctggggtaacggagaagggaagcgtgggctcaccgttccggtagctattgtgatagctcatgtgagcagacacgatgcactcaaggtgtgtgcacgctgggtcgttccgattatcaagcatgatcgcttcttgtgctatgctctacttgcgccatcaaggtgggaatcccgggagaattgaggtctcctatgatatgagcatctcggaacacttctacttgcgtgctagaaaatagatagcatcctgaacgggcttcgtgatggagcatccacggttgttgcgttgttcacgtcctctcaaagcccagataagatgacttagatcctttgaacgtgaatactgacatttgagctttgtcctcaaagattcaagcgtgctttgattcaggcaatgccacagactaggttaacaaaacaagggatactcaggacaattcttgcgatggtatctactgtctcgtgagaaaaaatggacactggttcagacaaggctgattgaaataagatctaaggaagttacctggatacacgaaagaagatgccaagatgaacacgttaagagcctacgttgtgatatttaaactgattgcacataaaagaactattgagactttggtganagaaacgagagaagaaaaggaacaacatcacaagggggcaactcaaagtacctcaggggtaggcagaaagacaacgcaaggttaagagcaagagtgggccactagtgactccgaaaacacagaatcgcagaacacaagcagtaacaaggacagacaagaggacagaacatagggagagccggataaaagagacgaactagacacacagagaccggt

SEQ ID NO: 624047 - DNA, 379 bp, Homo sapiens
ggtacccttcatgtacggggagttgtaacaaactcctagttgacacaaaatagactacgaagagtggctattatcatatctgaacacacaattagctaagacccagagctggctattagataccccacgtatgcttatgccctcaacctccacagttaatatcaagcaaaactgctcgccagatcactacgagtccatagcttattactccccggacctggcggtgccttcatacccctctagaggaacctgttcatgtaatcgataaaacccgatcatagctcaccacctcttgctcatcctatgtatccgccatcttcagctaaccctgatgaaggctacaaagttatgcgctcatggtacccggtaacaatgcccg

SEQ ID NO: 624048 - DNA, 132 bp, Homo sapiens
ctaaatctgtcatcatttctcctcctcacatctgttacgtatcctcaccaatttatagtttaacaatctgtccacttcccaacaaatacaatacgaggctcagggtggtggtttatgccgtgtaatccctgc

SEQ ID NO: 624049 - DNA, 846 bp, Homo sapiens
gattcgtgtcctggatgttggtgcggaaggagtgtgaaaactgcagactgcctgcagggcttccagctgacccactcgctgggagggcggcacgggactccggcatgggcacgttgctcatcagcaatgtgcgtgaggagtatcccgaccgtatcatgaagaccttcatcgtcgtgccctcacccaaggttgtccgacacggttggtggagccctacaattgccaagctgtccatccaccatggactggttgggagaacacggatgtagacctactgacatcgcacgaatcgaggcgctctacgacatctgtcttccgcgaccctcaaagctggccacgcccatctacggggacctcaaccaactggtatcggccaccatgagcggagtcacccatctcctttgtgcttcccgggccagcgtcgaacgctgagcctgcgcaagctggccggtctaaccatggtgcccttcccctgagcctgcacttcttccatgcccggcttcgcaccccctcaacaggccggggcagccagcgagtaccggggccctgcagcgtgcccgagctcacccagcagatgtacgatgcctaagatactatgatggccgcctgcgaccgcgcgccacggctcgctacctgtacggtggccaccgatgttccggggccgtactgtccagtgaaggcaggtggacgagcagaatgctggtctatccagagcaagaagcagccagaatagcttcgatggaagtggatccccaactacgtgaccatgtggtcgggtgttgacatcccgtccccggggctccagatgtactcgacctttcatcggggaacagtacgggctataca

SEQ ID NO: 624050 - DNA, 225 bp, Homo sapiens
aaattcgactcgtaccccaataacactttcgcagctttcattggaaaaatcggattctgcaccattttcgcaaatagatgttatggtgtaacaataggttccgtattctaatccgctgtcggtgtagctcatctcggtgatgccgcttgcaattagaacattattgcgatagatattgtaactcatatctcttgtctctgaaacttttgttgatggaatcttaag

SEQ ID NO: 624051 - DNA, 125 bp, Homo sapiens
  misc_feature (98)..(98): n is a, c, g, or t
agagagagaagaactagtgttttcctacatcccttacatttacagggtttctctacagtgtgagcagacaaccagaaagattcaactgtccaggcttnctcacattccttaattgcggggggggg

SEQ ID NO: 624052 - DNA, 663 bp, Homo sapiens
  misc_feature (50)..(50): n is a, c, g, or t
  misc_feature (91)..(91): n is a, c, g, or t
  misc_feature (100)..(100): n is a, c, g, or t
  misc_feature (102)..(102): n is a, c, g, or t
  misc_feature (130)..(130): n is a, c, g, or t
  misc_feature (146)..(146): n is a, c, g, or t
  misc_feature (165)..(166): n is a, c, g, or t
  misc_feature (171)..(171): n is a, c, g, or t
  misc_feature (177)..(177): n is a, c, g, or t
  misc_feature (185)..(185): n is a, c, g, or t
  misc_feature (188)..(189): n is a, c, g, or t
  misc_feature (194)..(194): n is a, c, g, or t
  misc_feature (223)..(224): n is a, c, g, or t
  misc_feature (231)..(231): n is a, c, g, or t
  misc_feature (241)..(241): n is a, c, g, or t
  misc_feature (243)..(244): n is a, c, g, or t
  misc_feature (276)..(277): n is a, c, g, or t
  misc_feature (301)..(301): n is a, c, g, or t
  misc_feature (344)..(344): n is a, c, g, or t
  misc_feature (348)..(348): n is a, c, g, or t
  misc_feature (352)..(352): n is a, c, g, or t
  misc_feature (406)..(406): n is a, c, g, or t
  misc_feature (418)..(419): n is a, c, g, or t
  misc_feature (422)..(422): n is a, c, g, or t
  misc_feature (424)..(424): n is a, c, g, or t
  misc_feature (446)..(446): n is a, c, g, or t
  misc_feature (581)..(581): n is a, c, g, or t
  misc_feature (592)..(592): n is a, c, g, or t
tttttttttaaggaatatataattcccaataagctcttctttttaaaggngattaacagttctagtgttcaatttcaaaatcaaaatgatntcatatcangngtcattaaaagacaaatgccaaaccatntttgcctacacaccantgccttttccctttttttnnttttntttgtncatatganagnnatggntttttttgttgttttcaccatctttaagnnccctgancaatttttgntnntataagggctttttacttcagtttctgtcacnnataaaagctgtgtgtcgagactgnagattatccactatcttctcttctatctctacgcctttttctntttnttcntctgttagcaataacttggtttccgagtctttggttacaataaacacaaaggantgtcgtgactcnnggntnttagccaccaccacttgatgcnggtaaatttccaaagccttccgggctcgattaattacaatgggggggtcagtctccaacttaaaggaaattataaatgctttgggagcccaatctttaaccaaaggagaaagcagttttggcaccatcttcattnttatctgcagngggcccccagatgactggatcttgtgttcaggcatttcagagacaggaacatagaaatctgacacagccgc

SEQ ID NO: 624053 - DNA, 480 bp, Homo sapiens
ctatctggtctagctgttcacgtgtatcccgcggcagtgtagtccatggtcttggatcattgcgttctccagcgtggtacgtatagtctctagtgtcgctatctcttttcgtatgcgtttcgcagattcagctccggtacccgtatatccacactcactacttcagttgcatcatgctgtacctttttgccgaggtctatacggacgccatccaagaacagatcacaaggtaagcgagcagctaattttataaatgcttcaacaggatcctcctccctttcatctttaatataacctctttatgctttacagtgttcaggtgaaaatccgtataggcatagaataaaataggtaatatagagacggagtgaagctctgtcactcagtctgcagtacagtgacgccatcttgagtcaatgcaacctccgactcccaggttcaagcgatactcgtgccttagactctcaagtagctgggatt

SEQ ID NO: 624054 - DNA, 257 bp, Homo sapiens
caccgtcggcctcccggactcaagtgatcctcccgcctcggccccccaagtagctgggactgcaggcatgcaccaacacgcctgactgatttttgtaatttttgtagagacaggtttcgccatgttgtccaggctggtctccaactcctggactcaagcactcccctggcctcagcctcccaaagtactggcattacaggcaggagcccctacacccagctgagtcaatgttctttaataaattccattcgtattta

SEQ ID NO: 624055 - DNA, 908 bp, Homo sapiens
  misc_feature (640)..(640): n is a, c, g, or t
tctacaaaccacaaagacattggaacactatacctattattcggcgcatgagactgcagtcctaggctcaggtctaaccctccttattcgagccgagactgggccatgccaggcgaccttctaggtaacgagcacacatctacaagcgttatacttgtcacacgcaccatgcactttgtaagtaactcttcttctatagctaatacccatcataatcgggaggcgtatgtggccaagcgtgacttacggcttccacctgaattaaatcgagtgcccgcccgcatagtggccgttttccgccggcattacaacaaagcactaatgccattcctgcactcttttaccatccctctcgtcctactcctgcttcggcatctgcatactagatggaggccggatacacggaacacggattgcacaacaaggtactacgcctcccttagcaagggaaacatatcatcccacccatggaacgccttcccggtgagatcctaaccagtcttcgtccttagcatccataagcaggtgtctccctcttatctagaggaggccagtccgattatctagtcagcgaacgaattatcaattataaatacccgcgcgtgcccatagatccaataccgaaacggccccgtctgcngtctgatccgtcctgaatcacagcagatcgtaacttgctcggctaaatcctctcccaggtccctaagtcttggcttgggcattcactaatacgtactagacagaaccgcgaactctgtaacagacaaccttcattcgaaccccggctggaggaatggagtaccccacgtgctgattatccaacatcttattctgaatatcggggcaaccctgaaatggatattcttattccaaacagggtttggataattcccaattgtaacctcacc

SEQ ID NO: 624056 - DNA, 252 bp, Homo sapiens
  misc_feature (195)..(195): n is a, c, g, or t
ccgcgggcgtgggttagggagtttcgtttgaacagcgacgttgggttcggccgcagcgggctttatttaagctccataacaaatttttacttctgaaaaaaattttgttatagttatctgtatatgagtgggcgtgatatttcctacagattacctagtgcaacattagcatttaagatggggcggagagcgccngtctctatacgagtacaccgtagcgagttcgtttggtatgtgtaaataacagcagtg

SEQ ID NO: 624057 - DNA, 158 bp, Homo sapiens
ccccaaacaaaagggcatgggggcccccaaaaaaatggcacccccctccaagccaaaaggaaaagcctcccaatgaaccccccccccccctggtggcccctatgtttttgacttccagcccccagactgtgaaaaataaatttttgttggttcaccca

SEQ ID NO: 624058 - DNA, 199 bp, Homo sapiens
taccagcctgggcgacagagtgagtagaaaactactatctcaaaaaaacagatatatataacaataagtaggtaaaacaccaacttacagtaagcctctaaacttcacagaaaaagcgtacaatcaaagttaatgatgtaaaattaatatatacaaagggatagtaaagacggggcataataccactacccccataagc

SEQ ID NO: 624059 - DNA, 137 bp, Homo sapiens
gataataacaaaccttatacatactgttttttcctatgcatacatacctgtgattaagtttatgaattaggcaccttaagagattgacaacaataactaataataaaatgtaacggttatactgtaatgaaagttga

SEQ ID NO: 624060 - DNA, 1180 bp, Homo sapiens
  misc_feature (242)..(242): n is a, c, g, or t
  misc_feature (494)..(494): n is a, c, g, or t
  misc_feature (498)..(498): n is a, c, g, or t
  misc_feature (501)..(501): n is a, c, g, or t
  misc_feature (531)..(531): n is a, c, g, or t
  misc_feature (565)..(565): n is a, c, g, or t
ggtcacacgtgagcacatctgtacacgtctcgagtcgtaactgccgactgggagggtgcatgagggatccgagacgggacaaggtagggtgctccatggggatcagttatcccttccccggccggaccttcacttgtggcgccttgcccgtgggacagccagagcttccaggggctttcgctgcgaccgtctcttgaatgcgcccggcaagacacactcgccatgggcgcttggtatgtagngacttcaacgttgcttggtgtccaagttgcaatgaggactaactgggaattacgcagttctgggagtggtctgctactggagtgagagcttatcatggaggctcgaaccttgccgactggtattccaatgtccatagacaatggcctcgtcgccgaattcgagcacgaggccgacgcgattaccgatcttccccagtctgtgacactactgcacagtcgcagcttgtagcgctcgtcgtacgggagcccagncatntcngacgagagagaggtccgaggcagcgcgggnaagacgcctcttcgccgctcgaaaacgaggcagngagcgaccccagcatccgcggctccgaaggggccgcgcgcgcgctcgccgcactgctgcgctgcctagtgctcaccggctttggaggctacgacaaggtgaagctgcagagccggcggagcgcccccggccctgggcccggcagctgacgctgcgtctgcgggctgcgggctcacttcgcagacctcatggctaggcaggggctgtacgaccgtctcccgcctctgcctgtcactccgggcatggagggcgcgggttgtgtgatcgcagtgggccgagggagtcagcgaccgcgaaggcaggacgaccgcgtgatggtgttgaaccgggtcagggatggtggcaggaagaaggttgactgtgccctcggtccagaccttcctggattcctgaggccatgacctttgaggaaggctgtgccttgcgtcgtcaatttacattacagcctacatggtccttctttgacttcggaacctacagccctggccaaagccgtcttggtacacatggttcagggggtgtggtatggctgctgtgcagctgtgccgtacagtgccgatgtgaccagtgttcggaacggctcgcccagcagcacgagcactgaaggagatgggtc

SEQ ID NO: 624061 - DNA, 83 bp, Homo sapiens
gggccttgtccttaaatgcttcccccacctgttttcaataactcgggcatagaatgggccccgtaaatatgtgttggctgcca

SEQ ID NO: 624062 - DNA, 609 bp, Homo sapiens
cactcacactattgatgactacactgaaaagaagaaagaaatgagaaagcacgcacatgtatgaagaattagagagtaaaactagaagcagaaaataacagtaattcagaatacttcataatattaccaattcggccctcaccatttctccaagaagccattaaaattatccatcactgtttggatagaaactgaagcaaaaaacacaaatataatctggcttaaattacccagaggttattgagatagagggctgacagtaaaagattgtgtctaggatatagtcttatcctatttcagtgcagctttccttactgagagtgaaacaggttggttttataaatctttctattaagggaaatttctgctttcttggtaaaaggcccaaatatgactgtgcctgaattagatttctttaatttcagaggtaaactgtagctcaccagcagatatggatggaatcagaaagggctggaaccaaggaaaatgtatcagtatggagctgttgtaactctggagtgtgaagatgggtatatgctggaggcagtccccagagccagtgcaatcggatcaccaatggaaccctcccctggcggtttgcgatcccgt

SEQ ID NO: 624063 - DNA, 151 bp, Homo sapiens
aaacaatggaatcaagctgtcttagtggtcttagttgatgagatgaagtactggcaatatgaaatcacttctaaagtacaaaggttggatggtatagtaaatgaattgagcatatcagaaaaagatgataccgatccctctaaactaggag

SEQ ID NO: 624064 - DNA, 1262 bp, Homo sapiens
gaaccaggccctttggatctgcatgccctgggttctgcccgcacgggaaatcggcctatgttacgttgcccgctgcgatccattggacttactcctaactctattaatcgcctctaagcacttctgtcttcccttcagggtcgatagaatttccttatcagtagctctcatttacacaccactgtcgcattcttaaatactggacaacatggcgtgatctcatcgccctactttatccaggggatttgggttgacttaattgctccactctttctctactcagagtctggtgactgacctggagactcagtaccgaagtatgaggatacgtgataggttatcaagacagatagggtggtaccaccatgaggcataactcgcaaatggcataggtgctaggtcctggatgccctgggtgactggcgtgagatatcatcttcctgaagggactccctggcttcaatgtcgcgagttaaagagagccttgtgacgacccaagcgtacttactgaaaagtgagcccctttgacattctgctacatacgtggactttcatggctatatacggcctacttccgctacgcgagaccacaaataatgggctatggcattactctatgtaaccttaatgccctaggtcaaaggtcccttgtgggagcacgaaaagtggtgagacactcaaagacgtcttgtaaagtgaactacgcagaacaaagagaaacgacgttggcacaaaggaaacaaccaggataggccaacaatctcccattggacatacattcgaactggggggcacccatggcatgggagacaagaacccttataggaccccaacttaacaggggggaggcgtaagacaccaagggagggccgcggaacttataaactaatgagctacaaacagggcgggcttggaaacaagcgcgtaaaccacaagagagaggtagcactatcaaggtgccgaaccatcggatgcaagagttcggaggggaggttcttcgggaccccatggggaatgagaaacccgggcgcgattggcgagggaaaagcaccgacgtttggatggggacagccagataccaccagagagggcaacatcaacggggagctcaactacgtgagacacaaaaggcacaaggggaaccattcccaggcaacaacaactggggtccacaaaagaactcgcccagagtcggggggagaagacagaggagtgaccatggatatagcacacacgcttgacaacccagcatggactaacga

SEQ ID NO: 624065 - DNA, 81 bp, Homo sapiens
ggtggtggaggaggaggtcgtccttctcgatattcgtgatttcacgcagacgatcgagagccagggtgtcaggagtccggg

SEQ ID NO: 624066 - DNA, 384 bp, Homo sapiens
gcaaagttattcgaatggtatctgttcattttagtgatactaaatcacaactaacaactagacaaatcagagtttgccagtatcaaattcagcatggctgcagctgattaagaaattgatatgatatattctattgctagcctctcttactaatggaattatatactggccagtaaaatgggcctcccaattgctgtttcagcaggtttgaaaccttcaggaacaccagttaaggaaaatagctccagaaaatatcgatatattttatttttattaaacatggcagtctacatcataattggcatttctcaagactgtctttaccagaatctgtgtgaaataaggcaatctagtctccttgacaagaaaatcccttggatgttt

SEQ ID NO: 624067 - DNA, 302 bp, Homo sapiens
tgggtcccctccaggttataaagggggcatgtcccctgctttaaccctaaagggcaggtggtgggccatggccatggtccccagtttaggagcaggtgtcccttaaaacccaaacttcccaaagagtttgtgagaacccaccaatgaaaacagtcccctcgcttttacccggtaagttaaccgtcaaaaaattagcatgaaacccgtttagccttgggaggaagctcagatttttaaagcttttttgtccccccccaggatttacctgtgtgtaagtccccattaactccccttctcttcca

SEQ ID NO: 624068 - DNA, 372 bp, Homo sapiens
ttcctccacttctagctctgagtttgttttcattgtcaaggtgatggagtctgttctgtctaccatcacaagtctgggatgtttcatcacaaggatcagtggccgagccatgaaccttcctcgcttacttcattcctctgcccctctctggtgctgcccggctcagatccctgccttcggcccagggctgcctggttgtgagggctcagctcagcagccctggcaaggtcaccagctggagagtcttcctcactgtagccctgtagccctctgctgccctggccactgaaactgtcctctctctcctgccaaccccagaaactcaagccagtggattatgagtaccgagaagaagtccactgggccacgcac

SEQ ID NO: 624069 - DNA, 305 bp, Homo sapiens
  misc_feature (5)..(5): n is a, c, g, or t
ggcantcgaggacattctagtaaaccaagtgacagagaatttcaaggtagcacgtgataagccaaaaaacggtaaaaccactgaatcaacacatggaagtcacctggtgaccattatgagctgttttatgtacttactaaccatcatcttagatttcataactcagtacctgttaggttttctgctccttttgaagatcttttattttattctgttggtggctagccctacttagtgattcatcctccaattcaccaattttggatttcacactttccatcatttgttccaagtcattagctcgt

SEQ ID NO: 624070 - DNA, 85 bp, Homo sapiens
gattcgagctggctccctttcaccagcaaagacaaacatactaaagaactaggcccctaatccacctcctcaatggtagggcctg

SEQ ID NO: 624071 - DNA, 180 bp, Homo sapiens
  misc_feature (67)..(67): n is a, c, g, or t
  misc_feature (174)..(174): n is a, c, g, or t
acgaggagaattaatgaacgggacagtatcggatagttattgaaaaactaagctatcactccacttngagcacgtacagacaaaaataaagatggagacccaggttatggctgcctttcaacctggagaatcagcccttataccagtaaggtcgattcacaatgcaagccgtgncaagaa

SEQ ID NO: 624072 - DNA, 222 bp, Homo sapiens
cctgtatattgacgcgtctccttctcctgtagagacatgttgctatgttccataggcttatctctaatctgggctcaagtgatcttcccatctcagcctcccaaagtgctggctgggattacaggcatgagccactgcacccagttctaaagtttttttttttttttttttttttttaaaaaagaagtgggggtcctaataaggtgggaaaggggggtcaaa

SEQ ID NO: 624073 - DNA, 122 bp, Homo sapiens
attccacccttcttcccccaccttgcccgcaaggcagcccaccccgacttgagatccaggttggagaatcctgctgagagcgaacagtaggaggattccccaaagcttccagcttgccacct

SEQ ID NO: 624074 - DNA, 1549 bp, Homo sapiens
tactatccggcgccgagccggaggggggaaacggcgcccgccgcccgcccggagcccgagagcaacccaagatagcacacacccacaccagagcgtggcgggcgacagagaatccacagagagcaaacgaagggacacgcacaccatcattcacgagacatcagcagtgaccaggagacagattgtcagacatccgcgcggatgagatgcagtggcgcatcgtcaacgaaaacgacaagtaatgaacacgtgatgccgtgccatttgcctcgacggacacgtcactacgcaggcgagatccaggatacattcatatacacatggactgacatgaccaggagaacacttatcaatgcgagaccgactgcacgaagaagaagaacgaggagacaaacaaatagtattagagaccgtatcagaatgggtagattaagtgattgaggacagcattacgaaaaatttgggaaggaaattgaaagaactagttagggactctagtgtttgaaattgatatttaggaatcgtccatataacggggaaagaaaagtatatatggtatacacagaaagatgaatcaagatgtgaaaataccaatagaataggaatgcgccacattactaaagacataaaccaaagcgaaaaaagccaaaacaaacgacccagagaagcaaataaccataaaaaaactcaagagacaaaaaattacccaacattcagacagctacaacatccaaaacccgaagaataccaactgcaaattcacaaatgagacgaactaaacaccgtactacaaaccaaagaggagtgacaagaaaatacgcagcccaacaaagaagacagacgaacaaaagaaaggacaagtccattacacaggaatcgaaaaacagacataacgcaccgaagaatggcaacacaaacgcttaccaaacagcacactaggaacgaccaacagataccaagagcgaccactttgggcactaggcgatatgcagcaccaaatgaccacacaaaacaggcctaagcacgacaacaagggaaaaagcaacaaagacggagacctcaccacacaaccaacaatcacaactcaaccagaacacatgatcacaagaaacacagccactagcgactaaacacatagacaacaaacacacgtacaacgagacgtccaggccacccaagataactatacaaagggcaattagaacacgctaaaaccgccaaacagaggacaaaaaagcaccacagtaaaaaaccaacaccaccggaaaatacaaacacccataagagcgaaagtgaaacactcgaacacaactgaataagaacaactatgttaaagaaacacattattgacaagttgacactatgagaaaataggaaaagggaagataatattaaacgaagataaaaggaataaggaatacattagattatataagaaataaggtacatttaataacattaacaaagttaataaaatatatataaaaaaaacacaagtataaaatatcaatatacaataaaacaatttttatcaaaataataagaaata

SEQ ID NO: 624075 - DNA, 172 bp, Homo sapiens
atgggtgctccatcccccagtgtggtgagtggtaagaagttttgtcatagagaggtgtatgagttggtcagtttgcggagatcggggcgtatgctgtgcgaattcataagaacagggatagggcaaacccaaccccagagcgtggggggatggagcacgcaatgggtacccg

SEQ ID NO: 624076 - DNA, 240 bp, Homo sapiens
caagatctctgtagattcccatgggggttggggcaggcgtcacatttcagtcaccactcgctcacctcttagagttatcctctttttccatagcactttgtcgccataccctttcttccacaaaagcatctgacaaaactgttgtgtacagtgaggacatgtacgatgggtgatggcagcagggcgccctttgttttatggcatagaacctgaagtccctttttaatggtatactagaaa

SEQ ID NO: 624077 - DNA, 869 bp, Homo sapiens
cggagataaacaagcaccgagacgcgcgagcagcgccgaatccagacgcgcccagtcagacccgcaggccgtgtgtaccgagcatgcgcagagcccgcccaagccaggagcagcgtccacctgagactcccgagacattaagaaattgcggaatgggatgagatggtagaggggctagagctacctccaatgctttatcctgaggcggggagtgaaggtgagagatgcccgaatggaccaagaggggccgccgatggccattgtgttcgagtgccacccagctctgtcagcactcctagaagacttttggttttatctagtgtcattcacgcaatggtgaagcctcttcaagtgggcgcggcgcgagcataacgaggcgttcgtgagctgcacagtttgtcgtaaaccgcaaacgaaatactcgagagcgttggggaggcgttcagggacatgagatggagagaaggggatgagcgacgcccacactactgaggcaggcgacgtccgagatgaggagcgaggtacacgatggctggactcagcaatcagccaacggagcagtacgtggctccagagaccccgcgtgaacgttcgacccgggggtcccctgggcgcaaacgcagaccgcgtgctagggaagccgcagcctcgaagagtgtttgcgtttcctaaaggaacccgctggccccacgcttgataaccgagattgcccccagagcaactgtgggaccaggtaccgaaagcgtgactttaccgagctagtggccactgtgtcaagtcgcaccgggggtagaaagttaggagagaaagcttggggaggatagcggggagatcgcccggaaagagggcatagggcgggaaaggggccc

SEQ ID NO: 624078 - DNA, 1101 bp, Homo sapiens
ggcggtgcagtcttgggcggcccagcggatcgtgccgcggcggtcgagcgcagctacaggagggtgtccatgaaggccacaagccatggctgtggggaacatctaacgagctgcccgagaacatcctgctgtgagctgttcactgcactgttccctgcccgccaggcgtgcttgcttgaactgccgctctggttctgcaggcctactggcggggaccctcagtcgatccatcggtagacctctctggaatacgcaaagtgccttgccgagatgaggcgcttctatctacgttgaagtgactttgtgggacgcatgctcgcatgtgggcctgacagttgggaagaatcttatcgtacttctcttgtacgtggatgcacttgcgaccaagggaaaacacttcgcgttgcgactcacactccctggtcgcctgcctttgcacacggaaggggagagtgtctagcacgtgtccttcgggcacgcccattgcggcattggtcgcaccatttgggaaggggcccgaaattgcaaggttggaggacaaggggcttggcgggaagcgggacagttcccttccggtacccctccccggaagcgaaaacccccatgtgaagccggcaagcaagcgggcaacaaggtttcgtgcgccgcggccaaaaagttggcagaacccccgaagggaggatataccggggcgcaggaggcgcccaaggggacccgcacaaggacacttggggcccggagtgggtttcagccgaaaacaggagttaaaccgccgcaagaggacccgcgtctgggtttcggccccggggtttaatccaaagtaggtaggtctacccccccattggggggttcgaggggtatacgccgtgggcaccagggaccccgaacacagtagagacacggcgccctctaggtttccccctatggaaggggcgcactgtggaaaccccggccacttatgttcccgccccgaaagggggaccacccctcaaggggcggaaaacaggcccgccccggtgagggcgcgcagggagaaaagcgggcgcaaaggtgttcacccccaaaggggggtccccaacgaggatgaaataaagggcaaag

SEQ ID NO: 624079 - DNA, 391 bp, Homo sapiens
ggctgtcctgaggagggtggagcccctggtgctccccttagctgccactacctctgctcattgagccggcggtacttctccctgtcagcactgtgtgatcttcagcagcggtcgtgcaggtaggtcgatgtgatgtagtacctatcacattctggttaatccacgtagacatcatacagctcccgaatgtcatccatcgaatatcttcctcttgtggtgcctgtggaacccggtggttaagatgacggtgggaacctccagccccgtaccccgactgggaaacaaaggcgcccaggagccctgtgtctggggaggagcagggctgagacctgagcgtgaaagatgcatgggacgggccccgtactcacaggccacataggacagctcttac

SEQ ID NO: 624080 - DNA, 1023 bp, Homo sapiens
acgtatcctgtgccggctcctcgggtagtcgtccgcgcgcggtggccccgggacggctatgctgccgggggtcggggccccaggcattccagtcgctgcacgattgacaggggatcccggatactccgcgcgcaccctgcgcgctcaccgaggggtcctatgacctggtgggaagaaggtgcggggacgggtcccatgcagtgatcccgacttgcttacgagccaagatgcatcatcctttatagtgtgtgaccatacgaacatgtgacgtatcaccgtctagcttttgtgatccgttgaaattggacaagagttcggagacgctatcttcatcatgtgtctgtagacgacggacttaaactgaacagcaaatgtcttgttacataggtctcttttggctgggatggggatgccttcggaaaggcctagggccctgggcacgagcatgaggtgacatcgcttgctgttcaacacatgcgggtactcacgagttccatgcgaatgacaggatgcccccgctaggaagtcatggacctgctcagtgtgtggaaattgccacgatcgcccattcgtgacccatttcatgacagagcctgcatggcccgaaggaattgagcataacgcaggagaggttcggagggcccaaggggaccggtacgtaatagtagcgaagtgaagaaacgtcctgggaatttgggcaatgcgccaattgagtgacaatccaccgaggccttaaacccgcacagaccacgggtaccgtttcaggaattcccggggcgcaatttgcgagattgcgcatgaccaactggcataagggcagtgaaaatcgcaatgaattagtccgggttggcgccccacaaaggaatgaggcgaggttcgtgaaaacgtaggccacttttgccgtgggtggccaacacggggcgggaaggtcgttcgtttgaaaaccgaacctcacccctttccaacggggggccccgtaacccgccctccagtccgtcacccccccgaagtgcatggcaccga

SEQ ID NO: 624081 - DNA, 787 bp, Homo sapiens
tggtcccgacttcttgacgaggctgcggtgtctggctgctattctccgagtccttcgcaatgccgcctaaggacaacaagaaaaaaaaggacgctggaaatgtcggccaaaaaagacaaagacccagtgaacaattccgggggcagaggccaaaaaagaaagaaagtgtggtctccaagaaggcaaagtttcgggaacaagcctcaataactttagtctcgtggtttgggcaacaaagcttcaccttagtgaataacacctcgtgtagagggaagtccccaacttataaacattttatacaccccgagcgtggtggctcctcgtgagaagacacgtggaagaatctcggaggcctccgcgtggccccgaggggacagccccttctcgaggagagccctccttatagtataagaggactttatctcaaagctgtggtttctcaagagcccaacgagaagccttcagagtataatttatacacccgagaaatattcaccagagggtgtggaagaagtggcctcccagggcgtgcgtggttgtgacagatattgtcgatgtgcataattgaggtctccaacaccgagggcgtggggtacctgttgtgcgcaaacaaagtttaacaaatgttttatgttaaaatttccaagagaagagataaaaagaaaatagaaaaagaaaacaccgtgggggagggggactctattaatgtggtgggggggtgtgcggggagaaaaaaaggggggttatgttgagagagggggcgcccagatggggggtcttaataatg

SEQ ID NO: 624082 - DNA, 292 bp, Homo sapiens
ggcccttggtaactggtagtcagtgacctggtgcccagacatgaagcttacatggtgcggtggctgcaggtcttggcgccttatcggaccacacgggacgcacccactgcttcagcccagtccttcccttcctctcgagtccgcttagagtacgatctgactgcagagctcattgacaactgccgctgcctcctagggtcccaactgttccactttggcctgcctgtccttcacaacttcttcctcctcttcatcatcactgaacttcagtatctcagaatagtccacttct

SEQ ID NO: 624083 - DNA, 462 bp, Homo sapiens
  misc_feature (455)..(455): n is a, c, g, or t
ggcacgaggttttttttttcctatctactatgaaagcacaaaggattgggtgagaaaaggaaaggaaagctttgcatgtgagacagactcagttcagtaatccagcccctggttccgtgcaggggttcggaggctgctgaccctaagggctctgtaacacagcactttcagtttgtacatacgaccagttacacacaatttacacccacaggctctgtgcgagcctctctcagcagccccgcatcgccgctgcgggacagccacgctgggaggcgtcgctcgggagcccggccgtccctcttcaggtactggcgcgggggaaacgcttccagccaggagccgcccggcctagcgcgcagagccagagccgcacccgcacctcacctgcgccgccgcggtcccgcgaggtccgggggcgcagccaggcccggccgccccgccctcgcggccgcaancttattc

SEQ ID NO: 624084 - DNA, 586 bp, Homo sapiens
attcgcggccgcgtcgactttttttttttgagatggagtttcgctctgtcgcccagactggagtgcagtggcgcggatctcagctcaccgcaacctccacctcccaggttcaagtgattctcctgcctcagcctcccgactagctgggactacaggcccgtgccaccatatccagccaattttttgtatttttagtagagacagggtttcaccatgttagccaggatggtctcgatctcctgatcttgtgatctgcccgcctcagcctcccaaagtgctaggattatagccgtgagccactgcgcccagcccaaagtggaacttgataataatttgtgcggcaataacagaataaaattcagataagctagagactaaggagaagacaggtaacattacaacttagcaggaaatgatgaaagtctagaatgaaatgattcagagaaaagcaagctaaaaggaaagaatcttaagaaaattttctattacttttttcttttacttaactagctatttatcccttaatataatttcaggcaaggcactgaacatttttatttcatattgtacccaaaaattcacattc

SEQ ID NO: 624085 - DNA, 898 bp, Homo sapiens
  misc_feature (2)..(2): n is a, c, g, or t
  misc_feature (891)..(891): n is a, c, g, or t
tnttttggcttgacacaacagaaatttattctctcacagttctggaggccctaagtccaaaatccaggtgtcagcagacccagctctccctgaaggctgaagaggaggacccttccttgcttctctctagcttctggtgatcgtcagctgtcctcggcatcctggggttcgtggcacgtcatgaccatcttggctgctggcaccgcggggcatcctcctgggtcttcacactgccttccctccgtgtgtctcaggctctaaatttccctctcctcataaggatgccaatcactggattagggttcaccatattctagtacaacttcatcttattttgattacatctgcaaagatcctatttccaaataaggtctcattcacaggtcccaggggttaagacttgaacatatctttttggaaagatacacttcaacccaaaagaaagaagctgtgagtttcttttgttctctgtcttttttttttttcccttttgtcatcctggttgttctgtttttgtgagaggctatggaggaaattcaaaatcaatgctgctgccaccatcttgctccaccgagaaccttgtggttgtgttctaggtacccgtttccacagaacactgctcaaaactttaaagaatgaagccaaggcaaaaagtaatgctctagaggtaaaagggagtccttacctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624086 - DNA, 1206 bp, Homo sapiens
  misc_feature (1199)..(1199): n is a, c, g, or t
cggccgctctggcgtgcagggcccaaccccacgtggctgtttctgcagctcctcttggaggcccgggctgcttcccctttgaccaacctgggaaggcccttggcggacgctgcacaggccgacgtggtggccaccagagctgccctggaccctctgaggacagactggccaggacttacctctgccagccggtcaggatgatgccctgcagtgagtccgtgggcccgctgcccgccacctgcagccactgcacgtggttcctgaggtggtgctcaacagggggcacggcctggctgggccccgtggcacccttgaaggcactggctgcccacagctgcggaaagccgcaccgccggtacttctgcatgaggaggaccttgccgtgcacatccaggtcgccgtgtagtcccagagcaccggctccaccagctgcggcaccccggacgctgcgagctggtcctcaggcaggtctcggagcatgtcgtcccacaccaggggtgtcacgctggggcgccgggccttcacgccgctggccaccgcccgcatgtgtgacaggcacaacttccccgtgctgttctgctcttgctgtagccaccggcgcgaggcctccccctctccgaggtaatagacctcatcacacccgatgtgcagccgctgggcgcctgggtgtagctccaggacctggtcaatcatggcgcccaccagcgccagggactctgcctcgtgggggttcagggtgcaggggaaggagcccacctcccgcaggtgggcgaaggccgtgtgcttcagcacaaactccatgtgtccaaatgtctgcaccaagggaatcacctccagctcattgagtccagccagatgcaagatctctttgatttcagaggggctgtaggcgtacttggccctcagcagcctcagagggccctcgtagggaaacatgtcttcatactcaatgaggaggccgtttgcacctagcgcacggaacagaggaaaaatctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624087 - DNA, 1268 bp, Homo sapiens
  misc_feature (1261)..(1261): n is a, c, g, or t
tagaggcctgacgtggtgtgaacaacggcaaaggatgttgctgacaaggaaaggtagccggccgcctccgttaacagggcacgttgtgcgcaaggcttggaaatcgcgagaagcgttctccacgtttcgctttaacatcgtcatcgtatgcctccgcgtagaagcaaactgcaaggcaggcggccaagggacgcgactcctgcgggcagcagctcgcacaagcacagagtagtggtcgtacctctgccagccggtcaggatgatgccctgcagtgagtccgtgggcccgctgcccgccacctgcagccactgcacgtggttcctgaggtggtgctcaacagggggcacggcctggctgggccccgtggcacccttgaaggcactggctgcccacagctgcggaaagccgcaccgccggtacttctgcatgaggaggaccttgccgtgcacatccaggtcgccgtgtagtcccagagcaccggctccaccagctgcggcaccccggacgctgcgagctggtcctcaggcaggtctcggagcatgtcgtcccacaccaggggtgtcacgctggggcgccgggccttcacgccgctggccaccgcccgcatgtgtgacaggcacaacttccccgtgctgttctgctcttgctgtagccaccggcgcgaggcctccccctctccgaggtaatagacctcatcacacccgatgtgcagccgctgggcgcctgggtgtagctccaggacctggtcaatcatggcgcccaccagcgccagggactctgcctcgtgggggttcagggtgcaggggaaggagcccacctcccgcaggtgggcgaaggccgtgtgcttcagcacaaactccatgtgtccaaatgtctgcaccaagggaatcacctccagctcattgagtccagccagatgcaagatctctttgatttcagaggggctgtaggcgtacttggccctcagcagcctcagagggccctcgtagggaaacatgtcttcatactcaatgaggaggccgtttgcacctagcgcacggaacagaggaaaaatctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624088 - DNA, 963 bp, Homo sapiens
  misc_feature (2)..(2): n is a, c, g, or t
  misc_feature (893)..(893): n is a, c, g, or t
tnttttggcttgacacaacagaaatttattctctcacagttctggaggccctaagtccaaaatccaggtgtcagcagacccagctctccctgaaggctgaagaggaggacccttccttgcttctctctagcttctggtgatcgtcagctgtcctcggcatcctggggttcgtggcacgtcatgaccatcttggctgctggcaccgcggggcatcctcctgggtcttcacactgccttccctccgtgtgtctcaggctctaaatttccctctcctcataaggatgccaatcactggattagggttcaccatattctagtacaacttcatcttattttgattacatctgcaaagatcctatttccaaataaggtctcattcacaggtcccaggggttaagacttgaacatatctttttggaaagatacacttcaacccaaaagaaagaagctgtgagtttcttttgttctctgtcttttttttttttcccttttgtcatcctggttgttctgtttttgtgagaggctatggaggaaattcaaaatcaatgctgctgccaccatcttgctccaccgagaaccttgtggttgtgttctaggtacccgtttccacagaacactgctcaaaactttaaagaatgaagccaaggcaaaaagtaatgctctagaggtaaaagggagtccttacctctgagaggtacgagacctttggtggagctcctttaaggtctaaatgaactaatctcatctgaaatggcgtggaacctgacatttcaatatttcctgtgaactcctatggcgaagtctccttggggacttcttcctagtggagaaaatcaagagttatcaacaggggcagaagcttctccctttgcctttctccttatactttcagnttcagttctgatactggccagttttgatagattaacttggaggaaactcattttgctaacatgaaaatga

SEQ ID NO: 624089 - DNA, 1194 bp, Homo sapiens
  misc_feature (1187)..(1187): n is a, c, g, or t
cggccgctctggcgtgcagggcccaaccccacgtggctgtttctgcagctcctcttggaggcccgggctgcttcccctttgaccaacctgggaaggcccttggcggacgctgcacaggccgacgtggtggccaccagagctgccctggaccctctgaggacagactggccaggacttacctctgccagccggtcaggatgatgccctgcagtgagtccgtgggcccgctgcccgccacctgcagccactgcacgtggttcctgaggtggtgctcaacagggggcacggcctggctgggccccgtggcacccttgaaggcactggctgcccacagctgcggaaagccgcaccgccggtacttctgcatgaggaggaccttgccgtgcacatccaggtcgccgtgtagtcccagagcaccggctccaccagctgcggcaccccggacgctgcgagctggtcctcaggcaggtctcggagcatgtcgtcccacaccaggggtgtcacgctggggcgccgggccttcacgccgctggccaccgcccgcatgtgtgacaggcacaacttccccgtgctgttctgctcttgctgtagccaccggcgcgaggcctccccctctccgaggtaatagacctcatcacacccgatgtgcagccgctgggcgcctgggtgtagctccaggacctggtcaatcatggcgcccaccagcgccagggactctgcctcgtgggggttcagggtgcaggggaaggagcccacctcccgcaggtgggcgaaggccgtgtgcttcagcacaaactccatgtgtccaaatgtctgcaccaagggaatcacctccagctcattgagtccagccagatgcaagatctctttgatttcagaggggctgtaatcccagctactcgggaggctgaggcaggagaatcacttgaacccgggaggcagagttcgcggtgagccaagatcgcaccactgcactccagcctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624090 - DNA, 721 bp, Homo sapiens
  misc_feature (528)..(528): n is a, c, g, or t
ttgttgaatttcattattttaccaatatttggaaatttcaggatttttacccattacatcctgtgtctgtgaacaaaatttgtactttttcctttccaatttgcatcctttttattactttctcttgactaattattctgagtagaaattccagtactgtgatgaatagaagtggcaggaagagatgtgctatcttattcctgatcctggaggaaaagattttagtctttcaccattgagtatgatgttagctgtgagcttttcatgtataatctttatttactggaggagtttccatatattactaattctttgagtgtttttattacaaaaggtgttcatctggctctggaaccagataaatgttgacctgatagaatggattggaatgtccccttctggttttttgaacatttttggaagattttgcagaggatgtggcattaattcttcttgaaatgtttggtacaattttccagtgaagttatctggacctggaattttctttttggggggttttgattactngttgaatcttcttactagttacaggtctcttgtggatttttatttctccgtgatgcagtatggtggttgtgttctaggcacttataaattattctaggttgccagtttgtggcatatggttgctcacattaagtctctgtaatctttcaattctgtggctctggtgtcggcactatttattatgattagattg

SEQ ID NO: 624091 - DNA, 1304 bp, Homo sapiens
  misc_feature (1297)..(1297): n is a, c, g, or t
cggccgctctggcgtgcagggcccaaccccacgtggctgtttctgcagctcctcttggaggcccgggctgcttcccctttgaccaacctgggaaggcccttggcggacgctgcacaggccgacgtggtggccaccagagctgccctggaccctctgaggacagactggccaggacttacctctgccagccggtcaggatgatgccctgcagtgagtccgtgggcccgctgcccgccacctgcagccactgcacgtggttcctgaggtggtgctcaacagggggcacggcctggctgggccccgtggcacccttgaaggcactggctgcccacagctgcggaaagccgcaccgccggtacttctgcatgaggaggaccttgccgtgcacatccaggtcgccgtgtagtcccagagcaccggctccaccagctgcggcaccccggacgctgcgagctggtcctcaggcaggtctcggagcatgtcgtcccacaccaggggtgtcacgctggggcgccgggccttcacgccgctggccaccgcccgcatgtgtgacaggcacaacttccccgtgctgttctgctcttgctgtagccaccggcgcgaggcctccccctctccgaggtaatagacctcatcacacccgatgtgcagccgctgggcgcctgggtgtagctccaggacctggtcaatcatggcgcccaccagcgccagggactctgcctcgtgggggttcagggtgcaggggaaggagcccacctcccgcaggtgggcgaaggccgtgtgcttcagcacaaactccatgtgtccaaatgtctgcaccaagggaatcacctccagctcattgagtccagccagatgcaagatctctttgatttcagaggggctgtaatcccagctactcgggaggctgaggcaggagaatcacttgaacccgggaggcagagttcgcggtgagccaagatcgcaccactgcactccagcctgtaggcgtacttggccctcagcagcctcagagggccctcgtagggaaacatgtcttcatactcaatgaggaggccgtttgcacctagcgcacggaacagaggaaaaatctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624092 - DNA, 832 bp, Homo sapiens
gctgctgcgctcccggttcgctggacgggaagaagggctgggccgtccctgtccctgtccccatctggaaccccaatgtctgcgccgctgacccgtcgcaggtgcgagatgagcgctggacgcagcgtgcctggtggctgccccatgaccaccaggcatctgctgcactggatgacagggtccgaacggcatacaggattccacctgcacgtgttgagaagtggcaagttgggccagtacatccggctggtggagccctggctcgccgtgccgagacaggcggggcatgctggcgaggggaccggactggtggaggtgaacggcgaaaacgtggagcaggagaaccaccagcaggtggtgagaccgcctccgagaccgccactcaacgccgtgcacgcctgctggcggtcgaacaccgagcacggacgagacagctgcagacaagctcggcgtccaggatccgagaggagctgacgtgagacgcccaggaagcgcacggggcaggccgacagccgccggcccagcaccgacccgaggggtgccaatggaggcctggccaccgaccacactgagcccatcgccgacggcccgcacaacgcagcacacacgaaccacagcgcgaagctaccggaccacggcacccgtacacatgacacaaagggccccacacggagggacgtataggagctctgcaagccggcacccaccgcgacaaacaccaccaaggccacgggaccagggccaagccagaggcaaagatgggagcgaagaacacgccccagcatagactagcatacaggggagtccgagccccccacggcatcaccaatcg

SEQ ID NO: 624093 - DNA, 707 bp, Homo sapiens
ggactcgggacatgctgctagatgctggggttcctgccgttccacttggctgcgggtccgcaaggcccggccccagctcatcctcagccgccggccccgccgccggctcgggagcctgcgctggtgcggtcggcggcgcctactggcggcggttactgcaagcccaggcggccggcgtggaactggagggagggagcccgccaggtgtcgcgcgcggcggcggccggaagacccaacaaccgggacccccagcccgatccctaggcccgaccccggcctccgaaccccgaggtccgaacccgaactcgaatccgcctcgatgttgccaccgggcctcttctcatcccaccggtgcggcccgtgtgcccctggccgcgcgttgctgctgctgccggtcgcgcagggttctgactttaaggtgggatctgccgtgtgatttgcctctatggccaggtgcaggtatcggggtaaaccaatcagccaagggccagccttgcccaagacatctttctctgtgtatacccacttctggcttgagtatccatgcacttcactactcaccagcctgagaaaagcgagaaggacctgacaggtgacgcccggaatttgctcacatctcatcttaaccttgatgacgggcgttggccgatgccagaattttccccccgggtccgctgggatgcccgaccctttaactgcccgttact

SEQ ID NO: 624094 - DNA, 1096 bp, Homo sapiens
  misc_feature (1089)..(1089): n is a, c, g, or t
cggccgctctggcgtgcagggcccaaccccacgtggctgtttctgcagctcctcttggaggcccgggctgcttcccctttgaccaacctgggaaggcccttggcggacgctgcacaggccgacgtggtggccaccagagctgccctggaccctctgaggacagactggccaggacttacctctgccagccggtcaggatgatgccctgcagtgagtccgtgggcccgctgcccgccacctgcagccactgcacgtggttcctgaggtggtgctcaacagggggcacggcctggctgggccccgtggcacccttgaaggcactggctgcccacagctgcggaaagccgcaccgccggtacttctgcatgaggaggaccttgccgtgcacatccaggtcgccgtgtagtcccagagcaccggctccaccagctgcggcaccccggacgctgcgagctggtcctcaggcaggtctcggagcatgtcgtcccacaccaggggtgtcacgctggggcgccgggccttcacgccgctggccaccgcccgcatgtgtgacaggcacaacttccccgtgctgttctgctcttgctgtagccaccggcgcgaggcctccccctctccgaggtaatagacctcatcacacccgatgtgcagccgctgggcgcctgggtgtagctccaggacctggtcaatcatggcgcccaccagcgccagggactctgcctcgtgggggttcagggtgcaggggaaggagcccacctcccgcaggtgggcgaaggccgtgtgcttcagcacaaactccatgtgtccaaatgtctgcaccaagggaatcacctccagctcattgagtccagccagatgcaagatctctttgatttcagaggggctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624095 - DNA, 348 bp, Homo sapiens
  misc_feature (70)..(70): n is a, c, g, or t
gctcgaccacatttcaaccgtgcccgcttggctatttatgtgtttcgacccactccagtgcggtacgcangatgcaaatccccaggaagtacgccgacatcagcaaccacaggcccagggtcaggcgattggtgtacgggaaatcgatcaccagcagcaggctgcacagcaaccagatagtggtcactgcgatattgagcggcatgaagcgcttgacccggaacggtgcaggaacttcatcggcgtgacggtcaacagcgccaggacgatcacggtgagcaaggtgatccaggcatccggctggatgatgtagacgcacagcgcgaccacgttccaggcggcgtcgac

SEQ ID NO: 624096 - DNA, 1181 bp, Homo sapiens
  misc_feature (1174)..(1174): n is a, c, g, or t
cggccgctctggcgtgcagggcccaaccccacgtggctgtttctgcagctcctcttggaggcccgggctgcttcccctttgaccaacctgggaaggcccttggcggacgctgcacaggccgacgtggtggccaccagagctgccctggaccctctgaggacagactggccaggacttacctctgccagccggtcaggatgatgccctgcagtgagtccgtgggcccgctgcccgccacctgcagccactgcacgtggttcctgaggtggtgctcaacagggggcacggcctggctgggccccgtggcacccttgaaggcactggctgcccacagctgcggaaagccgcaccgccggtacttctgcatgaggaggaccttgccgtgcacatccaggtcgccgtgtagtcccagagcaccggctccaccagctgcggcaccccggacgctgcgagctggtcctcaggcaggtctcggagcatgtcgtcccacaccaggggtgtcacgctggggcgccgggccttcacgccgctggccaccgcccgcatgtgtgacaggcacaacttccccgtgctgttctgctcttgctgtagccaccggcgcgaggcctccccctctccgaggtaatagacctcatcacacccgatgtgcagccgctgggcgcctgggtgtagctccaggacctggtcaatcatggcgcccaccagcgccagggactctgcctcgtgggggttcagggtgcaggggaaggagcccacctcccgcaggtgggcgaaggccgtgtgcttcagcacaaactccatgtgtccaaatgtctgcaccaagggaatcacctccagctcattgagtccagccagatgcaagatctctttgatttcagaggggctgtaggcgtacttggccctcagcagcctcagagggccctcgtagggaaacatgtcttcatactcaatgaggaggccgtttgcacctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624097 - DNA, 543 bp, Homo sapiens
  misc_feature (2)..(2): n is a, c, g, or t
  misc_feature (536)..(536): n is a, c, g, or t
tnttttggcttgacacaacagaaatttattctctcacagttctggaggccctaagtccaaaatccaggtgtcagcagacccagctctccctgaaggctgaagaggaggacccttccttgcttctctctagcttctggtgatcgtcagctgtcctcggcatcctggggttcgtggcacgtcatgaccatcttggctgctggcaccatcttgctccaccgagaaccttgtggttgtgttctaggtacccgtttccacagaacactgctcaaaactttaaagaatgaagccaaggcaaaaagtaatgctctagaggtaaaagggagtccttacctctgagaggtacgagacctttggtggagctcctttaaggtctaaatgaactaatctcatctgaaatggcgtggaacctgacatttcaatatttcctgtgaactcctatggcgaagtctccttggggacttcttcctgcgccgccgcggtcccgcgaggtccgggggcgcagccaggcccggccgccccgccctcgcggccgcaancttattc

SEQ ID NO: 624098 - DNA, 257 bp, Homo sapiens
atgactaacagcacagagattgtgctaagcacagaaagatacctagtagcgtatataatgcctgatttacgcgcataggtcaaggtttgtttgctgcaccactgctcatgcctcttgtcacatcataatattgggggcacacctgcatagtatggtccccaatattggttcctatctcgttgctattccctttttgaaatttttttccccaagcagccgcctgggctgggtcattcaccctcccgtctcctcccaca

SEQ ID NO: 624099 - DNA, 84 bp, Homo sapiens
aatcttaggggtccttttttttttatctctcttgatgtcaggattttatagtctttttaaataaatccatttaattaaaacgtt

SEQ ID NO: 624100 - DNA, 535 bp, Homo sapiens
ctgttccttgatgtccccttgtcatcagcaatggatgctcttcaccgctggcttccaacatggccaaggacaaacagagcacgacggcgatcaacggtggtactgccattgccggcgaaatcacagcggtagccggtgcgaccagttgctcatcggatgccaataccatcgcctggacttcatactaaggagcgccgagtgagcgttatctccgaagctcagttcgtcgacctgtatctgggcgatggtttggcggacgctaggggtctccctggacaagcgcgaagagttgaggcgcccttagaatggcgggctgatctagaacgaatccgtcaactatgcgcagagaagtacgccgcgaccctggatccggagtttgcgctgctcgaagatggggttgtccttcgagtcacacagttgatagacgtaaccagcaagccggatttttgtcctcagcaagtcgtcggttcaaattcgtccggtggacatgctaggcctgcccgatcacatgcagaatgctctgatgagcgacacg

SEQ ID NO: 624101 - DNA, 775 bp, Homo sapiens
gagcggggtggggagggtgcgtcactgccgggcgctgcgcggcctcgtgcgtggcggctggcagcggcggccacggccgccgggctctcgggttgtctgtccccagttgttagccggccggtgtcccggctggatgagacgggcagtcgggttccctgtgcctcggtggccactctctggctggggcggctggggccagaggggacgatgtctactctgcgccccgatgcccgcctgcccattctcgggaggatccgcccgctggtgactgctgagagggagtcgctagtaaggccgcggtcgaacccggccggacgaggcagacagccccagccgaatgtgacgggcaaagacggcggcgaagggaggagacgggccgtcaggaccgcacaactagcgctggggcggcggggagcagcccaggtcgaacccgcgagctggtagcttggggacgcagacgatgaccaccagtgcggctgttccacccgattgcaggtccctggtcgacttgcacacttgagtcgcaacaaaggaagctgttatggagcccggggaccctttcggcagtgggagacgccaaccgtaaaacggcggtcgacagatcgccagtatgacggccgtatgactgagtgaatccgcccggccggaggaacagacccggcgaaagaggttggcaagctgggtccctgccggaaaagacggaagtcggccgatgcataggctcgcttaagggaaaattacctgaacacaaaaacgcctcccagtaactgtccaa

SEQ ID NO: 624102 - DNA, 156 bp, Homo sapiens
tgtggaggcatgatgaaactctgctgctgttgtggggctgtgtgactgggagagtgggcaggtcctgcgtggtgaccagacggtctcagacaattgagctccaggaagctgtccaactcacgggaagttaagtacgtcaattaaggaacattcaat

SEQ ID NO: 624103 - DNA, 1178 bp, Homo sapiens
gtgggttgtccttttgtccatctctctctggctggctctgttgtttttcgctgtttatatcctgcgctcttctttctgtgttttaacaacgggggctaacttcggtgtcctccccggaggtccctttgcgcctcctagtttttgccctgcgctatcatgtttgttctcattctgggtgaccccatttttttgtggtcaccggggcctccaactcgtttctgtctgtgctcatccgctttgccccggtgtgctgtgtcccaccccggtgtcgtgtatttctaagctctccataatttcctttggattgatcggccccctgattagaagtttcgagttgagaactttccccgatggaatcgtcaggtaaatcgcccactgtgggacgcttgtctgagactgcccttatcccagaatgctactccgcccaaagatcaatatcgcactgtgttatgtggttagaacaagtgtgttagggtcatgtggactatacccaggacagtttcagtgatcgccaaattgtgtgccctctggtttcaacgtgaacaccagtcctgggacatttgccaaaaacccgtggaataagtgctccccccacgtgtgtataaattggacccactttaggaacttttaaacctcttagagtggatccactcttggttcccactgttgttattgtcactttttaattctcttgtctaaagcccaaccacggaacttataatgaacctttgagttctctggttttaaaagagttatttataaaaaccacttggtgctaatcataaaacaatatgggcttcttgagggaccttagctttcacctagcacctaccacggatattgagtctcccactgtagtccaatataaacctgcacgagtgattttccacagagtgctcgaattctggttaatatacatctccacttagggctgaaaagagatgaccctacgtttctgataaaacacgctgtgttgcttttgatgttgtgttactgtacaccagaagtgtgtgcactgaggctctgcgtgtggtccgtatggaaagcctggtagccctgcgagttaagtactgcttcccattccattgtttacgctggaatttttctccccctggaatgtcaagtataaacttaagtgtttgtcatcaataaatggtaatactaaaaaaaaataaaaa

SEQ ID NO: 624104 - DNA, 455 bp, Homo sapiens
atgtcggggttgagggataggaggagaatgggggataggtgtatgaacatgagggtgtactcctttgtgaatgctggttctatccagttaatggggcgacagagtcccccccattcccccgggttaaatattgaatttttaggtaagactgggactcaccgtgttagccctgatagtctggaagtgctgacctatgaagacaaccggcttggtctcacaaagagctgtgattacaggctaaaaacaccgggcccggcccccaaaagaattcttgccgtgtattattaaaatgcattcaagaccaagagattgagggagtccctttttatggcttaggtaacaatattggttatgaactaaaacccggttttttttgaagatacattgcctttattaaaaaaaaccaaacaattcataaatgtcttctaccatacatcttttggggtttcttattg

SEQ ID NO: 624105 - DNA, 328 bp, Homo sapiens
ttatcatccccaatttcacggcagggagacctctatggtcacggtttattttttcctacccggacatccagaaacaagggcctccagggcttacttctcaatcttggcttaagggcctttccatcatagtggcccactccctctctttacttagcttccaggtctaactttctctgactactctggtctacctctctcatcaattccggctcctccagggaaggcggaccttcatggctcctttggtagattttggctctcctcagttaactcatggtccccgggaacaattcatggacttctacaaccattaccatctcattaaagg

SEQ ID NO: 624106 - DNA, 100 bp, Homo sapiens
  misc_feature (16)..(16): n is a, c, g, or t
  misc_feature (79)..(79): n is a, c, g, or t
  misc_feature (95)..(95): n is a, c, g, or t
  misc_feature (97)..(97): n is a, c, g, or t
  misc_feature (100)..(100): n is a, c, g, or t
gcccctttcgctcgcngctcctccgtcccgcccgcttccagtggggccaggacctctcccccacacctcggctcccccnccctcaacaccgccancnccn

SEQ ID NO: 624107 - DNA, 641 bp, Homo sapiens
  misc_feature (38)..(38): n is a, c, g, or t
  misc_feature (133)..(133): n is a, c, g, or t
  misc_feature (158)..(158): n is a, c, g, or t
  misc_feature (190)..(191): n is a, c, g, or t
  misc_feature (199)..(200): n is a, c, g, or t
  misc_feature (214)..(214): n is a, c, g, or t
  misc_feature (220)..(221): n is a, c, g, or t
  misc_feature (235)..(235): n is a, c, g, or t
  misc_feature (267)..(267): n is a, c, g, or t
  misc_feature (272)..(273): n is a, c, g, or t
  misc_feature (296)..(296): n is a, c, g, or t
  misc_feature (298)..(298): n is a, c, g, or t
  misc_feature (312)..(312): n is a, c, g, or t
  misc_feature (329)..(329): n is a, c, g, or t
  misc_feature (335)..(336): n is a, c, g, or t
  misc_feature (383)..(383): n is a, c, g, or t
  misc_feature (386)..(386): n is a, c, g, or t
  misc_feature (391)..(391): n is a, c, g, or t
  misc_feature (399)..(400): n is a, c, g, or t
  misc_feature (429)..(429): n is a, c, g, or t
  misc_feature (432)..(432): n is a, c, g, or t
  misc_feature (436)..(436): n is a, c, g, or t
gtcttcaaacacaagatgaagaacctcgtgtggaccancggtatctcagccctggcatggtgaatttcagtcagcctcagaggttgacttctacattgataaggacatgatccacatcgcggtacaccaaggntcgtccaggtcgtttatggggattncttcatccgtcagatccacaacatttgagganncttaatcnnaaccctgaatgaangatggnnacagtagcaccttngatgcatattcacacacagttcaggaacctgntattnngatgtattataggtcacggaacntngttatttgctaccngtgaaacctttacctancatcannccatcagcctgatcaactcagtttaacaagttaaggaccgaagctgnttncaagntggatctnnagctacgaggatctttggagtccagaaanaanaacntaatagacatagaattaaataaacgcctgaaggtgcctattagattcttcaggttggcggcatacaaaatgacgttggacgataataatggggcatattgcctacatagagtacttgccggcatcgccagtgtttgattgtttcaaggacggtctaaattttcgccagtcttccccctaatttggggatcggtatctctctgccg

SEQ ID NO: 624108 - DNA, 170 bp, Homo sapiens
ttggtagcaacaatttcatgccttaaaagtaattttctgattttacttttatctatttttactacatatatatacacacacacacacacacacacacatacatacattggaagcccatatctatccctgtgcccaatccaaactatatttttttttttaatttttttttt

SEQ ID NO: 624109 - DNA, 279 bp, Homo sapiens
aggaaaactcatccgggtcttcagacagtgtaattctagctacaggagcatgctatccagagaaacgttaatataaatcaagtagagtaggagaagcagagtattgatttcattttaaggataaattttacttaatagaaagtcagaattatacaatatgtttatccaatttttaattttaatttaaaatttaacactctatatttttcctcttgggatgaattaagtgcactgccatttaatatttactcctgatagccattttatagcgtctctatc

SEQ ID NO: 624110 - DNA, 456 bp, Homo sapiens
atcagcgcatgtgtgtaaggaaccacctcaggccagagaaagagccatgtgagaagattagaaggcacagtggtgctgacacaggacctagggtagggcctgttcccaccaccctagttggaaaacctcatgatttatggggcactgggtagaaaacacaagtgagaaaccctagatgggcactgccacctgacacagctatacagcaggactgaaaggatccacatgcattcttggcacaaggtccaaagttactctgggcatccacaaatataacgaggccccaaggatccatgattcacaatttcgaataccgaagaaaggcctaacaaaaacgaataaaaaacatggcaaaaaacaaaaaaaaattaatcacaactgacctggatctcagatgctagaaatagtagacaaagatgttatttcccagtgcaaataaaaaaaaaaagatagcaa

SEQ ID NO: 624111 - DNA, 272 bp, Homo sapiens
gcttctgcttgtttagcgtttgagttaagttttatttggatccaaggcatgtttgttcattctcttgtttagtatgctcgtcatacttcgagttatagtgttgttggctgctctcggctacttgggttatacactggtgtatgttccgttggattagcttcttcgccgcctaaccacaatttgaattatttagagcattaaattttgtttagtatatttgtcatacatcgatttgtgactttggtcatataccgatcttttcaggtcgacgc

SEQ ID NO: 624112 - DNA, 880 bp, Homo sapiens
aaaaaaaaaaaaaaaaatagacaacgtagaggactgtggttagtcggcacggaggggagggtcggctggacattagtggtatgtcttcaaggagctcttcgcatgctgcatctgcggtgtccttgttctgtcccatttcaccccctctgcagacaccaatgtccgaggtgccacccaggacaggcacgggggtcagccccaagctgagagtctggtcataggagtcatgtccagaggtcctagaggaggttattagcggcccatccccacccacacccacaggtcgatttggtctctttttagctcaaggaaagacagtagccaagcaacagagtccctctcccgtcgctggcaccgtgggagcagttacatcgggtctggtgctccagacctagggcccatgcactttcatcagatcctggctccttggagtgggggaaacgcagctaccccaatgtgttctgaggccacctaccctcccaggctgtcctacgtgatgctgacatgagcctcatgtagacccccaactcccatgtcctgggggagacgagcagcggctcagagacgcggcgggagcacgcgcacttctacaccaccatggcaacgctctggcactgacggtacaacctctctagctcccaggactgcttctggcgccccctgcagttcccaacacacccgacgatgtggtattgccctgtccctgcccctgtctccgctgcttggactgccgctctttcggttggccttgccatgctcggggcccgactggacgggcaccatgcgacttgtggtgtcttatcctctggtccctggggaccgcgtgctctgtggcaacgtgccccatcatccctggcatgtgcaggcctaccgcgactaa

SEQ ID NO: 624113 - DNA, 446 bp, Homo sapiens
atgagaaatgcacccgcatcgccattctgtagtctacagggatcagcatgtgataaaggggcaggcttgcgttatgggcctagattgggctgcagattaaatccttagaggattctcttctcttttaccatttttctgcgtgctctcactctctctttctctctctagcttattaatacatgaatattatcgtgtctgtctctctctcatctcagtgtaaacatccagacccttgtctcggagacggtgtaatcctcccttgccccattatctattcaactcccaggtctaacataaacatggtggtcgttgggtccgacataaaggatcggagcgtttgacattgaaagacatagtgctgtgtcatccatggatccatgtaggattggtgctaaccaacctgccctcatgaggatgtgtgctagagtgtggtgacccctggccaa

SEQ ID NO: 624114 - DNA, 412 bp, Homo sapiens
cccacaggacgggaggaattaatatgagatacatacaatctggcggtttccgccgggccggaggggctctcccactccagggcgccgagggtccgcctgcccagggccgggcctcgctgcaggcagctgtgggcgccactgtgtgcgcatacctgccccgacagccggacggtcggccgagcccagaccgcggcagccagggtcagggacaagggacgtcggacgccgggcgggcgaggggagcgtcgccccgcccatctccccactttgggggacagctcccctcgctcattcccgcctccacccttgacttgaatcactgttggcgggggacggggcgtgacccattcatgccgggaatcggatccagatgttcccgcggcgtgtgcagctgcatccttgccttttttgg

SEQ ID NO: 624115 - DNA, 693 bp, Homo sapiens
agcggtgagtccttggatgttaatcgactggatgtagaagtgcatgttttaaacgcttttccccctattttgatgcatcagactcagatttcatcatgtaggccagcctggtctcaaactcctgacctcaagtgacccgcctgcctcagcctcccaaagtgctgggattacaggaatttagtgattgacaatggcaaacaaaaatcctagagacgttggatgtccttgataagcaagcagagataatctaggccagaagaacaaagataaacaggcttcagagtgacaggcagaacaccaactatggctatacccctgacatatgatctccagttggaattcgaagaagctcttgctacagtccgcgtctaaggccactatcagccgatcgagcgcacgacaagctcatgcagcatgacgaaaagtcaaacaatatgtcggccagatggcaaagcgcatgaccacccgtgataccaggacaagccctcaggctggggtccctgatgcggctcccgagcaagtaacgggatatgccctaccagccgcgcagcccaggagatcgcgctaccgccaccgctggccagaccggacaggagccacatacccaagactaagagcgacccacatcaagtccacctctcagacacggaggcggcagctcgtaagcgaagccccaagcggcaggacccacca

SEQ ID NO: 624116 - DNA, 871 bp, Homo sapiens
tcagtatgagaccagcctgggcaacatagatcttgcctctacaaaaaaaaaaaaaaatagccaggtgtggcacatgcctgtagtctcagctgcttggaaggctgaaatgagaggatctcttgagcccaggaggtctaggccagagtgagctgtgatcgtgccattgcactccagactgagtgacagagtgagactgtgtctaaaaaaaacagtttggaatttacaaaaaaaaaaaaaaaaagttggctggtgcacgggggctcagtgcctgtgtgatcccagcacttttcggaggccgggggtggggtggatacctgaggctcaggagtttggagaccagccttgaccaacagtgggggggcctcccgctctactagggattacaaaattgggcgtgaaagtggtggagcatgcctgtaaatcccggctgcttgtggagggctgaggcagggagaagtcctcttgaaacccgggagggcagaagtttggcagtgacactctgggtaatggtgccatgtgtcactccaagctctgggacaatttgagcgaaattccttctcaaaaaaacaaaatccaaaaacaatctccaatttacctggatagaaatccagggctcacttgagaatccccggttttccggaaaatgcttccttgcggctcaccctttatggcgctaattctctttatcacctgcacccttgctcaccttgcgcacgttggttccttttttaaccctcctttttccttgggggccttaagaggggtctttagattttcagccccctgggctacaacttcccgcttaaaaccctctccattggcgctcttttaaaccttaagcgtaccattaaagggctcgacttgagcttct

SEQ ID NO: 624117 - DNA, 196 bp, Homo sapiens
cacgaggcttcaggacatgtttctttgatcaactctttgccacagcatcatcagaagcttcattcacgtacatagcgcctgctgctgcgacaagctgcaaaatccattgcaattccagtgtcacctgtttgtcattaccttcatcaatgagacagccagcatcaaggacaacgtcgtcacatccaagcttctctca

SEQ ID NO: 624118 - DNA, 389 bp, Homo sapiens
  misc_feature (12)..(13): n is a, c, g, or t
  misc_feature (89)..(89): n is a, c, g, or t
  misc_feature (116)..(116): n is a, c, g, or t
  misc_feature (151)..(151): n is a, c, g, or t
  misc_feature (155)..(155): n is a, c, g, or t
  misc_feature (161)..(162): n is a, c, g, or t
  misc_feature (165)..(165): n is a, c, g, or t
  misc_feature (184)..(184): n is a, c, g, or t
  misc_feature (200)..(201): n is a, c, g, or t
  misc_feature (203)..(203): n is a, c, g, or t
  misc_feature (351)..(351): n is a, c, g, or t
  misc_feature (362)..(362): n is a, c, g, or t
  misc_feature (385)..(385): n is a, c, g, or t
atttggacgagnntgatagtgccgaccagcacgtaatcagtgcatgcccagtcacgtgatcagtgcatgatagccacgtgatcattgcntgcacagtcccatgatcagcgcctgtnagtcactgatcattgcctgataaacacgtgatcantgcntgatanncangtgatcagtgcccgatcanccacgtcatcagtgcnngntcagcacgtcatcagtgcatgatagccacgtgatcagtgcatgctcagtcacgtgatctggacttgatcagccacgtgatcagtgcctgcagagtcacgtgatcagggcctgctgagctgcgtgattcctgccggctcatctgcatgncaattgccatntgagctgcgtgattcctgtcggntcct

SEQ ID NO: 624119 - DNA, 87 bp, Homo sapiens
acatctgtgtacttctgtgccatcaggagcccagggacaccacaagagacccagtacttcgggccaggcacgcggctcctggtgctt

SEQ ID NO: 624120 - DNA, 105 bp, Homo sapiens
ttaggaagttcaatagcattgctgcctggggaataggttatgtgcattaggcagtcagggttcaggcatgcagtggcgcaagcacagcaacagcagcaggcaagt

SEQ ID NO: 624121 - DNA, 84 bp, Homo sapiens
gagacacggtcttgctctgtcgccactgcacttcaacctaggcgacagagtgagacaccatctcaaaaagaaaaaaaaagaaag

SEQ ID NO: 624122 - DNA, 150 bp, Homo sapiens
ctgcaaggttgatctagaggatccctggtttccgggacgcttacagcatgctttttccgcccgagctgtccggttcggtcagcctgaacctgaaagaacaccactgtgcgctgaggcgctcgataccctgcgtgacgtcgatggctatga

SEQ ID NO: 624123 - DNA, 143 bp, Homo sapiens
actgggggttccttttagctttaaaaaaaaaaaacagtgttttgtgaaggtgttggaaaagggctgtgtttgggtgaaggaaggcgggggactgatttttttgggagggtatgaacaaaaaaaaaacgaaacatttcctttta

SEQ ID NO: 624124 - DNA, 111 bp, Homo sapiens
cgaccttgtactgtcgttggctcagagcaaggaggcgtcgtccggtattagttattcagaatgacactggaaatcggttcagtccgactgtcattgtggcggcgattacgg

SEQ ID NO: 624125 - DNA, 178 bp, Homo sapiens
actgccggtcttctctacgacggactccccgtgcgctctggccttgttgggcgctactggccttggtgggctgctactgtgccttggtgggcgcactggccttgtgtgggcgctactggccttggtgggcgctactgtgccttggttgggcgctactggccttgagtgggctgcactg

SEQ ID NO: 624126 - DNA, 938 bp, Homo sapiens
  misc_feature (938)..(938): n is a, c, g, or t
ggcacagagtcgctgtgtcttgctctggggtctcctggtgcatgaggtgatgcttacacctggctgtcctgtgagctgtacgaaggacgctcagaccttgggtgtgcgtcaacgatagacttgaggccacaagcgcatctgatcgagcgggaaggtgcctactgcaacccatggagatgccggtggtgaagagacccgcgtcacgtatcagcagactggacgcggtgctttctttgacctacgatgtggctactacatcgacggtacgaagttctcaaccgaagaaggctagacggcccggagcggggccaatgacagtgaaataggggcccttggccgaccgaaataattggcttcctgggcacggactggagtgacaggacgagcataagccgccatgatgagagggtaagacaacgtagcttgaattcctcaatgaattaagcccctgggaacccaatccgatgtgaaaggctaccccatgacaggtaaagcgaagagacggaatgctggcatcacgacccacagaaagccggcaaggatcgggaaccccaagagcaacccgtagaggccacaaccccgtgggacacctcagacagggcctgaaaccggttgtgttgaagccttggcacacaacgcttgagcaataatatcggaaaccataacgtacgaagcacgttatcccttatccctgaccccagtaaattcatggaacacaaaacattgttgagccatggtcaccaagagggaaaaggcctttgggacccattccgttgcgcctttgaggccacccagtttgaagaggagatcattcgtggcaaacaacccacgttgggaaacaagccaatgagttgggcccaatgcgacaacccgaacaagttcaacacctgggagaggacatatacttggggaccagaagccaagaggtatccatcgcn

SEQ ID NO: 624127 - DNA, 546 bp, Homo sapiens
tccaccaccggctgcctcctctaacttgtggtgatgccagtaggtttgaagggggcagagcactgcagggggaggggggggtctaggcgtgtgagaggacagggtggagaggaggagaaccctgaaggagagacggaagatgccaggacctttgcgttggacagccattgccctttccaggagagcctggatgtgtactgagggttgctggactgttccacccagaggagcaaggctgtacaatgagggtctgaatctggcacaccatgtcccttatgtaaaaggagtcgtggtcacaagaccctgggactggttaggcctctccacgacctcattgccatgttctatcttcgtgacctgtgcctctcatcgtttagaaagtaaccgctcatggggatgccccgtccagcttccgtctggaagtccagagtattcctggtttcacatttagccccgaaatcttggctgtaggaatcgggaaatcgaaaccagagtcctcctcgcctgatttccagctcaggaagggcctgctggcctgcccgtgtc

SEQ ID NO: 624128 - DNA, 221 bp, Homo sapiens
cgaggtgctaggagcggagagcaagtttcctgaggccttcccctgcgagggcaggaagcagatactttccttggggcgcagaggatgctttcacccggaaggtgtgtatatgtgggggaaggctggggccataaagagcaggttcctgtttctgtgagagtcccatgtgcttggcgtgaggcgctgtgtgagaatgtacagggcacgaggaaacatagcag

SEQ ID NO: 624129 - DNA, 404 bp, Homo sapiens
attcacaaaaagtgctgagtcagatataaatatagagtatgagatggcactgtgatgactgacttgcacggattatcttgccttgacgtaattcctactagcacagaagcactagttgttgaaatcgctagctgtgcctcttcagcgaagcacactatctggtcctggcctagccggcatttctgcaacaggcctgagaaatctgaaatgacagtctcaagttgttcctacgacatacgccgcttatgcttcacatggatacagtgctcttgctacatcgtatgcagagctacaccctgaacttggcacatatccatatggtgaacttgtcatcagataatgcgcgacggacataagtctgatccaccaccaagctgctggcatagcctcctgacggcatatgt

SEQ ID NO: 624130 - DNA, 302 bp, Homo sapiens
gaatcgacggtttctctatgtatccacgtaggtctcaaattcctgggctcaagtgattctcccacctcggtctcccagagtgctgggattacaggtgtgagccactgcgcttggcgttaattatatttgcatataaaaatttcagtatagggagatttggtgaaatttgtcattctaatccttatggcaattgattacttgaagaggctgaccagctatattagccttgttcttgactcttaaactactaaacaaggcagaacgttgtctaaagttgcgagactttcgaactgtcttagaaa

SEQ ID NO: 624131 - DNA, 197 bp, Homo sapiens
taatactaacaatgggcacacctagatcccagtactatgggctaggtatcacatatattacataagaccatctgaataaatagctctctgtatagtaaaatagtactaccacatataatctatatatacctataaataaggcaataatactagcactagactactgataggcataaaaccggataataaactaccct

SEQ ID NO: 624132 - DNA, 250 bp, Homo sapiens
  misc_feature (10)..(10): n is a, c, g, or t
  misc_feature (15)..(15): n is a, c, g, or t
  misc_feature (34)..(34): n is a, c, g, or t
  misc_feature (178)..(178): n is a, c, g, or t
  misc_feature (217)..(217): n is a, c, g, or t
gactaaatcnagatntgtgattgaacagggaggnatccagactgttgatcagttgattaaagaactgcctgaattactgcaacgaaatagagaaatcctagatgagtcattaaggttgttggatgaagaaggaagcaaccgataatgatttaagagcaaaatttaaggaacgttggcnaaaggacaccatccaatgaactgtattaagcctttaagnagcagaggggaaccaaacttcaggaacagtttt

SEQ ID NO: 624133 - DNA, 617 bp, Homo sapiens
gcaaatgctttctaaacaatgacgagtttacatatattttgcaggattttgtatgtatttctatggagtttcatgtttagaaatgtactctgttaataaaagaatgtgacctacaataaggtaaaaaattaggtagtatagtttaaaaatgcacacttattttatagtagctgtttttttctcaaatgtcttccaaaagggagtgtatttaataagcaattttactgtgctgattgcaaacattttgtatatcaggaaagtatatctaagggtaatgattcatacactaatgataatgaataaaacaatgctttttatctatttttatatatatatattttttttttgggcttttttggtgtgtcaagggtcagaagctacaattcaaagtatactaagaatatttttttaaatgtcaagcctggcgctactggctcgcaatggccagtaggtggtggtgtggctcttaccaaaaaaaaaaacaaaaaaaaaacaaaaaacctgtgttgtgggcgcggctctgtgggcccttgagaaaaaacgtctttcttacaaccatcttcggttgtggcggcgcgcgggggccccatgttccggcttctgtggtgacaccttgg

SEQ ID NO: 624134 - DNA, 612 bp, Homo sapiens
ggttaaatcagtgcgatgagtaggggaagggagcatactcatcgcactgaatttacacaacacaacaccctagagactcactaaacattcatactactcgactctcactgcccaaagaactatcaaatacctgagccaacaacttaatatgactagcttacacaatagactctaaatagtaaagatacctcttaacggactccacttatgactccctaaagcccatgtcgacacccacaacgctgggtcaatagtacttgccgcagaactcttaaaactaggcggctatggtataatacgcctcacactcattctcaacaccctgacaaagcacatagcctaccccttccttgtactatccctatgaggcataattctaacaagctccatctgcctacgacaaacagacctacaatcgctcattgcctactcttcaatcagccacatagccctcgtagtaacagacattctcatccaaatcccctgaaacttcaccggagcaatcattctcataatcgcccacggacttacaccctcattactatcctgactagcaaactcaaaataagaacgcactcactgtcgcctcataatcctctctacaggacttca

SEQ ID NO: 624135 - DNA, 376 bp, Homo sapiens
  misc_feature (13)..(13): n is a, c, g, or t
attttcattgtanaatcttttatgccccaactgaatcatgggagcctattaaacggctattatacattaaaaggccgggcgcggtggcccacgcctgtaatcccagcactctgggaggccgaggctggcggatcacttgaggccaggagttcgagaccagcctggccaacatggcgaacccctgtctctactaaaaagaattagccgggcatggtggtgcgcgcctctaatcccagctgcttgggcggctcaggcaagagaatcgcttgaacctgggaggcggaggttgcagtgagctgagattgcaccactgcactccagcctgggcaatagagtgataccctgtctcaaataaataaacacacgtgtgttttta

SEQ ID NO: 624136 - DNA, 313 bp, Homo sapiens
ttgggctcagagctatatcccagaactttggaaggctgacgatgagagtcctggaggccaggaggtcaagatccacctgaacaacctagtgaaactccattggccgggtgcggtggctcacgcctgtaatcccagaattttgagaggctgaggtgggtggattacctgaggtcaggagttcgagaccagcctggccaacatggcaaaaccctgtctctactaaaaaaaatacaaaaattagctgggcatggtggcaggtgcctgtaatcccagttacttgggatgctgaggtaggagaatcacttgaacccag

SEQ ID NO: 624137 - DNA, 948 bp, Homo sapiens
  misc_feature (1)..(1): n is a, c, g, or t
  misc_feature (69)..(69): n is a, c, g, or t
  misc_feature (74)..(74): n is a, c, g, or t
  misc_feature (141)..(141): n is a, c, g, or t
  misc_feature (155)..(155): n is a, c, g, or t
  misc_feature (171)..(171): n is a, c, g, or t
  misc_feature (181)..(181): n is a, c, g, or t
  misc_feature (188)..(188): n is a, c, g, or t
  misc_feature (194)..(194): n is a, c, g, or t
  misc_feature (220)..(221): n is a, c, g, or t
  misc_feature (234)..(234): n is a, c, g, or t
  misc_feature (239)..(239): n is a, c, g, or t
  misc_feature (269)..(269): n is a, c, g, or t
  misc_feature (295)..(295): n is a, c, g, or t
  misc_feature (301)..(301): n is a, c, g, or t
  misc_feature (324)..(324): n is a, c, g, or t
  misc_feature (331)..(331): n is a, c, g, or t
  misc_feature (355)..(355): n is a, c, g, or t
  misc_feature (370)..(370): n is a, c, g, or t
  misc_feature (385)..(385): n is a, c, g, or t
  misc_feature (407)..(407): n is a, c, g, or t
  misc_feature (424)..(424): n is a, c, g, or t
  misc_feature (508)..(508): n is a, c, g, or t
  misc_feature (512)..(512): n is a, c, g, or t
  misc_feature (631)..(631): n is a, c, g, or t
  misc_feature (733)..(733): n is a, c, g, or t
  misc_feature (835)..(835): n is a, c, g, or t
  misc_feature (841)..(841): n is a, c, g, or t
  misc_feature (843)..(843): n is a, c, g, or t
  misc_feature (870)..(870): n is a, c, g, or t
  misc_feature (935)..(935): n is a, c, g, or t
ngtgcaggcaggtcctggttcatccggtcccagccgctcccgcagaagccatgtcgttcttcccggagntttantttaacgtggaaaatggctaattggagggaatggtgcgcggcctgaagggggggtgctcagccaggncgactacctcaacntggtgcagtgcgagangctagagganttgaaantgcatntgaagagcactgattatggtaaattnntggcaaaagaggnataanctctgaaggtgtaagttatcgatgaccggntcaaggagaagatggtggtggagttncgccanatgaggaaccatgcctatgagcnactcgcnagattcctagaatttattaattanagttaaatgatcganaaagtgattctgctnataaaaggcacgctgaaccagngctccatcgctgagatngtgcccaagtgccacccactaggcagcttcgagcagatggaggccgtgaaaattgatcagaaaactgctgagatctacaatgcnattntggtggaaaagactcttgaggctttttttcaggactgcattttagagcaggaccttgacgagatgaacatcgagatcatccgcaacaccctctacaaggcctacctggagtccttctanaagttctgcaccctactgggcgggactacggctgatgccatgtgccccatcctggagtttgaagcagaccgccgcgccttcatcatcaccatcaattctttnggcacagagctgtccaaagaggaccgtgccaagctctttccacactgtgggcggctctaccctgagggcctggcgcgtgggctcgggctgacgactatgaanaggtcnanaacgtggccgattactacccggagtanaagctgctcttcgagggtgcaggtagcaaccctgggagacaagaagctggaggaccgattctttnagcacgaggtaaa

SEQ ID NO: 624138 - DNA, 414 bp, Homo sapiens
  misc_feature (375)..(375): n is a, c, g, or t
  misc_feature (389)..(389): n is a, c, g, or t
  misc_feature (401)..(401): n is a, c, g, or t
actagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtaggcatgcatcagaacttcctccccttttaaaggctgggataatatttcatggtatgtttagatcacattctgtttatccattcatccatcagtgaacacttgtgctccttccaactttggggctgttgggggtgtcctggccactgttggctcctaggtggntcaatctcgtttanttccctcctaantcaaggtgtaaca

SEQ ID NO: 624139 - DNA, 863 bp, Homo sapiens
gctgtccggccggaattttagggcatgtgaaggtggacgcctgtccagtgacaccgatgtctcaagtggggggacactgcgttgctggcgtcaacacctaaaactgccagtgccctcctgagtggacaggccagttctgcacggaggacgtggatgagtgtcagctgcagcccaacgcctgccacaatgggggtacctgcattcaacacgctgggatggccacagctgacaatgtgtgtcaactggctggacaggcagagaagctgcagatcagaatatcagatgactggtgccaacaacacagtgtgctatccatgggtgccacctgccatgaccgcagtggaattctaaacataactgatgacactggagccacaatgaggcaaagaacatggacctaccagatgttcacacgtggaaatgcactgaccctgacgctcaacaaaaaagcacactggacaacagcacgacatggctaatcatagagaacagcacgacagacacagagagaacacagggaccgggacacaagtactgacacaacccgtagataccaaacgcaagaggacatatcaagcaacagacacaggaagaagacgaaactagactagagaccagagaggaacatgcatagagcatcaaaatagcggcgcacatcagcccagcagacagccccaaagcaccgccacgagcagaaacagacaaccacaaggagcacacgagaggtcggaacagaacagaaaagccacacagccaagcagcaaggaacacaaacacccgagagaaaacagacagcggcagagaaaccaggacggagcgaagcagcacgtaggaagcagacagaccgacaaggcggaacagaa

SEQ ID NO: 624140 - DNA, 234 bp, Homo sapiens
  misc_feature (8)..(8): n is a, c, g, or t
tgcaggantttcggcacgagctgccgctcgccgatcacgcgctcggtcgtctcgttgacggcggagaacacggcgatcacccggccgtcctcgtccggatcgggagtacgaataggtgaagtacgcctcctccagatagccgttgcgtcgagctacagcgactcgtgtcgaccaggtggcctgccgtgctcagcacctgcagcttggggccgatgagtgccagatggcacatgg

SEQ ID NO: 624141 - DNA, 408 bp, Homo sapiens
ccagtctgtgacctgtgcctctcatatctgtgtgtgttctgtgttgcttgaggaatatggtccaggccctcagctcatgggaatctgcctctcactgtgcctcacatgtggtttataccagtgaccaattctaggatgaccacgaagaatgattccactgggcttgggagtgtgttgctggtacctctaatctctgtgtagaggtcataggacctgtgtgctctgtggctaggtcctcagagtcagtccctgggcaggtactcggaggcttcagttttccccacagactgtgttcctgggcctgaatcggtcagactacatgtgtccagcgcaacgcagatggcttcccagacctgaaacagatcgtccaccatctctgtcagctttgggggcctgtgcttccggccc

SEQ ID NO: 624142 - DNA, 636 bp, Homo sapiens
gttagacaggcgattatcttctatgttagccattggccactgtatagtggatactgctctgctctcaaccatagtgaaggaccactcctaggagtctgcgagagcctacttggatccatcgcgaaaccatggaccggaatgcctttggcaatagccttgagcgtaaatggcactctgatgccctactgacgggctgtaggttgatggctgacaacgtgaatactctcaggggactacgaggcgcaatcaggatactggctgacaccatcactatcccctgtctccctatctcagaagacgatggacgacgagatgaaagctatcggactctgggaggatacccacagcttatgctgggttacagaagtactgactaacgcgacttctcataacatcaaatgccacattgagaaccccttgccgcactacgtatgcagtactagtaccaactagcggacattgtgggagagcttgaggggtcaccggctaccagcttgctggtgaggtgactactatcacactgaactgtccctatggttacgacgtagcgcctggagacggcctaacatctaagacggcccggaccaaacggacttcgagaatgtgagcagcctgtatgaccaaaggcttccccgt

SEQ ID NO: 624143 - DNA, 233 bp, Homo sapiens
aggatgacaggagcgggactggcacacaggatccccacagacagaggtgatgtgcccggatttcaagcctcgaggagactggtccacacccccgactaacaggagcagcagtgccttcttcacatcttcatgcccgtatatatctgggtttattgaagctgccagctttacgtagaaatcctcctctgcaatttggctcagctcctccctggtgagctctccagccctcccca

SEQ ID NO: 624144 - DNA, 250 bp, Homo sapiens
cgacccccaacttagcctcgctgatgggagagaacaactgatcaatcttgctgcaatggaaaggcttggtcccttgagtctctgtgtttgcttcctatggctgctgatgacaagtcaccatacatctagtgacttcagacaacaccaacttgctctcttacagttctatatttcataactcccaccagagggctgacgttgcagtggctcacgccctataatcccagcacttgggcgaggctactagttg

SEQ ID NO: 624145 - DNA, 136 bp, Homo sapiens
gcactggtggtgacctcaaccatggcctggaccgttctactcctcggacctcctctctcaactgacacaaggctactgttgaacctcctcatgatactgaactaaacgaccctcggggttcaactggcccccggga

SEQ ID NO: 624146 - DNA, 768 bp, Homo sapiens
aggattcaggctccgtcctaacgaggcctgtggcctgaaggctcagggccccccgccctccctcccagccctacagcgtacctcccagcccctgagctgtaccgaacaccttggacaggttttccattcctaatgacgagccccagatggaggagaggtccgaggaggtgggcagtgggtactctttgcgaggactcccggcggtctgtaacccggtgggtaggcgtgccgaggcggcaggatgctcgtcgggactcggtgggcagatcatggaccgaaggaagcaggacgctatcgcaggtggagcttgaggcccgccggtggcgccactcatagggaagccccacggctttcgtccagtgctccccgccaggggggaagtggccaccccagtcggacaaagcggtgcccggaaaagggcggcgacgacccggtcataaattcggtgaccatgcgtaaagccatatcgcacggggcgcccaagcggacggaggcgagggtccaaagggccgaaggacacgcagcaagtaagagaaccggtggatggcgaagaacgaaattggagaaatgttcgccaggggtgtgcacttccagcggaagagaggtatatgcctaggggttgatcgtgggacgatagcgatggggggaagggtgtatgcacaagtggctgtgtgcgtgtgtcaaatgggttactgggaaaatactaagcgcgcaaggtaactggggccgataaagtgccgtcaaaggtgggaggttcagagaagagag

SEQ ID NO: 624147 - DNA, 529 bp, Homo sapiens
  misc_feature (89)..(89): n is a, c, g, or t
  misc_feature (367)..(367): n is a, c, g, or t
  misc_feature (387)..(387): n is a, c, g, or t
  misc_feature (419)..(419): n is a, c, g, or t
  misc_feature (424)..(424): n is a, c, g, or t
  misc_feature (483)..(483): n is a, c, g, or t
  misc_feature (498)..(498): n is a, c, g, or t
  misc_feature (513)..(513): n is a, c, g, or t
aaccaggtaaaaatatgcagaattactttctaaaaatatttttttttaatgtgaaaagaaatcatttctggaatctccaaagatacaanactactaattattgtatatttgaaaatcacatatttctaggaagagatcatcttgagagtgtgtaacaggaccaaggagaagaaaattctgtgggctttttctggtctatcaaatagtaaagcttagaaggtggaggcacttgtgttgatagagaccgttctacctgtgcacatactaggcctaagtaagtagtaaccttgtctttgcttgccagttttcaaagcactcttcaagctattgcaatgtgatatttctggtaatcgtctgagagtgggcntcttcatatgctccattttngtaaacaagaaaataggaagttcagagacatnggttngctcggggtcttgtacgtaaaatttcagaatcagtttcagaaaaattattttttacccngcattatttcccctnacatatgggaaactnggcccatttgtttatt

SEQ ID NO: 624148 - DNA, 167 bp, Homo sapiens
cccctgagtgctgcatgccagtcctaccagccgctcggtcatctgccaccgcccagcaatggcttcagcatgcagtccctgctaggggactccagggaggagcatcctggccagggctggtgccacagagcagcccagcttctgcaggcaggactgtgccatcaaca

SEQ ID NO: 624149 - DNA, 410 bp, Homo sapiens
gcaggatagacattatctctggtggggttggaaggtaggtggaagagaagaggaaaacatacgtagaaaaaaatggttgataaaaatccagtttcctggttgagggatggatttatgtgtgccattacattatgcttaatgatttgtatatatgttataaaatggccatttttgtctaatcaaatataacattaaacggcgagaaatttaaagcattttaaaaagcaaatacattaatcaaaaatatttgtaactggacaagaaccaatactattttggagtatacaaagatatagtaatattatctatgattaaacagaaataagaaaattgcacaaataaagcattcaattaaaataatcatttcaataccatgattaaatctcaacagcatttaaaatgttaattta

SEQ ID NO: 624150 - DNA, 156 bp, Homo sapiens
agtcaacggatttggtcgtattgggcgtctagtctaccagggctgcttttaactctccgtaccagtggatattgttgccatcaatgaccccttccattgacctcaactacatggccttacatgcttgccgctctgcatttcccaccgcattgggca

SEQ ID NO: 624151 - DNA, 475 bp, Homo sapiens
ccacgagcgcccatacagtcaggttttcctttagcaatagaacagattttttttttatcatcagataaagttgctgacgtgaatttaaaaagtagtttgttccaaacacatatacctttatttatttatttatttattagacagagtctcactctgtcaccccggctggagtgcaatggtgcaatcggctcaccgaatcctccgcccccccgggttcaagtgattctcctgcctcatcctcccgagtagctgggattacaggcatgtgccaccacgcctggctaattttgtaattttagtagagacagtgtttctccatgttagccaggatggtctcgatctcctgacctcgtgatccacccgcctcggccacccaaagtatggtgcttcggcgtgtgcagaggcaccagactttaaaagcgcatagtgattggggatgatgtgtctcgatgtattggcgttcggcgtgtcggtt

SEQ ID NO: 624152 - DNA, 237 bp, Homo sapiens
tgatcgctccatttgatcactccccactatgacgacctcactcctggactcggtctttgttcccagcaagacttaggcgccaaagcactatgacctttctccagtacaatcatatgccgctcgcctgttcgggttccataacgctctctgatatttttccagctgtaaccaaactcatcctactttgtccacatcttgtgagattctgcttgccgatgactgtgtgtgatcactacc

SEQ ID NO: 624153 - DNA, 553 bp, Homo sapiens
ggccggccccggtttcctggtttgggtctgctacccgcgcctgttccgctccgacgcccggcatctcgccacagggctcgccgttggtcacccgtcgctttcgtagtgttttctgtggtctgggtttcttgttttgtgtatagctccccgaggtaagtcccgtcctctgcctcgtcctctggcccccggcaatcccaactggccacagggtgttcaacgaggccctcgagcagcaatcggccacgggccttgcaagtggtaggaggtatgggcgaaggcacacaggggctcagtccctcgaagacacacgctgcagtaacctcgaaggggctcgcttctaatgcagtgtattgcgcctccttcatggcattcgcgagacatcgctcttggactcgccgcttgctgcagggagggaccccccccccgtccgccaggtgaacaagcggtcatgctccggggcccatttccagcttggccgccgtctgtgaccttgggcaagtcacttgacctctgtgtgcctcaacttcctcctatacacggggacagtcctgcc

SEQ ID NO: 624154 - DNA, 115 bp, Homo sapiens
cggcagggccaaaaagacccttattccttttaagatgccccttatgctttctgccagatgctttggagcaggtgctttctgggctggagctttttgacccttctgtcgtcttctc

SEQ ID NO: 624155 - DNA, 344 bp, Homo sapiens
  misc_feature (177)..(177): n is a, c, g, or t
  misc_feature (180)..(181): n is a, c, g, or t
ggcccctccctccctttcaaccacttgagcaaactccaagaccccttttaccccgacaccagcaattatgccaagggccattaggctttcaacatgactataaagaccccgtatcatcatggagacctttgttcctgtgggaaaataaccctcccccctgcaacaggtgcccctggntgnntgggcctgttttttccctttgaccccaaaaaaaggggccgtggtcagctgggtttttttccccccatcagggacaaaccgggggcaggaggaaagtcactaatgcccagctgtttgcatcctgcccagctacaggtccttaattaaaagtgtactgttggtta

SEQ ID NO: 624156 - DNA, 405 bp, Homo sapiens
cttcatggggtaagtttggtctgttctctcggagttggtgggccccctaaatatttgtaagttggtataaattgtaaacgtctctggtcaggcggcgcatttcgttcttttgctttgtcggggaaaaggctcttcccattcttggcccccagcatgagttaactcggggtgacttttccagtgggagtagtgcccccagcaacccttgtcctttggcccccctgttttttttgctttggggggcagggaaaactttggggcatttgaaccaacttggccaaaccctagtttggagggaggggaatggaagggcatggaagtttttttaaaaaattaaaaaaaaaaacaaataattttgagaattgggcatttaataaactgacttttgttataatggacctttta

SEQ ID NO: 624157 - DNA, 987 bp, Homo sapiens
  misc_feature (332)..(332): n is a, c, g, or t
  misc_feature (551)..(551): n is a, c, g, or t
tgagaaccctcgggccccccggcggaagggggcacccctcccttccccgaggagttgggcatatagagcaccccgaggtaagagagagggggggggctgtctgcccacaaaggaagggggaacacgcggggactatcctggggggaaccactcgagaaaaaaacacacccgggggggtgtctcctgcgggggagactcaccccggggggcgcccgcgagaccccgccacaaagagaggtgtccaccctccacgcgaggagagacccactctcggggggcccactattaaaaggaggaggaccccgagagaagatcgcgtcgccctctgcgcngcccccccacactacaatatgtggggtagtgttgatagacaccacgatctggggggagacgtcgcaccaatttcttgtgacccacccagaagaacaggcacccgctggtggcatgttgcgcacacactaataaacacactaggggcgttgtatatgttttatataacagagctttctactagattaatagatagagggagcgcacaatattactatcgnggggagtatctcatatatagggtggggatagcaaacacacccacgtgtatgtttttttaaatagagggcgctcagacagacgcaccgcgcgcatctctccacagactcacatcgtgaggtgttgtccagggggttttgtcagaacatacccgacagaggcgcgcgttcttttttaataactcaatatgaggaacacatgctctcaggaagattatgaaacaccacacataaagattgaataaggtccaaaaaataaaaatccatccaggctaccaccccgcacaaaaaaaataagagggtctccctcctttgaagaagaaaaattattttttttgaaattcaaaaaggggtttatacttttttttttaaaggggaaaaaaggaaaaggtgccaatatcccccccctttttttttccaaaaaatttaaaccccacca

SEQ ID NO: 624158 - DNA, 104 bp, Homo sapiens
actgtcttatcacagaataggagcattactattgggtatatctccattttctttaagcttatctaaatttggtacttctttgacagactcgtattactagtgta

SEQ ID NO: 624159 - DNA, 274 bp, Homo sapiens
tcctataaagtaccttggggctttccatactggttgtcgttcaaatcaagctcctcacatcaagcttttttctcccaaggtaatgagcagcactagcatatgtgaactttgtgtagctttttcttgacgcatccattcgtaggaagcttcatcttagactgcttagtttattagagtgtattaagagtatctgcggctgggcctggtggctggtgcctgtggtcccagcgctttgcgacggccgatgcggtggagtcacctcgggtcaggagtt

SEQ ID NO: 624160 - DNA, 531 bp, Homo sapiens
  misc_feature (366)..(366): n is a, c, g, or t
gcggcggtgacggcaggaatggccagcgggctctcgcttgctgaggggcatgacagattgagggagcagcacgttgcatgtgattgggattgtggggctgcatgccacgtggggaccagccctcgctgcctcccctgccctgcgttacagtgtctgggaagccaggcgcaggtgtgccagctagcactcaccactacacactgaaagcagtcacttccggctgctgctaaaacacactactgactgagcatctagcacgagccaggtcctcagagctccctgaaccctctttcacagggtgcaagcctacccttttcacacacacaggaacccaggcaccgagtgaggggcactaagttctagaanccgcttctgctccaaagccagagctttcctggaagccctgggatcagagcccactccgtcttccagtctcagctggcagggcagggtcagcctccttggggggaaggtctgacacaatgaggtaatgacagatggcgcccaccacgagggcatcatggtattgtc

SEQ ID NO: 624161 - DNA, 188 bp, Homo sapiens
gtccaccgtccgccggtcccagtgtctacatcatgtgtctatggagacatggcggctgtagcctacctgtgtcttagtgtcctccaaatccaagcggattcagctgtccctgccgcacaggcctcaaccgtgctgtctgactggcagtatgctgctcaccatgtgcatcacacagtctcgcgtcatac

SEQ ID NO: 624162 - DNA, 295 bp, Homo sapiens
tcaagtgatctctgcctcagctcctgagtagctgggactacagcagcccgacaccacaccccactaatttttgtatttttagtagagacagggttttgccgtgttggtcaggctgatctcaaacacctgacctccagtgatttgcccactttcagcctccaaaagtgctgggattacagatgtgagccactgtgcccagcttagtaattcctttgtattgcattatatgaaatatgtagctgggtgtcattagagatcataaagcccaggatacagacccagacctgacgggtag

SEQ ID NO: 624163 - DNA, 246 bp, Homo sapiens
gctacttccctatatagaagagctatcactgtaggctcaaccctcatatacttttacttatctgttactagtatctgtataggcttttgctaaactcacgacgaataactgtccgtcacatatcagatgctcagggaatagacatcgtttggactattctgcccgccatcatcctagtactcatcgtcctttcatctctacgcattcgttccataacggacgaggtcctcgaactctccctacccc

SEQ ID NO: 624164 - DNA, 284 bp, Homo sapiens
gcccgagaccccttagtccctacacagataagacccatacagtctcgaatgtactagaggtaggatccccaagagctgcttaaccagagccagtcaggagagcagggttatatgtcactggctacatatctcttgtaggacatgtctctgcccactagatattaccctcagaaacacacagaacatgaaaggatccaaatataacccccttctcccttctagtcccactctggaaaggcctgctgggaagcgggagatgctggacttagcggatccgctagaga

SEQ ID NO: 624165 - DNA, 209 bp, Homo sapiens
tgttctaggcactaaaacatttgctgagtgcatgaaacacaaagataagaaatctgtggcagcaatatggatgcaactagagagtctcacactaagtgaagtcagtcagaaagagaaagacaaataccacatgacatcacttatgtgtggaatctgaaatgtggcgcacacaaacctgtctacggaacagaaacagactcacaccacag

SEQ ID NO: 624166 - DNA, 354 bp, Homo sapiens
  misc_feature (1)..(1): n is a, c, g, or t
nggatgctgcgggtcgctctcgaggatcccaggattcgtagatacccccatatgctttactgtacgtattctggtcatctcaaatgggtctaaacccagctactttgcattccagaagttacattccctccaattccacctaatttttcatctagtcctagttactggctctttcttcatgtcttatttctcttgctttgggagcttaaaagcatttacacagacctaatatttgggttcctatccttgggagcccatagtttacacctgtccaaggaacgagtcagaaaatagggttacaacttccttgtgttacgctaccacccaaacacctactagtgcagtgctacattc

SEQ ID NO: 624167 - DNA, 847 bp, Homo sapiens
aaaacagctatgcacatagatgcagataatcgaactcgaggccgtgtcagtgacctggacgcgaatactcgtcgagtaggtctctccttactgagatgatgattaatccaaaagataggtggagaatgaggcttaatattggccttcactataggtgaaagacgtacattaactgtatgatgaggtgtgcatcatattaggggcactactgatgatgttcgatggtggcagaagaatgacataagtgcttttctaagtcctagagtaagtggcagggtattataagtttcagtgctaggaaaatctttatcaatgaagataggtttgacttttttgaaacaaaagtcattcaggagataagtctggtgtgatgtgaggcccaaatcattccagttgagtagggaataataagagaagttggaatatacaagagcaatttcaaaaggaggggtgcacaacctctttagagtagggtggaagtataagaattcctttggatttctacaatgacggggttagagggcagcagcagcttgttaaaaagtgggagtgtatggcggtcccccacaaaagttaatcatccgcggggggagggggagccatatgtgtgtgtctgacagaaagatttacataagctttacagttctctctactgaatatcatacgttacttttcttaaatgtgtctacgtcatatttgtgtgatctgtataaagcgccagtcctcaggagccatgacagcttatccggaactaaggagttatgtaggcgggctgtggccatgcgggccagctacctgagggggcaaggatgtggccggggcacgtcaggcgatggaaacccactga

SEQ ID NO: 624168 - DNA, 127 bp, Homo sapiens
gatcgaggtgataccatacttcattaggcaacaaaagaacttaggggtactttccgtttaatcacacagaatactaaaaagacatgtaccctaggatcacagcgtcgacataaattaaaacaataaa

SEQ ID NO: 624169 - DNA, 473 bp, Homo sapiens
actctacaggatccccagtttcgacgagactctctctgtgatccttctctctaattcacaggtataggaacacctccggacggctccgaagataaacctcctgatctacctgtggattggacccacctgccagggcccatgggaccactctgtcgcttggaactcgccagccctgccctccttgccaatttaaactaagcccatcttctggcaagcaatgagccttgaggaggagggaaggaagcacgatacctcagaggggcaccatcaggcagtccatcacccagcactgcacaaaggtccatccaaacggggggctgtatggacaccaagatcctccttccccgcaagccttctgcgacacccactctcgaacgcagcaggagagccctgctcctctcagcattgccctttacactcctgtgttttctgccccgaatgctccctcatgcaatttcaggactgctgctttc

SEQ ID NO: 624170 - DNA, 394 bp, Homo sapiens
cgggggaaaaagaaaaaaaggaaggaggaaggggggggggggaagaaaaagggggaaaaaaaaggaaggaaaaaaaaggaagaaaaagggaagggggaaaaaagagaagtaaaaaggggggtaaaaaaaagaaagaaaggttgaaagaagggaaagggaaataaaggggagaaagaggggaaagagcaggaagaaagagtggaaggaaggcgaaagggagaaagaaagagggagaagggagagggaagaggaaaaagagaaaaaaaaaggagtggttaagaaaaaagagggaaatgtcaatatcggtcaagcacactctgggggtcgggctctctctctctgtctctctctctctctcactctctctcgtgcagaatgcggaacgagaacgtgc

SEQ ID NO: 624171 - DNA, 247 bp, Homo sapiens
acctcgcgttatggggggcagtttgatgtcttcctcacaactatgaaactacaatttaaaatgtggttacatgtttttcaacaaatgtaagacagtataaaagaactagtggtacatattgataagtagctgatgtcagtgtgtggaacggctttgtcgaaggataaactccaagaaaagatgcacacagtaacagatctagatgcctactgctgaactacaacattacacattttaaacaacttat

SEQ ID NO: 624172 - DNA, 833 bp, Homo sapiens
  misc_feature (392)..(392): n is a, c, g, or t
  misc_feature (400)..(400): n is a, c, g, or t
  misc_feature (416)..(416): n is a, c, g, or t
  misc_feature (420)..(420): n is a, c, g, or t
  misc_feature (445)..(445): n is a, c, g, or t
  misc_feature (450)..(450): n is a, c, g, or t
  misc_feature (461)..(461): n is a, c, g, or t
  misc_feature (473)..(473): n is a, c, g, or t
  misc_feature (491)..(491): n is a, c, g, or t
  misc_feature (496)..(496): n is a, c, g, or t
  misc_feature (502)..(502): n is a, c, g, or t
  misc_feature (510)..(510): n is a, c, g, or t
  misc_feature (521)..(521): n is a, c, g, or t
  misc_feature (524)..(525): n is a, c, g, or t
  misc_feature (548)..(548): n is a, c, g, or t
  misc_feature (554)..(554): n is a, c, g, or t
  misc_feature (560)..(560): n is a, c, g, or t
  misc_feature (580)..(580): n is a, c, g, or t
  misc_feature (592)..(593): n is a, c, g, or t
  misc_feature (595)..(595): n is a, c, g, or t
  misc_feature (602)..(602): n is a, c, g, or t
  misc_feature (608)..(609): n is a, c, g, or t
  misc_feature (613)..(613): n is a, c, g, or t
tacccaaaaggagactcggtcagccaggttcctgcaatcaggatagggtgaagggaaaacaaggtgtttttgaaattagaatgtccgataaaaattatacctagaattgttaacttagcaaaggaagtctagggtggggaagctggtggacccatgcccattagatagataccttcaagggtgacttagacgtccaccctgagacttcgcgttatgctaattgtgatcattatggatcccctcagtcacattagggggaaagttgattggctataagtactcattcttagtccagtcagtcttaaaacatcttgggttaccccctctgtccactcccataggctacagaaaaagtcaccagcgcatggtttcccaccatatagtgttttctncagttatntctcttgttctggccnaacnaccctaaaatccttaccattccacnaagtnggaccatcacntgtgcacccacnttgactatgagtataccnccacnttgcanttctgttngcaccatgtcntcnnggagactagactactgttgtccngggtcnatttgngtgtaaagaaaatgtagacnaggaattgcccnntnttaaatnctgacnntgcngacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacca

SEQ ID NO: 624173 - DNA, 434 bp, Homo sapiens
  misc_feature (116)..(116): n is a, c, g, or t
  misc_feature (368)..(368): n is a, c, g, or t
  misc_feature (411)..(411): n is a, c, g, or t
gaccagcttggacaacatggcaaacccctctacaaaaaaaatacaaaaagaaaaaattagctgggcttggtggtgtgcacctgtagtaccagctacttgcggggctgaggtgggangatcacttgaacctcagtgagccctgatcactgcactgcactccagctttggcaacagagcgagaccagcctcaagtgatttgcctgcttcagcctcccttctgagattacaggcatgagccaccatgcctggcccactttaagcattttaagtgtgcagttcagtgggcataagtacgttacacatatgcgctgttagcactatccgtctccagaactttttcatcactcattttgaaacaaggatgatantctcaagggatgttgtgagattgaattatgagatgaagtgcangcacagagagggcactctgtctt

SEQ ID NO: 624174 - DNA, 335 bp, Homo sapiens
  misc_feature (95)..(95): n is a, c, g, or t
atccctaaatccttgggcaataacaaaatctaagatcctaagatcatgatatttaaggtaggaaaaaagtaatcagactagaactgggccgccgngtgtcacgcctgtaatcaatcccagcactttgggaggcagagatgggtggatcacctgacgtcgggagttcgagaccagcctagccaacatggtgaaaccccatctctactaaaaatacaaaaattagctgggcatggtgccactgccttccagcctggatgaaagagcgagactctgcctcagatctcacctgagatcaggagttcaagaccagcctggccaatatggtgaagcccgcc

SEQ ID NO: 624175 - DNA, 241 bp, Homo sapiens
aaaaaggggggtttgggggccccccccagcctttttttaaaaagcccccgcggggttttttttttttaaccccgggggggggggggggggtttaaaaaattccccccttttttttttttttagggccccccccttttttttgggggggttggccccttttccaggggggcctccttttcccgggggggttttggggggggccctttttttttcccccccccctccccccaaaaaaacccca

SEQ ID NO: 624176 - DNA, 889 bp, Homo sapiens
  misc_feature (34)..(34): n is a, c, g, or t
  misc_feature (91)..(91): n is a, c, g, or t
  misc_feature (174)..(174): n is a, c, g, or t
  misc_feature (209)..(209): n is a, c, g, or t
  misc_feature (213)..(213): n is a, c, g, or t
  misc_feature (268)..(268): n is a, c, g, or t
  misc_feature (270)..(276): n is a, c, g, or t
  misc_feature (289)..(289): n is a, c, g, or t
  misc_feature (296)..(296): n is a, c, g, or t
  misc_feature (299)..(299): n is a, c, g, or t
  misc_feature (346)..(346): n is a, c, g, or t
  misc_feature (360)..(361): n is a, c, g, or t
  misc_feature (364)..(364): n is a, c, g, or t
  misc_feature (367)..(367): n is a, c, g, or t
  misc_feature (370)..(370): n is a, c, g, or t
  misc_feature (375)..(375): n is a, c, g, or t
  misc_feature (380)..(380): n is a, c, g, or t
  misc_feature (387)..(387): n is a, c, g, or t
  misc_feature (394)..(394): n is a, c, g, or t
  misc_feature (399)..(399): n is a, c, g, or t
  misc_feature (409)..(409): n is a, c, g, or t
  misc_feature (412)..(413): n is a, c, g, or t
  misc_feature (416)..(416): n is a, c, g, or t
  misc_feature (421)..(422): n is a, c, g, or t
  misc_feature (424)..(424): n is a, c, g, or t
  misc_feature (426)..(428): n is a, c, g, or t
  misc_feature (430)..(430): n is a, c, g, or t
  misc_feature (440)..(440): n is a, c, g, or t
  misc_feature (444)..(444): n is a, c, g, or t
  misc_feature (472)..(473): n is a, c, g, or t
  misc_feature (475)..(475): n is a, c, g, or t
  misc_feature (484)..(484): n is a, c, g, or t
  misc_feature (510)..(510): n is a, c, g, or t
  misc_feature (523)..(523): n is a, c, g, or t
  misc_feature (566)..(566): n is a, c, g, or t
  misc_feature (598)..(598): n is a, c, g, or t
  misc_feature (639)..(639): n is a, c, g, or t
  misc_feature (681)..(681): n is a, c, g, or t
  misc_feature (851)..(851): n is a, c, g, or t
ttgtagcaactctggattctttagtataaagagnaatcaaaagaaacaaaatatctatagtcttagtttcagaactacactaggatctggngacctaaaccatatgtacagaatataaacatatttatactttatatgtacatagttaatggttacctatgcattataaatagnaagtttaacttagattctacaaaaataatcatttngggngggtacatgcaaaccagtacacataaacctatttataaaacacatctctatgctntnnnnnnnggcttctaaatanaaatttngcnatttagccatcagctaaatgatctaaatgcaaaccccaaagtttccngttaaaagtataannccngcntcnaaccncagcngcatacngcttcangtatnccccccctangtnnggncgggnnantnnngncacatatgantttngggggggcatctcatttcctcacatatnngncatcctgcnggggtcacagcttctttgttccattngtctttttttgtngttttttaataagacattgcaaacagtagctatttcttaaagngacataattttcgcttttgcattctgataaanatgaacatacttaagcctcttccttgcaccctgaccctggngctctagcataatgcaacaaatcctacgctcaatggtttgcngggccatccacgcgaggcagatgactgggtggccacaaaaggctcattttgcttctggtcctctttcatgccagctgcctggtctgtgatcgaggagaaggacagttggtcatgctctatgatgtgcacctgatcctcgtccttgtccttcttcacatagaacatttttnctgaattttttcagctcatggagttcacagaaggtttc

SEQ ID NO: 624177 - DNA, 101 bp, Homo sapiens
taggatccccctgtagtacctccacctctttcttcagtgcgcgctgatctcggcatcttggccttgagcgcctccacggcaggcggggcctgggtcgatgg

SEQ ID NO: 624178 - DNA, 910 bp, Homo sapiens
  misc_feature (51)..(51): n is a, c, g, or t
  misc_feature (87)..(87): n is a, c, g, or t
  misc_feature (249)..(249): n is a, c, g, or t
  misc_feature (337)..(337): n is a, c, g, or t
  misc_feature (344)..(344): n is a, c, g, or t
  misc_feature (348)..(348): n is a, c, g, or t
  misc_feature (350)..(350): n is a, c, g, or t
  misc_feature (372)..(372): n is a, c, g, or t
  misc_feature (378)..(378): n is a, c, g, or t
  misc_feature (401)..(401): n is a, c, g, or t
  misc_feature (423)..(423): n is a, c, g, or t
  misc_feature (448)..(448): n is a, c, g, or t
  misc_feature (466)..(466): n is a, c, g, or t
  misc_feature (469)..(470): n is a, c, g, or t
  misc_feature (473)..(473): n is a, c, g, or t
  misc_feature (475)..(475): n is a, c, g, or t
  misc_feature (481)..(481): n is a, c, g, or t
  misc_feature (486)..(486): n is a, c, g, or t
  misc_feature (493)..(493): n is a, c, g, or t
  misc_feature (496)..(496): n is a, c, g, or t
  misc_feature (498)..(498): n is a, c, g, or t
  misc_feature (526)..(526): n is a, c, g, or t
  misc_feature (534)..(535): n is a, c, g, or t
  misc_feature (542)..(542): n is a, c, g, or t
  misc_feature (548)..(548): n is a, c, g, or t
  misc_feature (553)..(553): n is a, c, g, or t
  misc_feature (614)..(614): n is a, c, g, or t
  misc_feature (622)..(622): n is a, c, g, or t
cttgtcaactggatctggcgcttctactttgagggcttctttgacctcatngctgtggtggccggcgtagtccagaccatcctatantgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcaganacttaactcttttgttgcagatagtcatcagtggctctgtaaaaacgcagaggaaaagagccagaaggtttctgtttaatgcatctgnccttatntttntntattactgtgtacaaagatttnttacanaaagaaacttaatgctgtattantaaattcagtgtgtagcttcantgggatagttccaaaagtgaagatntgtgaggaataagtgcanatnnttntnttattnaaacnattcttngananctcttaagtcttgtgtctgcacgaaatngtactccnntgacagntgatanatatntatccttccatccctcaacttgcattccactatatttatttctggcaaaagatgagctganttgttganatctgagacactatgtacacgtggaatgtatcgtgccaatagatgcccacgtgacgaggcaggtcccaccgcagggtggtcacaacactacatacacacgatcggcacgactactggacggccaggtatgcataacaacactaaggacggacgcacaggcacccagaaaaaaaaggcagacacaccctgcgaatgaagagagagccaagggcgaaaaaaggaagacgcagacaacacgcgagaggacaaaaagaaaccagcaaaaagacaacaaaaaaaaaaaagaaa

SEQ ID NO: 624179 - DNA, 362 bp, Homo sapiens
gcggggttgaatgcgattctcgcgggcctcagcctcccaagtagcgggaattacaggcacgcgttaccatgcccagctaatgtcttgtatgggcaatagagacgtggttgcaccactattggtcaggcgggtctcaaactcctgacctcaaatgctcccccaactcaggctcccaaagcactgggattacaggtgtcagccacctcaccgggccctggccactttgtgtgtgtgtgtgtgtgtgtgtgtgtgtgtgtatgctcgaaacaaggagtagcctctgctcgcccaggcgtggtgtgtgtgtgtgtgagacaaggactcaatctgtcgcccaggatggagtgtgtgtgtgtgtgtgc

SEQ ID NO: 624180 - DNA, 545 bp, Homo sapiens
  misc_feature (51)..(51): n is a, c, g, or t
  misc_feature (87)..(87): n is a, c, g, or t
  misc_feature (228)..(228): n is a, c, g, or t
  misc_feature (231)..(232): n is a, c, g, or t
  misc_feature (244)..(245): n is a, c, g, or t
  misc_feature (252)..(252): n is a, c, g, or t
  misc_feature (275)..(275): n is a, c, g, or t
  misc_feature (394)..(394): n is a, c, g, or t
  misc_feature (409)..(409): n is a, c, g, or t
  misc_feature (527)..(527): n is a, c, g, or t
cttgtcaactggatctggcgcttctactttgagggcttctttgacctcatngctgtggtggccggcgtagtccagaccatcctatantgtgacttcttctacttgtacattacaaaagtactcaagggaaagaagctcagtttgccagcataagtgccaaagaccatcaccagcatctgtccttcagggtgctcggacagaattcttaccacagcaaaggcataacanccnncagacccaaaannacaaaangaaagaggggcggcaacagacgnagaacgccagagcgaaaaaacaacaccaaaacaccaacaaccgggagcgggaagcaagaggcaaggagagggggggaggaagcgcgaaaaacagggggggaaacaaacaaaaggaagcngcgaggaagaaaggnacgcgcgaccggcaaggcccagacggaaaaaacgcaacaggggcgcaccaagaacgcaaaaggggggggggaggggaaaaaaggagggcaaaagaggaacgggtgtgtcgtcgtgcanagtcaaagtgtcgtagtg

SEQ ID NO: 624181 - DNA, 230 bp, Homo sapiens
aagtatccccgcccgttacacagttcaaagaaaactatatctttctgctattatgcatagtctctgatactacgtacatatatttccaacatcagagatctgatgtgtgcgcaattcaggttaaactgtgacaccaaaaagtccactggattgagacaagactcagtgtggtagcatatagcattttaaattgccatatatcatcttacaacatgagctgttgtaactgg

SEQ ID NO: 624182 - DNA, 402 bp, Homo sapiens
tgttgccgtagtaattgttactaatcattcaaattgagtgtaccagaccttaacagtatgaatatgccaagatcacagtaagtaaataactgagccagaagtgaagagcacatgtgaacagatcactactaccacggagatggagaaacatcacacaatggattgctaattggtcgatgtaaacatgaccacgaaatggaatattgtgacacctaaatggaagttgaactaagtcagatgagacacgcagttgtagtgtaggaagtcatgccgacatggaacgaatgagctcactttctaccacagctgcgggcaatgagtgaacagcttaggtgagacagtgtcaagaacactgcgctcagcagtgcgcgacgcatatcagtgtactagcatattcagtcc

SEQ ID NO: 624183 - DNA, 204 bp, Homo sapiens
ctatagataagtcacttgagatgaaatgcttggggtagcttttcccctcaaactataatgttttaactagttcatagtgtttggaacagtatatgccaatcactgagactgcatcagagtttgcaattttgtatgtttattgccaagaaggcttagtgcttgttgactggtagtataattcagctttgctgtagcataacgatt

SEQ ID NO: 624184 - DNA, 102 bp, Homo sapiens
cagcgaaactactacagtctctccctccaagaccaaggtggctggcagcttttccccaagtcagactccaaagcccttgacctgctggaccggatgttaacc

SEQ ID NO: 624185 - DNA, 807 bp, Homo sapiens
tctgtgcattaacgtcagtggctttgcatagctttcacaagtctctctatgacactcctcacgggaaactcaaggaggtggtgaatttttaatcagcaatattgcctgtgcttctcttctttattgtcactaggaattctttgcattccttacttgcactgttactcttaattttaaagaccctatcttgccaaaatgttggctgcgtactccactggtctgtctttggataataggaattcaatttggcaaaactataatgtaatgtcagactttgctgcattttacacatgtgctgatgtttgacaatgatgccgaacattaggaattgtttatacacaactttgcaaattgatttattacttgtgcacttatgtagtttttacaaaactgctgttgtgcatatgttaaagcttattgtttactgttggtctttatcgatttctatgtacacgaaagtgtctctttgaacactgatacatgctagagaatgggacattttcttgttatgtatcaggttgagaatcacattgttcaagtgctctcacactttcgtatgtcgtgtaggagctgtaaactattttttgttcacgtgtgcatatagcatgaagcgatatgttcagcacatgtaacccaccgtgtacatctcactcgaactatatgtagctgatattagatagcaaatgatatacagctagaattttagtcctgacgctacggggaaaatgcattttcttcaagaattatccattacgtgcatttaaactctgccagatagaaataactaccttggttaatcagcgtgtt

SEQ ID NO: 624186 - DNA, 1081 bp, Homo sapiens
  misc_feature (839)..(839): n is a, c, g, or t
gcatcatgttgcccaggctggtctcaaacttcaggattcaagtgatcctcccccagcactttgggaggctgaggcgggtgggtcacgaggtcaggagatcgagaccatcctggctaacatggtgaaacccgtctctactaaaaatacaaaaaattagccgggcgtggtggtgggcacctgtggtcccggctacttgggaggctgaggcaggagaatggcgtgaacccgggaggcagagcttgcagtgagctgagatcgcaccactgcactccagcctgggcgacagcgagactccgtctcaaaaaaaacaaaaaaggtgcacacttcaccttccaccattgcccagttcacactgttccgtggcttctcgtggcctttctttttcctccctcaggcagtcctatattccccttctgcagggtgacttgcctgtgcccccaccaatctctttcccaagaacttcacctggctggaccaggtctcagcttcagtggccagccatcccctggggaccacccaagcctttccctcttcccagaattcacccttgctggactggtggctcaagcttggtagcaattcccttgagatacggtctcccttgcaagaggcctttggagctcttgaagatgtgtgcccaccgtagaaacggcttagatccttgtgcgcctcttaaaccctcaggaggggtgtacagagagccaacgcttccagagaccccttgtggtcaacacaaggttgtctccccattgtggacaccacatttggccagggaaacaagactctgacaaggcaaggggcgatgtggttggccccctgacttcagcggaaacaaggcncgttacgtggaaaaaagcgcgagatgaagtgagcccagaacggcgaggggcgactagaacaccagcaaagtcagtccgacagaaagagcgagccgtggacgacgagcacagtgtagtggctccccacggcaaatcgacagggaaaaaaagcgggcccctataagaggcaccaggggaaaactttgggaccagcggagtaaaggtggacacagggggttgggcagaggtgccagaaagtgagg

SEQ ID NO: 624187 - DNA, 191 bp, Homo sapiens
tctgatatgcagtctcaaaaaaaaaaaggggaggggagcatgtactagattccagattcataaaatttccaggcctataccccagaggaaattttatcagcgggtaaaagaatttctcaggctctataaccttggcagagtaggtaaacaagtcagaaacaagatatcctggaattacttgatttaggaaa

SEQ ID NO: 624188 - DNA, 141 bp, Homo sapiens
tagaggatcccaacacgcatctacagctctgtgcatttcacacatagatctgtagctacaatgatgccaccgtcacgtaggaattatagggctactcagaaggtacccagaacacagaacagtttaggggtaatagtaaac

SEQ ID NO: 624189 - DNA, 421 bp, Homo sapiens
aaggctggtcagggacatctgccgcatgtcagtacaggtatgtccactattggtactgattcgccagtccatgtgcgcatgtaaccctgaagcgtcgcctctggcctagaactcgtctttgtagtccagcagcgcttctttcaatgctttgtagctgtgcatctccaccatgcgctgtgagcccacgtacagcgtgaacaccggccggaagtgctggcccaaccgggtgaagaacttgggaatattcttcaattccaactggaagatgttcccgatgatgtgaagtggcaaagggcctgggggcagattccagatcatgtgcacttgcctccacatggactccagctgtagtaagtcagcccacaccagcaggccctcggtgactccgagggcatacatggtgccgctggggccgtgctgc

SEQ ID NO: 624190 - DNA, 170 bp, Homo sapiens
  misc_feature (16)..(16): n is a, c, g, or t
tcgtgatctgcccgcntcggtctcccaaagtgctgggatttcaggcatgagccaccacgcccggcctgtatcaggtattctggtgaatatgtatttacatcataacaagagcaagtaaggattttatgcaattccatggcatattagccttgatagggaagtcagtttgg

SEQ ID NO: 624191 - DNA, 367 bp, Homo sapiens
agctgggtgacatcgagaagatcgggtgccccactctcggatattcatcgagcctcaccaagctacatccaggcacagagtatgtggtcagcatcgttgctcttcatggcagagaggaaagtcccttattgattggccaacaatcaacagtttctgatgttccgagggacctggaagttgttgctgcgaaccccaccagcctactgatcagctggggatgctcctgctgtcaccagtgagatattacaggatcacttacggagaaagaggaggaaatagccctgtccaggagttcactgtagcctgggagccaagtctacagctaccatcagcggcctttaacctggagtggattataccagtcact

SEQ ID NO: 624192 - DNA, 316 bp, Homo sapiens
actgtagcgatcttatgcggcgcctttctgcattgaaaggtaggatccacagcaatcccctcattctctatagggagtatgaaccactcctcttgtctctccaggcaggaggctgagttcaataacgtccatgggagaactcttgacttgtacccacatcctaaacgtcactggtgagtcaggcaatggcaattactcagttctccatataccctgggctgactgtctggaggtactgtggcaagagcgaacctccataacctgttacggtccaactcggcacggcaaacttgagctcaagctccaactggcctgg

SEQ ID NO: 624193 - DNA, 120 bp, Homo sapiens
tatgagatataaataaaggcaacgtaattaaaggctcactccacacttattctaggggatgattaaagagagtagtttagaaggtaatagcagctaggtactgtggctcaatcccggtga

SEQ ID NO: 624194 - DNA, 1010 bp, Homo sapiens
cgctctcttacgtgggtccttgtgtgttgtcgcctagtcctccggcagggtcgtcatagctgtgtgtgtcttccccagtagcttgcccaggtctcactaggcgtggtgcccacacagtcggagtttttatgagtattccgccaatcctctctcgttacgtgggaattgtgggccccgccctggggttgtacttgtgcatgcacggtgaggtgtccaccccccctggggcagtggtgaacaaacgtggcgcctttgcattgggcgacccatttattgggccgggtccactcctcttggtctggggaattcatcatgccccaatcactagggtaatgttataatacatacagtggtccgcgggctgtttgataagccaaacctgatatctagcgccgtatatttgtcgtcaattatctctatggagggggtgttatttatcccaccacccccccaaggtttttgacaaatcttttgtccgtaaactttctctgggccccacgatgttttgtgccgtagatccctgcacagaaagatcggtttctaattagcgaaacgcgggtcctccacaaatagctatgggttcacgggaatacaccactgtgaatggattcttagagcaagggtcttgttacaaacgggtcttcttacaattttttttggttccttaacaccccggctctggtgggcgtcaccaccccgcctgtgccgcccccttggggggtacgtagcctctcgttggatcctcccccggcaggtactcagcatcttcccagatcccttctcgcggctcaactcaccttgcgactccctctttctgttgttgcgatcatggccaatcaattctttgcggccctggttggcgggcgcccgtcatcgcacggcaccttcggggggctgaccgcgcaccggaggcttcaattctcgctccctggggatttcgtgggtgttgttggggggcggtcccccctccctcaccccgcgcgccaaaaggacccccgcccacaaaaaca

SEQ ID NO: 624195 - DNA, 414 bp, Homo sapiens
  misc_feature (122)..(122): n is a, c, g, or t
cagtaatttcgaagcaccatgtaaggtcatgatacgagggcatggatgtcgagccaggtatgccagtcgtgacagcacaggagattcattcattcagatctcattctgacagtcaagctcgngagtcaagtggtgtctctccaatgtgggctgcgagtaggcatggccaggagccgcctcaccatcgaaggggtgtgtcgcatggaagccctcgcaaagaagatcatgatgtcggctgcttctcatggccctcacggatgtaggcatagggcacctcgcggaagcccagtggtgtggcactctcccacacgcggaacgccttgcgaatggcctcgtatgtggcatactcgcccaccgtgggggtgtaattctggatgccgaaggtgattcattatgtcgctatcggagagaggg

SEQ ID NO: 624196 - DNA, 145 bp, Homo sapiens
ccccgggggttttgggggcccttttcccccccttttttgggttccccgggcgttgggggggggggtggggggggttttcctttcccccccccccccctttttttcccattaaattttttttttttttttttttttcccttgggga

SEQ ID NO: 624197 - DNA, 453 bp, Homo sapiens
  misc_feature (5)..(6): n is a, c, g, or t
  misc_feature (240)..(241): n is a, c, g, or t
  misc_feature (244)..(244): n is a, c, g, or t
  misc_feature (323)..(323): n is a, c, g, or t
acccnngcacgcgtccgttcaactgtcccatcacttgtttgtatatcataataaccgcttaacgagcgaataattcgtcctgttttcataatgttattgtaacaaaaaagccgaccgtaatcgacttgaatttacttcaccatcaggcaaagcggttatttagatgaggcactcgcactactgcttgaagtgctacttgatgaactactacttgagctacttgaactgcttgtactactnnttnaggcgcgcttgtatcttgtggcccttgtgaaatcgtcactaacaaaaccatatccttggtaatacttgaaccacctcgnattgattgactgatcacataatcttttttcgtgtcccatcaaactgggtgttaaattaaccacgatactgtgctgagttgccaatcttgtacttgttgctgggtgcttaccgtgaatccgcacacatctg

SEQ ID NO: 624198 - DNA, 323 bp, Homo sapiens
  misc_feature (34)..(34): n is a, c, g, or t
gctcagggtttgtgagtgcaccaattcaacactnctgatctagctgctctggtggggccttggagaacctgtgtgtcgaaactctgtatctaactaatctgatggggacgtggagaacctttgtatctagctcagggattgtaaacgcaccaatcaacgacctgtcaaaacaggccacttggctctaccaatcagcaggatgtgggtggggccagataagagaataaaagcaggctgcccgagccagcattggcaactcgctcgggtccccttccacgctgtgggagctttgttctttgcaataaatcttgctactgctcaaa

SEQ ID NO: 624199 - DNA, 200 bp, Homo sapiens
cacttgttaatgggataaccagctgagttgtttagatattagtgatataaggaatggtaaatccatagcaccatttcaaacgacttgttgtacactcgatttctcatttagatgtgtgacgaagatctccacctgtaagggcaagtatgccaatgccacaagccgtgtatttgcgagggctccagtttgggcattttgtc

SEQ ID NO: 624200 - DNA, 133 bp, Homo sapiens
atctagaggataccccagcaacatgcttcgtgcacagccttacagaaccatgagccaaaatcatgcctcttttccttgtgaaattattcacccttgtggttattcctttatagcattgcaacacggtctctca

SEQ ID NO: 624201 - DNA, 311 bp, Homo sapiens
aggtgcactggctctaggaggaaaagatttatgggattaccaaaatcactgagaagaatgctttgattaaaatgcaattggccggagtgcaatggctggccggagtgcaatggctcacacctgtaatcctagcattttgggaggctgaggtgggtggattacttgaggtcaagagttgagaccagcctggccaacatggtgaaacctcatctctactaaagatacaaaaaattagccggacatggtggcgggcacctgtaatcccagctattcaggaggctgaggcaggagaatcgcttgaacccgggagg

SEQ ID NO: 624202 - DNA, 437 bp, Homo sapiens
  misc_feature (192)..(192): n is a, c, g, or t
  misc_feature (436)..(436): n is a, c, g, or t
actgaggactctgcaaagtaaaccagtaaaccaaagctgtggaggtggcccctgtgggaaagccgtttcctggttttatcttcccttttctctcgtagctttgccccaggatggcctcagttacggaactgcacagaaacacggaaagctaaaactcccatagaaaccttgtccttttggcaagagaaattntgaacaggggccactgaggtccagaaagcgtgtggtgggggaatcccagaagggagcgagtgggagaaagaggccttgggactctgaggaggaaccagcagcagccccggctcccccacccgagctgcacctgtgtggggtgcactcagagaagcaacaggaattggctttgaaagtggaacctcgactggagcagaggcagcagaactttgtggttggaactaaccaggttgatgggcatttna

SEQ ID NO: 624203 - DNA, 131 bp, Homo sapiens
cctgacttcacatagccttaactaatttacctttttttttctttttccttctttctttcatttctttctttctctttctttctttctttccctttctttctttctctctctctcccttctgtcgtcttctc

SEQ ID NO: 624204 - DNA, 164 bp, Homo sapiens
caagacagcttgtttctcttcattttaccacccaactcctgacctattataaatgtttaaacagagtgagagtagaggaagagttcccatcatagaccagtgggttaagaaccaaatgcagtggctctggtcactgtggaggcaagagttccactcccagctcc

SEQ ID NO: 624205 - DNA, 301 bp, Homo sapiens
  misc_feature (209)..(209): n is a, c, g, or t
gggtagcgatctgcaggaggtatcgacgaacttcaggtctggtctgccgtaaggtcctcgggccactttggtcagctcctccatccacatgcaataaaacagtcctttccacaccttcaggcagctcgtcgtgcgtaaaaccacctgcggcccgtgagtcctggcgacgatgtatttccggagcttcctcactctgtctttcttcccangccttgcattcttcacgaaccttcaaggtactcgttcacggaccatccgcatgagcatgtagaatttatccaggcgcagccggtaaatagcc

SEQ ID NO: 624206 - DNA, 778 bp, Homo sapiens
  misc_feature (4)..(4): n is a, c, g, or t
gggnagatttaaggctaggtagcgaggctgggtgttggtggaggggtgcagtggtcacaccctgctaatccctagcactttggtgagaccaacggcgggtggatcacgaggtcaggagttcaatgaccatgcctggccgaagatgatgaaaccctgtctctactaataaatacaaaaaaaaatattagccaggcgtgtgggtgggcacccgtaatcctcatgtctacttggtgaggctgaggcagagcaattgtattgaagtcgggaggtggcatggttgcagtgaggccgagatcgcactccagcctgggcgacagtagcgagactccgtctcaaataataaaacaataagaaagaaacacttttggtgctggaggttcaagccaggtggtgcgtagggcgcctaaatttgttggcgttccaggagatcttgagatttggcggtccctcttgtaaacatctctaggacaggtatagtccccatcgacgcacgattctactttgtgtggacttcacgccggagcgtccctgcgaggaggggttaggagcaaggttcccctggtgggcacctccgcaggaactgttgaaggggcgcaagccgtttgcgtgttgtagacatgtcgatttggaggttccccatgtccgccgtggtgaccctccttaatattacgccttttgttggccccttgggcctccttgtagactcttggcccgtggaaccccccagtttctgggttgggacagggggccccctccagggcccggctcctgacattct

SEQ ID NO: 624207 - DNA, 700 bp, Homo sapiens
  misc_feature (76)..(76): n is a, c, g, or t
  misc_feature (93)..(93): n is a, c, g, or t
  misc_feature (131)..(131): n is a, c, g, or t
  misc_feature (459)..(459): n is a, c, g, or t
  misc_feature (472)..(472): n is a, c, g, or t
  misc_feature (480)..(480): n is a, c, g, or t
ggctgaggagccgaggtggtaaaagatatagagacagagaggcagaggcaaggagagacagagacagagaggcacngagagagagagtcaggnagagagacagagatagagacagagagacagagacaggnagggagacagagagggacggggagagagacagatggagagacagagatatagagacagagacaggcagagacaaggagagacagacagggagagagacagagagacaagagacagggagagggacagagatacagagagacaaggagagagaaagatagagactgagttggagagacagacagagatacagacagagacagagagaggcagagacagagaaacagactgggggtgacagagcgagcgagaaggcaaggatcctgctgctgttaagtggagaagccgtgggggtcctgtcctgcagtcacggtggaaggaccctgaccnggtggaggtgganagtgtggncagcagtggctctgtctcctcggctcctcccatttctcagccgcagcgggggtcctgcctgcctggcctgggctcaggggggcggggtgcagagccaccctggcccatcacagcttggggtgaagcagcccagagccagccgccccgctgcagccacggcgccctaaaaacggcccgggagctgggaggggcggcctggcttgcgctgtagtacacctgc

SEQ ID NO: 624208 - DNA, 229 bp, Homo sapiens
  misc_feature (45)..(45): n is a, c, g, or t
  misc_feature (72)..(72): n is a, c, g, or t
  misc_feature (164)..(164): n is a, c, g, or t
  misc_feature (179)..(179): n is a, c, g, or t
  misc_feature (182)..(182): n is a, c, g, or t
ctcactctatgtcccgctctgccctaagcctatttatttatttgnttatttatatttttgaggtggagtttnactcctgttgcccagtctggagtgcaatggcgcgatctcggctcactgcaacctccgcctcccaggagaatggcatgaccccaggaggtggngcttgcagtgagccnagngggtaccactgcactccagcctagatgacagagcaagactctgtttc

SEQ ID NO: 624209 - DNA, 250 bp, Homo sapiens
cagccggaccgactcacactcatctgcttagaacaaatactgctaagtacattaatttcctttttattttcttttgaaattttttgtagagacagtgtctaactctgtggcccaggctagtctcaacctcctgggctcaagcaatcctcctgcctcagactcccaaaatgctgggattacaggcatgagccaaccacattcagccttaattggctaatgtttggaacacatcactttctgcagatgaggt

SEQ ID NO: 624210 - DNA, 738 bp, Homo sapiens
agcgggtgctgctgcttcgctccgcggacctgacgccgggacggagcgtcccccgtgcgccggccggaaacccggcaggcggcgaagatggcggagaacagcggtcgcgccggctagagcagcgggagcggcgcggggaagggggcggctgtccgcagagcaggtgattgctggcttcaaccgccttcggcaggaacagcgaggcctggcatccaaagcagctgacgttggagatggacgtcgaatgagcaccagcctagtgactcgatacagctgaacggaggtagactgaaacctcgttacgtgctaccgcatggttggacggagtgctggtggattcgaactgtctagagaggtgctgcccgcgttcggagaacaacaaggagcagatacagaagactcattgagacactgacacagcagcttcaggcaaagggaacaagacactaaagtgaattccgggacaagcacaacattcgtctcatgggagaagatgacaagccagcagccaaggacaagcgtcagaaggggctggggcgtaaggccagctcaggctggagtgatggtctccctagggaccaaggccttatgcctttgttttactactcgctgaagtcccactttctaattttccttctttactcggtcacttattgacttagtctggcatctggctaattgtaactatctgcatcgctaattcaaagtgttctgggtcccgagacagtgatcgccccc

SEQ ID NO: 624211 - DNA, 190 bp, Homo sapiens
  misc_feature (29)..(29): n is a, c, g, or t
  misc_feature (32)..(32): n is a, c, g, or t
tttgaagcaagacccttctcaagccttgnttntgcgactgtgaagaaactgcagccaggtgcagtggctcatgcctgtagtcctagccactcagacagctgaggcaggaagatcgcttgagcccaggagttagaggctgcagtgagctgtgatgatgccactgcactccaaccagggtgacagaatgaga

SEQ ID NO: 624212 - DNA, 868 bp, Homo sapiens
  misc_feature (306)..(306): n is a, c, g, or t
  misc_feature (449)..(449): n is a, c, g, or t
  misc_feature (451)..(451): n is a, c, g, or t
  misc_feature (453)..(453): n is a, c, g, or t
  misc_feature (456)..(456): n is a, c, g, or t
  misc_feature (459)..(459): n is a, c, g, or t
  misc_feature (463)..(464): n is a, c, g, or t
  misc_feature (481)..(481): n is a, c, g, or t
  misc_feature (488)..(489): n is a, c, g, or t
  misc_feature (494)..(496): n is a, c, g, or t
  misc_feature (501)..(501): n is a, c, g, or t
  misc_feature (528)..(528): n is a, c, g, or t
  misc_feature (537)..(537): n is a, c, g, or t
  misc_feature (554)..(554): n is a, c, g, or t
  misc_feature (558)..(558): n is a, c, g, or t
  misc_feature (560)..(560): n is a, c, g, or t
  misc_feature (568)..(568): n is a, c, g, or t
  misc_feature (574)..(574): n is a, c, g, or t
  misc_feature (577)..(577): n is a, c, g, or t
ggtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcaagccgcgggctaaggagtcgcgaggttcccccagctgccaccatgaaccccgagaaggatttcgcgccgctcacgcctaacatcgtgcgcgcccntcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagaancncncanagncggnnaagggggcctcatcggnctgaccnnactgnnnccatngcactgggcaaggactcagggctctanctgaaggangctgatcgagccagtgntgancntgcttcanatgatngcnagacagcacgacttgcgcttactattgcctgcgaaggccctcatacaacaatcgtcaaggtgggccgggagcagctgtgcttgcccccacttcaaaggtgcctctttgaccgggcttgagcaagcatgagcagcggacaccaagaaccccaatgtgaaaaagacggaatttggagaatcctagacccgctttaagaggacattgctgactgacggccacgaaggtttagctggtacagcttgatcccgttgatgcaaacagaagtattaataccaaaaaacaaatatggcc

SEQ ID NO: 624213 - DNA, 296 bp, Homo sapiens
tccactagtgtaggcacattgcgtgtggtctttacacatgttaattaatcttcctgacgatgcactgtgcataaggaagccctttatttccctgggactactgatgaccaatatgaatgccagactgattatgttactgttacctgacccacatgcttgtctctggacgtacttagctgctttattcactacctctgatatgccatcacatggcagatagactgctcacattactacgtgaggcagagctgacacagctaaggtggatggtcctcatgaagagaacattcattcta

SEQ ID NO: 624214 - DNA, 1073 bp, Homo sapiens
ggttgtgctggttaacgggagagaaaagttcaacgaagatcttgacatatattgagcatggacaatggcgtagctctctgaggggctatgcaacatgcacgtctatggatagcgacagaagtctcccgttggctactatctgcatgtcatgtcgagcacatagtactgagatgcctagtgatgccacggcacacggtgaactctggggattcacggggtaactaaggcagattggaaccctgcccttgttgaagacttgcagctctagaagggggaagacggtgaccatcgaaagtttctacgctatcaagagatgctgagctagtcttaatctctttggccttcgtatagccaatgcattctaattgttaaaaagtcaatcatgtacgagattagccttgggttcacacttttcaggagtcgaagaccttggtgtacaatgtcgagggcatattagcaagtggggaactccagaatcgctggatggggcccttatagaaccaaggcgtactgtttacaacacagtccgtatatatcttttaacggcccaagagtagcggtttgggcttgcaaccacccctcgataagtccccacgacaccttgttgtgtgcagcggcatacgggtgtgggttggaattcactgaaagggtcagggaagggttccgagaatccagggcgctctgggccaattaatcgacttgaaaatcgtgaaatccgtcatacctagggaatacttacaatttaggcctttagggcccagggggcaggtggggatgggctgcaaatgggcgcttgttaagtttccaccaccggcgtcaggcttcccgtgggaataaacatatgagggggaggaaaagaaagtgccgcttatgaatcccctgtggagaaggccgtgagtggttggcatgttgcaagcccggggggattccttcggttcaccctggtgacttacccaaacccttggtggtgcaaagaagtaggaagaaccacccagctacttcatatcacaacacttataaggaagataccgcttttgagctagaaaccgggggaatctctgcaaaaacaacgc

SEQ ID NO: 624215 - DNA, 153 bp, Homo sapiens
catcatggggtctggataccatccagaatacgaggcatcgccaatggaagaaagaattacaataatgttgctctatgctacagccctacactgagctttttcttcattcctctaataacaactttgcaaggtagaaatttttatctacatttc

SEQ ID NO: 624216 - DNA, 685 bp, Homo sapiens
tctgtagggggcatttccttcttaggatcctttaaaatcagtctggggaaagtgaaaagggggaattacaccattacactcaagccgggtccgccctagggaaaggtttttttaagaagggtatttcaagaatagattctaatacccttccttcccccccctggttgaggtggctctccccgggacgtcagcgattagacctttgtaatttttggtggacggctcctcttttgctagtgagcccagggagtgcaacacaaaagtgtcagtaccattactagtgtgtaaagggcttcaacacaggtgttgatttgattctgtgcatgatagccctggggtacatcttctcctctgatagcatccaacacatcctgttcatgtacagcgaagtttagtgatggctggagatctttaaagtgaatgaatgggcgttggtttctcatagctccacagggggtccatagtcagcatgcagtttttccgtaagttgtaatcgtgccaaaagagtatgctggaatgtctgcagctcaaataactgctcagggggatgggcaccccatgttgcgttcagtgatcatgacacactgcagggctataacaaagcatctcatgtcccccataattatattctccttgtacccgcaaaacttcaaatataagatgtgtaattgacaataaagagaat

SEQ ID NO: 624217 - DNA, 833 bp, Homo sapiens
gctaggtcgagcctggtgtgatcggccgaggcttactaccagacatgcttagccaaacatgtacccaagataaagtataaggcgatagaaatcgacacctggcgcaatagatatagtaccgcgagggaaagatgaaagaattgataatccaagacataatcagtagcaagggactaacccctaggtagccttcgtgcataggatgaacttaagctagaacatagacttcgcagggagagccagagctaaaacccccgaaaccagacgagctacctaagagcagctaaaagagcagcacccgtctatgtagcaaatatagtgggaagattcactaggtagaggcggacaaaccgtaccgaggcctggtgatagctggtcgtccaagggatgagaatctgtaggtgtacaagctcttaatattgtgcccacagaaccctctaagatgccccttgtagatttagctgttagtccagagaggaacaggctcttgggacactagggaaatgagaccttgtagagagaggtaaaagaatgtgtaacacccatagtaggcctagaagcagccaccaattaagaagagcgttcaagctcaagcacccactatcctaggaaaactcccaaagatataactgaactcctcacaccgcatatgggaccaatcgtatcgaccctagtacgaagaactagtgttagtataagtaccatgaggacattctccgtccgcataagcctgcgtcgcgatgagaacagctgaactgacaattaacagcccaatatctacaatcagcaacagtccttattaccctcacgtgtcaacccagcacaggctgctc

SEQ ID NO: 624218 - DNA, 189 bp, Homo sapiens
cgccacctaccgggctatacactggctcgacgctcgagacagcttgtacatatggtgaaacctcatactctaccaaccaatacaaaaattagcccggtgtggtggtacacgcctatagtcccagctactcaggaggctgaggcagaagaatcgcttgaacatgggaaatggaggttaccgtgagccaag

SEQ ID NO: 624219 - DNA, 584 bp, Homo sapiens
atgggttcttcattcagatcatcatttcgtgcatctgacatgagattcttccctaaaaagtcagcatagtatgcaaactttccattccttaagcaaatgcacagctctttacggtttactgataatcacagccaataatgccgtaacagaagtaaaggagttcaattccaatgcaatgtatctaaaattatatttcacttaaagtcagcatcagtggttaacagtcagcaagatagtggtagtatttctagtgatggcaagaccatttcccaagggatctgtttacatgttcagtaagctcgctcaggcgtgcctgttgaaatacccctggatatgcagatagagtataaagaaatttggttttatagttagtcttgtatttagaacagctgttctgtagaaatggagtgcagcagattagtcaccgtcatttcaacatcacctaaaatcacgttagtttttgtggcagctgtgtcatcttgctagccaatagtacataatgccattaacactcatatgtaagtatgttagtgtggttgtatactatacgcagtcagcctaggtttcaacctccgtgaatttac

SEQ ID NO: 624220 - DNA, 110 bp, Homo sapiens
agaaaaaacatgttattacactctataaccctctcattctccctgtgactcaggccccaatcttcatctccttcttcattgctaagaagagagatggccaacctatcctg

SEQ ID NO: 624221 - DNA, 385 bp, Homo sapiens
gatgtgtttggcgcgatcttgcgcctcgtgcttgctccgcgctcccgggcttcacgccattctcctgcctcagcctcccgagtagctgggactacaggcgcccgccaccgcacccggctaattttttgtatttttagtagagaaggggtttcatcgtgttagccaggatggtctcgatctcctgacctcgtgatccgcccgccttggcctcccaaaatgctgggattacaggcgtgagtcaccgcgcccggctccatctaatttttaaatattttagagagtgggtctcttactgtgtcgcccagggtggtctcgaactcctggcctcaggctgtcctccctcttcaacctcccaaagtgctgggattacagacttgtgccatca

SEQ ID NO: 624222 - DNA, 798 bp, Homo sapiens
  misc_feature (495)..(495): n is a, c, g, or t
  misc_feature (709)..(709): n is a, c, g, or t
  misc_feature (718)..(718): n is a, c, g, or t
  misc_feature (766)..(766): n is a, c, g, or t
aactcgatgctgccattgtttgatacggcgccagacaagcccatttcgacaccgaggagtatcaacagggggaagttacagggcgtattgaaagtaggtaaactgctgcctcagaacatttgaggcgaggctcaatggatcccacccttggacccaaaacagccttgcaagcaaccggaaactagaacctgcgctgcccgacaccacgtaaaaccatcgaatggataatggaaaaaagagacgaaaggccaggagtccaaggggagatgaaataaaggacctgaaggaaactaaaacggcactaggccctccaacccaactagaacggacaattaggacaagaaacgacaggccgaatgccgacaactacagagcataaggaaaaataatacaggctaaccgaatttgtacaaaagcagaaaaagctaaagaagtcaccacaagaaacgcgacaacaacaggtcacaaacatagtgcactgacggaggctaagangaccacgccatttctagaagccaatggaaactaaggcaccgtggcaggcaagaacatgcaaatgacaggccaataatctggaaaataataccaaaccccggaacaagtcaaggctcgtgagaaatcgatgcccacaaaaatacagtgaggcgtgacgaagcaaagggaatcaacagaggccacagacccaaaagacagtaaacgaaatgcatangacacaccncaggggaaagttaaacgcaactataaaggagcacaaactaaagtcatnaacgagataactcaacagtgaacttccaaagc

SEQ ID NO: 624223 - DNA, 693 bp, Homo sapiens
  misc_feature (209)..(209): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (245)..(245): n is a, c, g, or t
  misc_feature (263)..(263): n is a, c, g, or t
  misc_feature (268)..(268): n is a, c, g, or t
  misc_feature (290)..(291): n is a, c, g, or t
  misc_feature (293)..(293): n is a, c, g, or t
  misc_feature (299)..(299): n is a, c, g, or t
  misc_feature (324)..(324): n is a, c, g, or t
  misc_feature (328)..(328): n is a, c, g, or t
  misc_feature (333)..(333): n is a, c, g, or t
  misc_feature (340)..(341): n is a, c, g, or t
  misc_feature (346)..(346): n is a, c, g, or t
  misc_feature (360)..(360): n is a, c, g, or t
  misc_feature (363)..(363): n is a, c, g, or t
  misc_feature (376)..(376): n is a, c, g, or t
  misc_feature (386)..(386): n is a, c, g, or t
ttggcatgagccagagccggcacccagacatccattcctccagctcccagcaacacaccaggcctgaacctggcttcccctcggctgtgtagggacaaagccgaagcccagtgccatgactgcccgcggattgaaaaacagaaacacaaaactttgacttgacttgcgaagtgaagcagggttttcatttttactctccttggtttagntctaganagnagnatnctgacctgagaggaggcccngtgagattctgaaacctnattcntcgaaggcgtactggcccttanntncagttnttttagttgtataagttgatatttntttnctggnatgtagnncattngctgttatctgggnacnagattctacaggnaaccagcctnagacacttcaggttgagacgcgtgcctcggagtctgtgacccgtcgcgtccacctgcattgagattttgcacttggaagaacacctgcaccggctggacgatgtgcgacaggcacagtcccatccagagcatggagcccgaacccagacagcgccttccactccatcattttcattttcacacccccgaagggaggggaggccacgcaggacactgatcctgacagaagctggtgagtgaccgttgggaatcggccaacactggtgtccagggcagactggtgcaatccattcattgtaccgaacag

SEQ ID NO: 624224 - DNA, 315 bp, Homo sapiens
ccttatccgggaagatggaatctttgtacaaacaaattattttcatttgttttacaacatttataatactgtgttcccccccccactccatgataattgcaggttcactaaatagtgaacagctttgcttttcacgtgatttataccctactccaaattgttgaagctttatcaggaaccattttactctcatgattcttcattaatctccttcatgtatgccaagcctgacccttttcacattgaggacaatgtggtttgctcctttttgaatctcctgattatgcatgttttacagtactccccgggatacag

SEQ ID NO: 624225 - DNA, 715 bp, Homo sapiens
ctcatccatgtatgatgaggctgttctcattggtcatagactaggcgcctatatataatgtcggttccagtcaaagttgactaatcgcacagctgaacgaatcgtggaaagagtcattgaggactatatcatggaatgtagtgtatgatactgccacacatgctctatagtggagagctcgagttgactgctagatcggactggcttagtgttgcgtactgccagctcatgcttatcatgagggagtggactgtgaaagaactactctgtggctactctcaactacggtagaggacgatatcactactgcctgcacatcctaccgctgcacatattgttatgtgccaacctgatccgctcaagcataacgataattctacggacctgtgaaatctatgatgacataggagtatcattcctgatgtaccactgccacaagctccggggatgtgcacatttttagtaccctgatgacacttccgaagtgtaagacgccagaactgctgtagcacacctgagaagccattctcttctagaacaagacagcattgagttcagagcagaactgtggttgtaacaacgtcgtagcattttgcacacagctttgtatgattatcataatctgccaggtgcttgaccacacgtttataccatggagatgaactcgtctcacattagtctgtctaagggggcttttgagttgtggcatacattc

SEQ ID NO: 624226 - DNA, 666 bp, Homo sapiens
tacccaaattcctagtgttcacaagggaggaatccaaaagcccttttaaaggaatttaatttttagaagggcccaggtaaagaggttcccatgttttttggggatacttgccttccgatatagtgtaaacccctttaaacggggtccatggcaacccttatttttaaaaaaattccccccataattcctttcaagggcccaagcgcaccccaaatggggtcaatgaaatttccggacaaggtttaaaacttaggggtttatttaacctttcaaggaaaccaaagactttaagggccccccccgggaattttgccccccccatttgtttcccccggggtttaaacagtttttttccttttccccctccccctttcccgggctttttgccccccttcccttaggcatcccataaagctgccctctagtaaaccgttccaaaaggggggaccctaccagcccttttttttttaagggcaataaaacctttttaacccaaattgcctttggttcccccaacaacgacccctttggggtgggtgcaaaaaaaaacttttttccctgaaggcccctttttttccccaacccttaggttttacgaatttttttcccttctttttgccggttaaaaaatgtttccttttttaaaaaaagcctggatccaagcct

SEQ ID NO: 624227 - DNA, 277 bp, Homo sapiens
agcacacaggggtggatggctgcccccatccccaccacagggaagaaaaggtccccggcagctgaggtatcacacacactacagcactgctctggctgctgcttgtgtccagatccttttcacctaagctgcttctgtcttcgacccctccaggacagctaaggacctgacggactccattaacctggccattcctcaccatccgtgagagaggcttccatcagagctaaaaggtctgctgtcactacctgacttcgcttcctttcccctctctctc

SEQ ID NO: 624228 - DNA, 646 bp, Homo sapiens
aaaaccttatatatgggacatttgtaactgtctcatgcaacctactactgtatagcacagctgagtacatacacatcatagaactggaatgctcggaataagattgtatcagagttgtcacaaggctattccacaagctttgttctctcgttcgagatcataatgcacatggtctcaccactagtaaggtcagaactaggacagtgatcgctcggaaggctggttaggtcagccgagatcattacaaatggctgaccctaaataagaacttgcaagaaaaaaagcagggccttagaagtttaggttctattctcctcccctgttgcaaattctcatggtttgggataggtggtgtacagcgcgtgtcatctgcggttgacactgcccacggtgggcggtcgggcctcttaactcgaaggtgcccacgtttagattctgagacggcaagtgaagggtgaatagctcgcggcgcgcctattttttattagtagaacttctcctgttgtgctgtagagtcatcctcgtcgatattctgcgtataggtatcgacatcgtcatcctcatcatcctcagctgcccgcttgcccatagctgactcagcttcctcatactcatctccatcctattcctcaccatcacattcttc

SEQ ID NO: 624229 - DNA, 842 bp, Homo sapiens
tttccaaggtgagtggttgtgtgatcgccatcttagggatgtgatgtgtggcctgggccttctcctgtgtgctgtgtgtgtgggtgatgctgtgatgcccatgatgctcctgtgtggtgcctgcatgcgttttggctgtgtggtgcccatgcctgggatgcagcctctttctgaatgtgcctgctgtgacctcttcaatggtgctgtggagactgggaatggaaaatgtgcccctgtgtttggtgtgttccatgtggactgcctgtgtaactgttaacctgtgctgccttgcccttgtcctctaacctgtctgctccctctctcccctagaaatgatgttctctgtcctgtggctgcaccttgtgctgcgtgtgctgaaccccgttcaacatctgccaacatcttgcacgcttggtgcactgattgtgtctctgtgtggacctcctgtatgcatgctccccatgtggcccactaggccatgcctcctgactgcccttctgcaaccccttgggcatgcactgcctgcacctgttggaacgatcgtacacgtttgtctgacactttcgtgcttcccgctgacatgtatttacttgcacttgttgttggcctacagagtcgcgagtccttcaacgtttgtcgggtccttgacacacactaggtaggtgaggtttaccccttgggattcaaagtcgactcttgccccgtacttgcgagagtgggaaacccaccaaacagtaacaatggggcattatatcacacgtgattcctcacgcttaccactttacaatgactcgacttggttgtcccggcggctttgtgctacatggactgtggtccagact

SEQ ID NO: 624230 - DNA, 84 bp, Homo sapiens
aagggcagggttcagaaagccatgacattagaaataatgtggtcataactctatcttacagtataccaataaaatattaatagc

SEQ ID NO: 624231 - DNA, 242 bp, Homo sapiens
  misc_feature (32)..(32): n is a, c, g, or t
  misc_feature (174)..(174): n is a, c, g, or t
  misc_feature (198)..(199): n is a, c, g, or t
cgggctgcctgtgcctatcacctcttatgcanacctcccaccccctgtattcccacccctggactggtgcccctgccttgggaaggtctccccatgtcctgcaccaggagacagacagagaaggcagcaggtggcctttgttctcagcaaaggtctgccctccctccttccttnttgcttctcataggccccggtgtnnggtgcatacacccccacctcctgcaataaaatagtagcatcgg

SEQ ID NO: 624232 - DNA, 110 bp, Homo sapiens
ttgaaactacatcacacacgagcactatatactatttctcaaagcaattaccctggcactctctaagtagctgacttgcctttattgtatttactttcgacgatggtagt

SEQ ID NO: 624233 - DNA, 843 bp, Homo sapiens
acagcggataatgctgttagaacgaacatgcagttgaaagaagaatggaaaataaagcggttaaatcaacagactgatgtctcagagcatgtcttcagtatcttcaagggcattctgagaaagatagctagtagagattctcaggtgggagatttggtactcatcatcctagatgaacgccatgacaattagtgtgttatattactgtgtagtcctactttatgattgttgcctacattcagatgtctcttacctgccctggatctggccaaactcgaagcttcaaggtgcatctagaagaccctgggtcacttggagaagtatatggacaggagaatagctgttaagccaataaggggcaaaacagatttaaagttcctggggggactagttgacggagtgaagccgtatcatgccaataggaacgtgtagttatggacgagattaatacattctatgacagtaagccgattcgtcctgatggctcattcatcaatccagaaacagcggcatcttttcatgcagaagtccggtgagatatacttcactggtgtcctcgtccctttgaccggtcatttacgaatgtaaatctcgatctggtgataactggtgtggacggggtcattaccagggactctgaaatgggccaattacttattggaagggaactgtgctgggatatgaagacgattaggggggaaaaccgcggccctaaggagtgtattcacctgacctgggacaccacaaagtgccttcacatttaagggtttccttcaaggggggcggaaaagggcgcaaacaggttccggtcaacaaatgtatacccactgttgtcttgttcca

SEQ ID NO: 624234 - DNA, 355 bp, Homo sapiens
  misc_feature (20)..(20): n is a, c, g, or t
  misc_feature (40)..(40): n is a, c, g, or t
ggtgggcagatctcttgagnccctggagtttgaagcccanccctggtcaacatggtaaaacccccatctctactaacaatacaaaaattagccggacatggtggcacacagctgtaatcccagctacttgggaggctgaagcatgagaatcacttgaccccgggaggcaggggttgcagtgagatgagattgtgccattgcactccagcctgggcagtagagtgagactctgtttcaaataataataataataaagggagtggaaacggtttctgttgcttagggttgctgtcagggcatgaaagatcttggaaaggagggcaaactacagcttccttcgacaaggataacaatg

SEQ ID NO: 624235 - DNA, 596 bp, Homo sapiens
  misc_feature (510)..(510): n is a, c, g, or t
gcacgagattgcactccaatctgggcaacagaacaagaccctgtctatttaaaaaaaaaaaaaaaccaccaataccacatggcataaaacattaattcactttttataatgaaaggttaactcataactcacacattactaaaattaataaaaattctccaccctaaccaacatggttaaaccctatctctaccaaaaaataaaaaataattaactgggcatggtggcaggcacctagtatcccagctattcagaaggctaatgcataataatcacttaaacctgggaggtgggggttgcagggagccaacatctaccactacattccaacctaggcaacaaatttagactctctcaaaaaaaaaaaaaaaaaaattcactgaccatcattttacaacatcttaactggtaaaaccctaccattacccaacttaatcaccttacagcacatccccctttcaccaactaacctaatacctaaaaaaccctcaccaatcaccctttccaacntttctcaacctaaatggctaatggcaaattttaacccttaatatttttttttccctttaaattttatttcacttattttttaacct

SEQ ID NO: 624236 - DNA, 347 bp, Homo sapiens
  misc_feature (316)..(316): n is a, c, g, or t
tggttggggtccatcaggtcgtccttcctcagcttgtcatactcaatcagctcgggtcggtgccggtggatcagggcatggaaggcaagaccatccttccagctgatgtggaagtctgcacatggacgttcttatagggggctgtctttctctggcaccagagaaggagcccttcctgggccgaggtctcttccagggagatgtcctgggatggcgaacctagggatgagggtccagatcattcccagggtcatcttggcgtggccggccacaatctcttctggccggatggagaccagcttgacgccttggcggncaataaagtccagcgcttggtacacatggtg

SEQ ID NO: 624237 - DNA, 279 bp, Homo sapiens
  misc_feature (6)..(6): n is a, c, g, or t
  misc_feature (29)..(29): n is a, c, g, or t
cccaanaccccctttgccgctccccgggntgggatcaaaaagacccttcccaaaaattagccacagtccagagaagcctaaagtgattcaatagcccaggagccccttattcctttttgcctcaaggggtgggggggtggggggcaaaggatggtgcccccattggtaaaggtagtgtgagtgtggtgtgtgctggggatgggcaactgggcctgcctggttggcccccagcccccccagccaaaaatacaggtggggttaaaccttaaaaaaaaaaaa

SEQ ID NO: 624238 - DNA, 655 bp, Homo sapiens
  misc_feature (46)..(46): n is a, c, g, or t
  misc_feature (92)..(92): n is a, c, g, or t
  misc_feature (112)..(112): n is a, c, g, or t
  misc_feature (115)..(115): n is a, c, g, or t
  misc_feature (123)..(125): n is a, c, g, or t
  misc_feature (127)..(127): n is a, c, g, or t
  misc_feature (131)..(131): n is a, c, g, or t
  misc_feature (133)..(133): n is a, c, g, or t
  misc_feature (135)..(135): n is a, c, g, or t
  misc_feature (140)..(140): n is a, c, g, or t
  misc_feature (159)..(159): n is a, c, g, or t
  misc_feature (172)..(172): n is a, c, g, or t
  misc_feature (178)..(178): n is a, c, g, or t
  misc_feature (181)..(182): n is a, c, g, or t
  misc_feature (186)..(186): n is a, c, g, or t
  misc_feature (194)..(194): n is a, c, g, or t
  misc_feature (238)..(238): n is a, c, g, or t
  misc_feature (259)..(259): n is a, c, g, or t
  misc_feature (294)..(294): n is a, c, g, or t
  misc_feature (333)..(333): n is a, c, g, or t
  misc_feature (355)..(355): n is a, c, g, or t
  misc_feature (375)..(375): n is a, c, g, or t
  misc_feature (388)..(388): n is a, c, g, or t
  misc_feature (401)..(401): n is a, c, g, or t
  misc_feature (411)..(411): n is a, c, g, or t
  misc_feature (448)..(448): n is a, c, g, or t
  misc_feature (514)..(514): n is a, c, g, or t
  misc_feature (517)..(517): n is a, c, g, or t
  misc_feature (519)..(519): n is a, c, g, or t
  misc_feature (539)..(539): n is a, c, g, or t
  misc_feature (542)..(542): n is a, c, g, or t
  misc_feature (546)..(547): n is a, c, g, or t
  misc_feature (549)..(549): n is a, c, g, or t
  misc_feature (576)..(576): n is a, c, g, or t
  misc_feature (582)..(582): n is a, c, g, or t
  misc_feature (614)..(614): n is a, c, g, or t
caaatttcccttctgtatacctctggcaagatacagatgttgatgnggatctttctttcagctggtaggttgtatagtcaataatctttgtncttccctccttatttcctangtncatatttnnngntgtntntnatttnattatactgatcacagaangctttttttatancaatanggnntgtntatatttnggtattactaaaaatatctagagatcaacacagatatatctttnttcatgagcttaaaatctgangtaaaaatttcatgctaataatattaatgctttcncactagggctaataagtcaaaaatagaatgtcatatgcntcacaagtctttcacttttgcngaatattataaatagaaatnacatttaatatgngtctatagttgtnttacaatgcngtacttcatatatgagtctatgtatgaggttgagggnaacagcaatagccgactaatgggatgccttgtctttcttgctttgtaatttgtattgttcaatcanaananggagtagcatattgtatttnttnagcnnanaggcatcagtaactcatcagtaagtcnaaacanagtgtatcaacaatttgccaaagaagcaaaanggaaagacatttcttttttcgacaattctgacaagacatgt

SEQ ID NO: 624239 - DNA, 233 bp, Homo sapiens
ggggccggcttgagcggctggtgtcaacaattcctcttctctcactgtgaacagcaccagaacaagaaccatttcactcatctccaagtcgcagagctcatccagtcctataataaatgtatgtgtatgatttgggtagtggatgaagtcttatgctttataaatgtcatggacgtcccccacaagcctacacatgtgctcagcaagcatgtgtgtagatcttctttttgtgt

SEQ ID NO: 624240 - DNA, 170 bp, Homo sapiens
accctccccacccccttggggcagagtttgcacaaagtcccccccataatacagggggagccacttgggcaggaggcagggaggggtccattccccctggtgggggtggtggggagctgtagttgccccctacctttcccaccttttgtttttcaataaaatgattttaa

SEQ ID NO: 624241 - DNA, 896 bp, Homo sapiens
  misc_feature (409)..(409): n is a, c, g, or t
agcggggtgctcgagccgcgcacggagctggtggctgccgcccgaggggctcgacggcaggtcggaggctgcggcgccatcgagcgtgcgaggggtctggccttcatggcatgggaagttgccccgtgagcccccttgcaggtggctgaaacatgtgtgcttttgtggagcgagtacaggtggctggccgtacgttccgtccatgcgtgctcctggtggctgttggtctgcctcttcaccgctcctgggcctgggcgatgcatgaggcagaggggtctggggtgaattcggtagaattgatcaagtccattggaagttctccctgggtttctacgttaccttgcacgccctgaggggctctccgttgggagccgtggagaggcacgccacggaccggggcgcctctagntgaccttactggactcacgagaatcgcaggacgccttgagtgtttgctgaaacctgaaccacaggaaggacgaccaagggtctcaaggcatcaagatcaatccatgatagctaattatgtactccgatactgacagataccggaggcacagtcataccaagacccttgtccaaactagatgagctgagctctgctcccaggcgagtctctgggcaagatacagatcccaggctgctgggcctggagcgagaaagctgtggctcagttccgcttcagcgcagaagcctctgctgtgcttggaggagacgtctgacatgtgacagaaggagaatttccagcagcttggtggcactgctacatgtgatcgcatgcctgtcacataggtactatggtgcatgcctgcgggggcctgtgcgaagacggccctggaagggctgctcttactgctactcttctccctggctgtctgaggagcgttgggcatgcc

SEQ ID NO: 624242 - DNA, 428 bp, Homo sapiens
ccaatcctccttgctgcctgggttgtcctaaagatcaaatgatgtcacgtgtaagttgcttggaataatggctgctatctagtaccaactgtatttgctggttttcttactctcttccgaatgtatcagtaacatgggaaagtctcgcactgccgcattttgcaggctcgattgtcagcatttgttggctgcagcagtggagctacagagaatggtcctagttgtcaggaaatgcagagcctgattggaggtagaaaatatttaaaaccagtggtacaagagatgcaaaggcctgattaataataaaataataattcctatagaagtctcagaaaatttaaataaacattctgttgaacttggttgatactagtaggtaaatagatgaactaaaaaggctagaagtaaaaacaaatctttgaacttca

SEQ ID NO: 624243 - DNA, 271 bp, Homo sapiens
  misc_feature (13)..(13): n is a, c, g, or t
  misc_feature (36)..(36): n is a, c, g, or t
  misc_feature (177)..(177): n is a, c, g, or t
  misc_feature (192)..(192): n is a, c, g, or t
  misc_feature (221)..(221): n is a, c, g, or t
  misc_feature (238)..(238): n is a, c, g, or t
  misc_feature (254)..(254): n is a, c, g, or t
ggtggcgcttccncagggcccaccattgttagaggntgatttaagccaaccaagtgtagatgtagcagggtcccacactttttaaaacattggaaggtcccaaaaccgtagcaaattcggtggcagtttaaaaaagttaagccgccaaagtaagtcacggggcacttcccaaaactngaatagggaacatangcacaggggaaggaaaaaacattgcactncaaaaacaccgtaaggnaaggggaaaaagcaangacccaaaaaaaaccaa

SEQ ID NO: 624244 - DNA, 840 bp, Homo sapiens
  misc_feature (55)..(55): n is a, c, g, or t
taccttccacctcccggcgtgcgggggggcggggggcttatataccaactcttanagctgtgagagaagaccaaagaaaaccatacaccagagagaaacatttcttgggcttagaaaagaaacttaagcagatggaaatgagacatgcacaaagagaacaggaacttcaacagataatacagcaaacacaccaagtagtagaaactgagcaaaacagagatgttgaaaaatggaaaagactggttcagctaaagaatggcgatttggagaagcgccgcccagcacgtcacctcgcgccggatggtttccgcgagctgcgaaggtatgtctgtgaggcgccgcggtctactcgctgtcggcgtgggggctcggtactgcgtcttttaccctctcgcggcacctcgagcgcgtttgccgtgtgcgcctgcccgtgcggcacgtaggccctctgatctctccttttgctgatggttgttggtgtgtcgttgtggtcaggctgtgtgacgtgcgctaagtagcagtcgagagggtttttgtggtgtggatattagtctcaattcctgcatgtgcgcgagctagtctactcgttataactcggacgcggtcccgcgaatgtgtcgcgcctagcgccgcctcacctggatactgagtgcgtgcgagcggcagattgcgtgatccgccgcgcgccgggcggcttgtgtgtgcgccgctccgtccctgcatccggaagcgcacgctgagcgccgccttagggaggcaggcgggcagtgcgcggagcagggtcctccgatcgcggctgcggccggttcgggtcgtctcgccggccgtagcttgccgcat

SEQ ID NO: 624245 - DNA, 153 bp, Homo sapiens
gttgaaaacttacggacttgcgatgatgaccgccgccggcagcaatcgcaaagcccagctcaacgcacgtattcttgcagcagggtggggcggtctgcgacggcagcatggagtacaaagcaatttgaaccgtgcggtgcgagcagtggggga

SEQ ID NO: 624246 - DNA, 1085 bp, Homo sapiens
gaagcattgaagaacacagggcaggggcttcgtgctgaggaggccaagcgaagctggacgaaaccgctagataaggagtatctcgcgttagagaagatacgacgtattgaatactaaactcacttaaaaaattgactaggtcagagtagggttgaataggatagtagctattatccgattacaggtatgtttaaactgctgatctttttacatgagctctaagaatattgaggatgcacaaagtcagtgacatgcacttactgaacgatgtacggccactcgagcgcaactggaacaccagactacaaacgcgtttcctacaaacactgcacggacgcgctcgcacgactggacagctctctctcactggacgctaacacaaacacatgtacttctaacacacgcaaacacttgacgacgaacagggacatacaggagcccccgaaattaataaccaattagaaagggccaactgcttcctagcattacacacactgaaccggtgcaccttacaccaggccttaaagtctcagcttctccacaagctcgctacgggtgattaaccactaactctcgcaagcgccgattctcttctacacaacagcagcattaccccccccggacacgggctggacttctcacccacgcacgcctttggaacaacatccccacttgaccgccacgcggggcagcaaacttcggctggttccatctctccaaacacggcccctaaggtctaacaaccggccattttttacctaagaaccgacacgcaacccgaaacacattggcgcaccaacgaacttctacaccttgcgcgcaagccggcgcacagcggcccgccacacacccacacctctcgccccaccacaacgccatcacgcaccacggcctcggcaccacgcctgcgcccccccacgctggccaccaccaaccagccaccaacctcacaccgcggcgccacaccgcgcgccacccacaccacaacgccaccccccccacgcacgcactacccgcgcacacactccccaaccgcccccccccgcccccctcaccccccacagccacagcaacacccacgcccc

SEQ ID NO: 624247 - DNA, 105 bp, Homo sapiens
cccctgccctgtatgggcggtgcactctggttggtggggcattggtaacgcaagcggcctttggggatacaacctttgatggtcaaggctgcgccaatgtaagga

SEQ ID NO: 624248 - DNA, 1305 bp, Homo sapiens
tccactatgttgatttgtttgtcggtcttcgcttgtgatacagagttctagtctcttttctctaccctggtgtgtggctcgcttgtttctgctactgtgtgtctcttgtgttgctggctgctatacttaggtgttggttttcttgtgattagttgtttgctcctcccttttttcttagaaggtgcgtcgttcttacttcaggtgtccctcttcctcgtggtcacagattcctgggcgcaacttttttctggccttctcccccggggtgccccccacgggcttattatgagactccccctttggccccaatttccccccagaaggttgacccccggtgattttgcgccctgtccccagagtcgtgcccaactgggcttttttttgattgaagccgccttggctccaccccaggctctcttccaagccccgatcttttggcattcgggagcggcctttgggacacccgtgcccggtattcaagcatttccccccgcccgtttggggaccagacgtttggcgcacccatctttttggctggccccctcgttctgttctgcataaattggtgttaaaactctgcgttagacatttggccaggtctctgtacaaggcccatgttctcgtgcccgtcgttcccaggatccaggggtttagaggtcgccagaaagcccattttagggccacgcccaaaccaagtgaccatagaagaggagaggtccccctgtgtgtgtgtgtgttgctgaatgtttccctgggtgcccctggctcccttgcaacacagggctgggccctgcaaagacccccaaggcgtcacactgcaagcggcgcttcctgaaccccctccctgcacaggggctaacgcttatccacgcccacgcacacactagccttggcctaaatggctttcacactctttctctctttgttttaaaatgagactccataaggtccccgagcactcttaagttgagattattttttgcgtaacacagaacctggtacacctctgatgtttagatataagtaaagcctatggtgttgtcacgcacggcacggctgtgggaaggccacactgttttgggcttcctcgctgggagctgaagaaaggctcaccgaaagggcactccgccaatgttggtgttcacctcgaggaggctgcctccctggtctcttcacccacctcgtaagttctctcactttcccaaccactcacgctgcttttataaataagatcttctttgtaagccactcctgttaaaatttgtaaaccaatctaattaaatggcatcagccactttaacccca

SEQ ID NO: 624249 - DNA, 856 bp, Homo sapiens
gggtcttactacttggatcgctatgatgtggctttgaagaacttgggcaaatagcttccttcaccaatctcatgaggagagggaacatgcggagaaagtgataaagctgctgaattcagcgaggtggacgaatcttccttcaggatatcaggaaaccggactgtgatgactgggagagcgggctgaatgcaagggagtgtgcattgacattttgggaagaaatgtgatagtcagtcaactactggagctgcacaaaggatggcgcccttgtacgagaagatgaccccctagtttgtgtgacgttcaatccgagacatcattacctgaatgagacaggtgagaagccgatcgcaagaattgggtgacctacgtgtaagcaacttgcagctaagaatggtgagcgcccgagtctggcgtagacggaaataatctcctttgagcgaagcacatcccctgggacgacgaggtgataatgagaacgctaaagccgtcggcgctagattgccccactagaccagtggggggagctttatcccctggaggtcacgcatagggcacgttgcagtgcagtgcttcggtgttttccctctgaggtttttcctactgaagtcgttagccagacacgatggcacttaagttctttgaatttgtagccatgtccttcaagggtgagagaatatcttggtcaccccaagaagaaggaaacccaaagaaaccccgcgggggttcctgtgagggggggcccaaaagagtgtgggagaatggcacgggcaaaagctgatccgggccaggattcttgcaaacgggtgggaacgcggggccccagtgtggatggaatactgcaagacagcaccgc

SEQ ID NO: 624250 - DNA, 1413 bp, Homo sapiens
gtagtttagtatagtgttgattggattgttctagatgtagttgattgttgtatgtatttaggagtgtgatatggtcttggattagttttttatgaagttatttgatgttgttcggggtggatgtattggggtttattttttgtattatgtactattggtagtagttagggtttgatggattgtttttggttatattctgtttttttttttgtgcgtggtttgctactctcttgtttgtagtctggcagggatgtatgttgtgtattcatcgtcgacatttaataaccgaccccctgtagggtggtgaagcggaacaacaagaagcgagttttatgggggaacaccccgaaatggggagcttcagaaagggatgcgcccacacaaaggagtttgggtgaacacaccaaataacgccacgggcccttgttttataatccgctccgcgccccccgcttgaaccatatttagtaccgcggctcctccttataaggttatacgaatgagccccttgtgggttggggccgaaaattatccggcacccgaaagggggggaccccccccacatgtattttcgctttaaaaggggcccccccacgaaagggaaacccccctctgccgcgaggggggaacttttcacaatccaccactccaccaatggttataggaatacttcccaccccgcttcttcttttgggagagaaagaaataaaaaaagaggcgctctccccggggttgtacacaaaaattgttgtgggggtacaccaagaaaaaggagacactgtgggtaccccgttctcggagcctatatttgttatgtccaatggcaccacgagaccaatgagtcacaagggtgttttaccacactcggggggctttatcccgtgtgaacacaagatatgaaggttgttttgtggttatagctccaccttttccccactatcacaaacgtgttgtgttaatgcccacggagagaataggggttctctctttgtgttgagaatatccgagaatatttcttgtgggtggagaaaataaacactatccgccacggggttttcgggatgaagagccacggttgttgctttgtgtgcacgttattctctcacagcccacgagaaagagttgagattaatccctctgaaaggaaatgaccactttgaggctttgtttccaaattcacgcggctttgagttcagccagcccccaccacggttaaaaaccaaggagataatcacgggaaatttttggagtggtattcttaatgtctcttgaaaaaaggagactgttcacgcacggcctgatgaaatatagagtttaagagtttacctggctaccagaaagaagatccccgatgaccacttaagacctacttgtgatattttaatgaagccaattaaagaccttattgatttg

SEQ ID NO: 624251 - DNA, 189 bp, Homo sapiens
cgttttgatgtgagagagggcgctggtgccgctcaatcgtatgctggattttgcggctactctacgtggataacgaataataaggcgtaacgttacgctttgggggaaagatggatttttttagtgtgcagaatatcctggtacatataccaataggggcaggcggatatgatctctcacatcaaaacg

SEQ ID NO: 624252 - DNA, 413 bp, Homo sapiens
tttccaagcggagatgctgtttccaaagggagatgctgttttgtacactgcagaattccagccaccacatcccaggagctcagcgggaagttagaaaccgtggctggacactagcacttattccacaagagagggacacacgaggaaacgagcaatgctgctatcagagaagccggcggctgacaccagctcagggagccccttagtgggccctgagcactgcccttcatgtagcctccggcagccccacagcaaggaagtcccggacgggctgggtgtcccgcagggccggacaaggggagaacatggacgacagaatggaaggagctcaggaggcctgcaacccaacctctttcaccactgggaagctaaggccttgaatgactgcctaaggccgccctcagcatctccgt

SEQ ID NO: 624253 - DNA, 727 bp, Homo sapiens
  misc_feature (29)..(29): n is a, c, g, or t
  misc_feature (83)..(83): n is a, c, g, or t
  misc_feature (101)..(101): n is a, c, g, or t
  misc_feature (133)..(133): n is a, c, g, or t
  misc_feature (149)..(150): n is a, c, g, or t
  misc_feature (157)..(157): n is a, c, g, or t
  misc_feature (161)..(161): n is a, c, g, or t
  misc_feature (177)..(177): n is a, c, g, or t
  misc_feature (180)..(180): n is a, c, g, or t
  misc_feature (215)..(215): n is a, c, g, or t
  misc_feature (217)..(217): n is a, c, g, or t
  misc_feature (242)..(242): n is a, c, g, or t
  misc_feature (253)..(253): n is a, c, g, or t
  misc_feature (273)..(273): n is a, c, g, or t
  misc_feature (286)..(286): n is a, c, g, or t
  misc_feature (288)..(288): n is a, c, g, or t
  misc_feature (297)..(297): n is a, c, g, or t
  misc_feature (320)..(320): n is a, c, g, or t
  misc_feature (336)..(336): n is a, c, g, or t
  misc_feature (353)..(354): n is a, c, g, or t
  misc_feature (357)..(357): n is a, c, g, or t
  misc_feature (373)..(373): n is a, c, g, or t
  misc_feature (380)..(380): n is a, c, g, or t
  misc_feature (387)..(387): n is a, c, g, or t
  misc_feature (401)..(402): n is a, c, g, or t
  misc_feature (434)..(434): n is a, c, g, or t
  misc_feature (447)..(447): n is a, c, g, or t
  misc_feature (451)..(451): n is a, c, g, or t
  misc_feature (456)..(456): n is a, c, g, or t
  misc_feature (460)..(460): n is a, c, g, or t
  misc_feature (467)..(467): n is a, c, g, or t
  misc_feature (491)..(491): n is a, c, g, or t
  misc_feature (592)..(592): n is a, c, g, or t
  misc_feature (629)..(629): n is a, c, g, or t
  misc_feature (704)..(704): n is a, c, g, or t
attcattcaaaaattaaactcacaaacantttaaccataaattaaaaatggtaaactcacatttgaatagcaacaagtaatanataaaaaaatccaaattnattaaaaaatcacttgtattaataaaaactgntaaataaatcaccaannatttgtntccncatactatcatattantcntcagatataaccataaaagcaaataaaccataaananaaacaagatgaaataaaaaaaatgnttaaaattgcntcttccagaattttacgaantctactagcaaancnaactttggncatcttctttttctttttcaaancttttgcacatgcacntttgcaatcctccctgnnaanaaaattattgtcaaanccaccanagccaanataagtgaaagcannacaggtactatatcttagattaaaataataanaaatcacaataanaganacagncccncaacttntaaactatagcaaaatgatagaantttctttggtgcgcaaaaaacacaaacaagtagatcatctggaaacctgttctcaatccggttccggtgacacccaccggaaaaagaatttttcacatgtnatggaacttagattaaagaaatacttttctgtggacncttcacactggtcgtccacactcacttgcagccggcaaactttgggaactttttctatcctccagcaagcatcgncgcaaacctcccaggtgtagaaa

SEQ ID NO: 624254 - DNA, 1091 bp, Homo sapiens
  misc_feature (272)..(272): n is a, c, g, or t
ttccctgccggacgtgtacctgggactgtgcgagtttccccacgagtatgtaggctatatgtccgacggtacaacggttgtgctaaaggctcgggcacacaggtttggcctggagtgttacttgtgctcacacgtgacgagatgttgtcgccgaaaagtcttggtgtgagcacattcacttcggtggacgaaaggcatcctcacgattgcagtctggcccgttacggcgggaagggctaactgggtccgaggaactcatggattccggaggntacttcggcccaatcagttagtctccgttgaggaatggccagaacaaggcggctgacattgtgcgtgtcatgtcgctttggagatacagggctttatattactctaggttacacgcaagtgaattattagccagatccggtcacgtggcaggccggggaagagtattgaaaggagcgctgtgccacggtgtatacggatggcatgatccggcttcctcttctaacacacatacaggtaccctgtgtgcctttcatgtagagtacccccgttgtgcaccacacggccggacggacgtccttgtaggcaggcgaatttcatagccctataatcgggtacggatgatacagacagatgcttcgggaatggatgacccgctgtttggcaatagtcattccgatgcagggcaagttcctccttacctcatttgtcggcacagaggcccaaccctatattttgcctcgactccgtcgttcaaggctcctagtttggggcagaactgtagcagtgagttgaccacggtggactaaagttgcgacaagcctttaatgtcagagcaccacaattgcaatgtcgttctacagggcaacctggacctttatgaactttgacggtgtgtaccggttgcctgaataaaggaaccccatgatggggacccagattctgcgggaaatgtggagcccgatgcccccggatgcaggactataaatagggcgacgagcaaactccacgatgtcaggagagttaaactgggagcgaaatcacattttgactagctctgccctttaccaaagggggcaccatctctccaggtgacacac

SEQ ID NO: 624255 - DNA, 509 bp, Homo sapiens
ggccgtaatggaggctgcagtgaactgtggtcatgccactgcactttagcctggacaacagagctagacaaaaaaaaaaagaaaaagaaaaaaaaaagaaagaaagattaaattaatctgttttcaaaatacaatgatggaggacaaccataattaagtcatccctgtccaggggtggtggtttacacctataatcccagccccttggaaggctgaggcaggaggcccatttgaccccagaagttttgagaccagtgtggccaacatagtgagaccctattctctaataaaaaataaattttaaaaaaataaaattttaaaaagtaagtcttccctgtcccaccagggagaatttgcaaggaacaaagggttcaccttcccaggcaagcttgaattccagcagggaaattccctttagtgttccagggcctgagattattcctctgtggctcactcccttgccctctgggaccacagagattccatcagcccctgcctctaggcctgcc

SEQ ID NO: 624256 - DNA, 187 bp, Homo sapiens
  misc_feature (102)..(102): n is a, c, g, or t
  misc_feature (107)..(107): n is a, c, g, or t
  misc_feature (114)..(115): n is a, c, g, or t
  misc_feature (117)..(117): n is a, c, g, or t
  misc_feature (129)..(129): n is a, c, g, or t
  misc_feature (147)..(147): n is a, c, g, or t
gtagcagctttaacccacgtttgtctgtcacgtccagtcccgaaacggttgagtgaccccaaaaaaggcttccccgaacccaacaagctcaggcggggctgntaagngtggcgnncntcggggacattntactgtgctaaaaagccnctgcagacatagcaataaaaacatgtcattttccaaagca

SEQ ID NO: 624257 - DNA, 256 bp, Homo sapiens
ctaaacggtcggtatcgacctggcggatcatgacgtctcggtaaccgatcgagaagcggtcaatcgacacgaagagcgctgggcattcaccggtctggggcttcttcgcggaacaagcgggcggcaatgacctgctggaaaccgggatcatggtatcgacctggttgtgccgttcgccaagggcggtaaagtcgggctgttcgggtggtgccgggtgtaggcgaaatcgtaaacatgatggaacctgatccgtaac

SEQ ID NO: 624258 - DNA, 162 bp, Homo sapiens
aggaacgtaccaggtatgctctgtgcttaaagaggccagtggaggggacagagacaaacggaccagtggtagaagcaggctagacaccctggacagcaaggaaaatagagagcacacacctgaccattacaccagacactctacctaccagagtatagcacc

SEQ ID NO: 624259 - DNA, 125 bp, Homo sapiens
ggtttaggatataaagcttacacagtctattctaagagatatgtataccttgtcgcatgtagtatgagacccttccaatagtgtatttccatttctgccctcccagccttagtgttcacttctct

SEQ ID NO: 624260 - DNA, 598 bp, Homo sapiens
  misc_feature (47)..(47): n is a, c, g, or t
  misc_feature (75)..(75): n is a, c, g, or t
  misc_feature (81)..(81): n is a, c, g, or t
  misc_feature (214)..(214): n is a, c, g, or t
  misc_feature (338)..(338): n is a, c, g, or t
  misc_feature (539)..(539): n is a, c, g, or t
tgcattcaccccttgggtcctttgatgaaaatgacctgcccttcaanttgctggatgaaatctttaagacccaantttgantgccaactccttcatgaaacctttcccaattctccttcagcgaaaaggaatctctcttctctgagcttcctatttacatacaccattcctatttttcattacacattcctgccttgcctttagttcctttacngtagaatctcctcggctgaatctggagcccttggaggggtagagtaagcatgtcatccagtctgtaattgcacccagcagcaggtacggtatgaatgtctgcctcacccacagtaggtgctcangcaagtgcctgttgcccgcggacgcagggcttcctgtttgcatcactcatttttagtcgcctaacagagcggaccgaacacggttaggtcacacagccacaggagtctgcccactccagccagtgactagggtgctcctacccttctctcctacctagttccaaatgggttgtgtgtgtgaaggaagttggggccgggtantccgctggctcgtcctccgcgtccacccagcggatctccgagtcccaggcggcctcccc

SEQ ID NO: 624261 - DNA, 351 bp, Homo sapiens
cccggcccccccccccgggtttcccccgggggtggggtttttcaaccccccttttttttttaaagggggggggggggcatttttttttttccttttcccccttccccccccgggggggggtttttttcccccgggggggggaaaaaatttttttttttttttccccccgggccccggggggggggtttttttttccccccccctttttttggggccctttgtttttttttttttggggccccccccggcggggttagggggggttttttttttttttttttttttggtttaaaattcccgggggggggggttggggttttttttttttttaccccccccccccccccccca

SEQ ID NO: 624262 - DNA, 253 bp, Homo sapiens
atgacgaggtaaagcaactgctgaagcctgccccggtgcagggggaactgccacattgtgttagacatggactttctctctgccctcacccaagcctctcaggtcacatgcagcaggaacaccaaggtgacggcagaaacatcaggtcccatttagaactgtgcctagtagggggctaaggggttacggggtcctcggatgtctagggttgcagccacgtcagccttggactcccatttgtagagcgccacac

SEQ ID NO: 624263 - DNA, 104 bp, Homo sapiens
tcgactctagctgatccttcactcttcctggggatatcagaaatatagatgtggctcacaaaaaacgactccaaacatagagcagccctcatcgcttatcaatg

SEQ ID NO: 624264 - DNA, 521 bp, Homo sapiens
aacagttggtcataattcacataaagcagtctgttcaattttttttttacgtgcttgtagattttttaaaaagtgattttaggtttgctttttcatgcgggaagcagataggtgctatcagagcctctcccacaccactatagtgtaataatgttattattactctacactgaaacgtattcaaggttagatattattttagcttcagttgttctttagaggctttcaaatggaccgatgatactgtttcttgccctgaatatataaacactccccagtgtttatattgggaagatattgggaaggaaatatatttgtaaaagatgaaggcgggatctatttttttttctttttaaaggttgttcccctaaattcttttgaggatgggaaggatttttcttgctggtcagggctttttccttttcatctgttgttttggggtcccagtgaccttaggtacatagcagactttcccaaatggattgattacaaataaacagttgtttcttagcaagacctga

SEQ ID NO: 624265 - DNA, 645 bp, Homo sapiens
ggtccgtggtctgtcgggccgctaccggcgggggagaagtgctatgcgcgcccgcgtctcgccggcctgctgcggacgccagcctatgcggagtacggcaacttgcgatcaggcgctccagttcgtgccggagacgcaggttagcctggtggacaacggcctgcgtgtggcctccgagcagtgcctctcagcccacttgcacggtgggagtgtggattgatgtgtggcaggcggttttggagactgagaagaataatggggcgaggctactgattggagcatctggcatttcaagggaacagagaatcgggctggcagtgcgctggagaaggaggtggagagcatggtggccatcttaatgcctaagaaccgggagcaacagttactaatcaaggcgctagcccaaggaatctggcgaaaggcgtgtgggcgctccgtggggtgacattcgcgcagaaacgtgtacgtcttggacacgatcacgggatttggcgaagggaacgtgactgtgacacctgcaggtacgatgcagcgacgaattgacaccatgtactcacgacggatgacggtccggtgcaatagtggcctggccgagagcatcccagggcaagcgctcccacgcacgggccgggcactgccccaggg

SEQ ID NO: 624266 - DNA, 1872 bp, Homo sapiens
  misc_feature (1863)..(1863): n is a, c, g, or t
  misc_feature (1872)..(1872): n is a, c, g, or t
gctctgcgtttggctctactagttgattaacccaatcttacacaactatatgctattgagggtggtccactcagacccttaacgaccgaatctcgcttaagcatccacttctctctgtgatatagatacactgacactagagcgtctcatagccacctcagcggatgcgattgggaccatgcactgagcgccaacatgagtcctacgctagaggcacgatatagacaccgatgagaacactcatgacctcatctaatcacgtcacaacgtcaggctaagaaagtcagcacctcttacaattagtcataggagtgtcagactcgctgaccccgacaacctcaagtccatcacttattcataatctgtaattctgcaccctcccactacatagatacgccaatgttaggactcatctagtcaagcacggcgggagagggcctcagaggcaggcagacgcctggatccgtcgtggccccatatactttacactgtataacttaggagctctaaatccaggctacacactatacaccaaaaaatacatcggcaacttaaatatataaccacttacaacaaaaagccctaagaggctacacacattcaaacaaccagtattccttaaacgtcaacataccgcacctacgttccgacctaagggcgcgccgagaaggaccaggtcaatccaaagaagatgctctataggaaggccgcgaagagagcagagcgttatgcacgagtaattagccaccttaaagcatctccaccgacgcgacagtccaggcgctatatagcccaattcaggcgtcacacaagcaatcacccataacgtttataacgcaggggacacttaccccgcaaccttgtcaagtagaagcgtaccgcgcattaaaaaacagagcccacaacatggtttcacggaaaacgagacgcgcgcaccctaaatacgaggacttagggaagatacccaaacctaaggtttaccgcgtatggaccacaggacgaggtgaaacttccctgatgacaaacacagctttaagatggctggggtgtaagtggggatacttaacaataaacacggccacctaccacacaccaacgatacacatatatgccttccacaacaacgcccgcctagtgacgcaagacagagcgaaggcatatagagacctgtaaaaccgaccactatagcaccagaggggctacaagataatatacacccttaaattgcaaaggagccacttacgcatgtacatataacaaaccaagggagtacgaccaatagctgagacccgtaacgaggaagaacaaacacaggggacgcgctaaacgaaactaccgcggctgccagaaagggcataaacatcgtagcaagagcaagggcagcaagagtaagagcacgatcaggtaagagtaaaacaagggccacatagaatcagatgccaaaagacccgcgtgaacagacatttacagagcagccaaggacaaaaccgaacatacagtcggccaacaggggacactaactaccagctcaataacataaaaacgggcaagacgacaaccatcagacatcagacagacacgggcaacacaagtaggaagtaaaatacccgatcacaaaagcgaatcatcagaccacaagcaccacgatacaaagagaataggcaagcaaattagacagagccaggaaacaaggcaagacgaccgcaataacacaacgggagcacagcatggacagacaccagaccgagacaaacagactcgacacgagagcaacagaacagcgacaccaacatgccagagaagtgcgcagcgcaaaacaacgagaccacgagacacctacacctagttagactcgaccgtcgngtgaagagn

SEQ ID NO: 624267 - DNA, 1459 bp, Homo sapiens
gcgggagtcctggcggcgctgcggctgcgcacggccccggtggcgggcaccttcgtggctgctgatgctggatgccctgcattggctatgagtgtgcttgcactgccctgtgtgctactgtgctgtgccaatcctggcctggaatgtggccctgtgccctgtgtgtggccttccagctaggcctgctgccttgggctgatggtggtgctgtctgctgctccctgtttggctgctagctttggtgccatctacacctgtgctgctctagcagatcctctgctgttgcctgcctgctgcttgcttgggccaaagctcattccgcatttgtccccagtggccactgctggatcctgctagcatagcgctgtgggatgggctaggggttcacctggggaccccacaagacaaaggaagcccactgagtggaatgccggccatccagcatcgcctggcgtgaccgcgtgaggcattgacttgcaatgcatgtagacggcgacatagaggcagtggttcccaagtgcccccaagaacacctccgtaaactactcaagtgggtcaggcaagagtattggcaccgggcgacgccttaccgaacagggctgccgggacgagagaccaaaaacccctggacaccacagataccaccctgggactgtataccttacttcccccttggcaagacacatttaaacacccaggtaaggaacctttaacacgggcacccgaccacttacacccaccaagatacaaaagccttatgagcggcatcggcaagccatacgacaggcaagcggcccctccgtggacacgtcgaagggaccccatgagtttggcccggccctagacgaacctactataccaaagtgagaccacatgacacttaacggaggagacagcatccttgacacttggggggacattctggcaactacaaatatcccggacagaaccggagcattccgcataggggggaaccccggcgtgttccaaaggtgaccaacgttgagtacgaactcagtggaggaaagcgacacccctatgagccccacgaatggagagcccaccgtgacgacatcacacatcacccatgtgagacatgggcccaggacagaggaaaggggaaaccaaatgagacaggacaggccacaccatcgacggaaaaaggccagaccaaaagacgaaaggtgctcaagccccagaaaaggacacgtgcaagtaccactaggacgtgggcaccaaacaccccgaaggacacagaaaacaagccaagcacagaggacaaggagaaacaacaaggcgagtcaccaacacagaggccccaaaagcgggcatagaagagcacccgacacgcacaaagagaaaaaaacagcaaagcacagaaaacgagcacaaagaaaagaagacggacaaacagaaaacaggacgcacagaaagagagaaaaaccacggagagcaacaa

SEQ ID NO: 624268 - DNA, 231 bp, Homo sapiens
  misc_feature (83)..(83): n is a, c, g, or t
aaaaaaaaagtagacgatgggattctagcactcctaatatgccagacaaacgaatctaacataaagatttacctttgaataangcatatatatattcgattctgagctgctttgtattttttctaactttggcatctgtatcttggtgctttctattagactgatagagttttagaacctaaggagtatgcattgtacttcagcgcttttttcttcattactttactagtg

SEQ ID NO: 624269 - DNA, 722 bp, Homo sapiens
cggtaaaaaaaagtgttccccaggggaagatatgggatttaaaaaatcaagccctaaaaccccttggttttataagaattgcctcaggcccaacggctgaaaaaattaattcacgctcagccagaagttacaatcgctctaccagtaatttccttcccaccctaaatgcaccggggagtttactttcctaagaaaattctggcgaagttacccccttccataaagggattcttgtccaaacatttactcttgcgccgttggaccattctgatagtaagttcaaggtagtccataataatttaagcctacaatggtctctgcagatactgttggatgctgaatctgtccagccagttaataagagaattggcctgcccctgtttgggttaacaattgggcacgtgctccaaccagaaacatcaaacttagcttaagatgacccgtcatatggctcaggttttagtgggtggttgcatttcctgagaaagagtacgtgtcataatgcctgcctagaacatgagctctgatctggataaaggaaacagagtacccatgttcaggatcgcgtagttttggacttttagatgatctttattaatgcacttcattttgtgctcagagctcagcccccatgccctgtgtgaaatggtttcaaagttccccttttcgtttttgcccgtaaagatgttgatacagaccctcaatcattactttccatgcca

SEQ ID NO: 624270 - DNA, 147 bp, Homo sapiens
aactaactaactgattcctagccctcacaagcatggcaagcgaacgccatctatcaagagaaccactctcacgaaaaatactcctcctctcaatactaatctcactaaaaatctccttaattatagcattgacagccacagaactaa

SEQ ID NO: 624271 - DNA, 820 bp, Homo sapiens
ctgcgagcgattgagaagctgctggcctcggtggaggagcggaacggcacctcgcagggcttggcggtgggccgcaggccccctcaggaatgctgctctccagagctgggccggcgactggcagagctggagcgcaggctggatgtcagtggccggctcagtgacagtgctgagtgggcggcgaggcacagagctgggaggagccagcggggcagggaggccacccccccagagctacaccagattggacctcccgcctgtctcgcctggagagaccagcattcaactccaccctgggcccttcgagaggagcaggaggagagctggcctggggctcctgaagggggctgaagccactggcctgcactgctgaccggggccgactagagcagttgaagggaggagctgctggccaatgtgagcggggaacatcgagagggacggttggatctgttggaggaacaggtggcaggcgccatgcagagcatgcagggcagcctctagctctggggcccctggggagcaggaactcatcaagtcagagagatcctcagatgccttggagcgcagaggtgctggacagtgaggggcagcttgtcggctggtggggctccggcctgtcacacggtgcgaagcagagggggaggcccggcaaggcccacgctgcagtggcattcccagcaggttggtggggccggctccaggatccgtgtggattgcccacgctgagacgctgcgagtccacactaccggatgatctcctggcgccggtaggccactgggggcgtgacgcctgggataggatgggctggcgtcagga

SEQ ID NO: 624272 - DNA, 185 bp, Homo sapiens
gtgcttaactggagccggccatggattcctttttccttcctttttggcattttttttttcagaacggggcttaatttggtgcccaggctggaggggggtggcataattctaggttaattgcaacttcaacttctgggttaagccatccttctggcttaagcttctggagagcctccaaccctttc

SEQ ID NO: 624273 - DNA, 752 bp, Homo sapiens
ggtcgattatattggaactgcatctgcatctgctcatgctcaccgtcatcgcgtgcgttctcaagctcgtgtaggctggaggacccagactacgccaggaaaagctagtgagggtggggtccgatcgggcccgtgcgagtggggtcaagcgaggggcctggtggctgggagcggggccttcatcctgaccggcgcggagcaccctcggcgtccgatagcgcctgagtatgtacgcgtgcgccgcgcgcttcggacgcacgtaatgtgcgtgcgctcggagattcgcgcccgtcaccattctcgtaccgtcgggcgtctgcgctgactccggcgccctgtacccctgtctggcccttgcgtatggtcgcgaccgtgcggccactgcagtcccggggttgaggccgacccatggcaaagccggcggtcccggcgacgacggcgcatggagaacttccgtaaggtgcgctccgaagaggcgccagcggggtgcggggccgagggaggcggccgggctccggccccttcgcagacctggcgccgggcgcggtgcacatgcgggtcaaggaaggcagcaagatccggaacctgatggcctctcgccaccgccagcatggcgcagcagccacgcgcgccatcgtcttcagcggctgcggcgggcaccaccaaaaccgtcacgtgcgccgagatcctcaagcgccgcctggcgggctgcacaagtcacgcggctcgctaccggagcgtacgcgagtgtg

SEQ ID NO: 624274 - DNA, 354 bp, Homo sapiens
  misc_feature (219)..(219): n is a, c, g, or t
  misc_feature (228)..(228): n is a, c, g, or t
  misc_feature (281)..(281): n is a, c, g, or t
  misc_feature (336)..(336): n is a, c, g, or t
  misc_feature (339)..(339): n is a, c, g, or t
gggaggcgatctagaggatccggtgttcctttgtctacaaaaatacaaatattagccaggcatgcggcgcaagcctgttataatcccagctactcaggaaggccggcgtgggaagatcgcttgagcctggggggcggaggttgcggtgagcggagatcgtgccactgaactccagcctgggtgacagggcaactccgtcttaaaaaaaaaataaataanttgggggtnataggtctgacgacttccccaaggactagcagaaaggtttctgagctttttanccagggcattttcagggctggcatggcttcccaggtggctttagacaaaagcttnganagacaaagggaaaca

SEQ ID NO: 624275 - DNA, 212 bp, Homo sapiens
cttaccatgaggctatggttaaagctggaataagattataaatttacaatgagaaatcataatcacagagacctaaatatttcaagtgcatgggatttaatatcattgccaggggcaaatagaattctacaagccacataactaattagaaagttatttacgtgaccattgagattacaaaggctttcagacggaactcagagtgcctcagg

SEQ ID NO: 624276 - DNA, 141 bp, Homo sapiens
tccagaagatggatttaggatccagacctctagccactatagctctctaggaaataatggcgggggacatttaactacctaccaagcttcagtagtcctatataaaaaatagaggaaacaataactggtacccgtagacat

SEQ ID NO: 624277 - DNA, 454 bp, Homo sapiens
  misc_feature (1)..(1): n is a, c, g, or t
  misc_feature (15)..(16): n is a, c, g, or t
  misc_feature (25)..(25): n is a, c, g, or t
  misc_feature (27)..(27): n is a, c, g, or t
  misc_feature (40)..(40): n is a, c, g, or t
  misc_feature (335)..(335): n is a, c, g, or t
  misc_feature (352)..(352): n is a, c, g, or t
ntttcggcacaggcnnccaatattnanccccggccaaacnggcacagatgctgagccacacgtttttcaagacagcctgtgaactaggcacatatccttcccttcccagtccataaaaaccctggacccagcctcgtagaggcaccactttcagacacctatctctgctggcaaagagctttcttctcttgcttcttaaactttcactccaacctcacctttgtgttcacgctccttaatctccttagaggtagaacaaagaactctggatgttatctcagactacgagagactgttacatcttggtgcactgctgaggactacggacacttggntttctttgagttttgantaaatatttttacatggaggtgttaatttatacagctttcctttttggactggtcttgtttttactttaacagatgttttggaggattgtccctttgttggt

SEQ ID NO: 624278 - DNA, 236 bp, Homo sapiens
agggggaaaaacccccccttgggggggggggggacctggtttcccccaaaccccccttttttttttttccccccctgaagggttggggggggggaaacaataatttggggttccagggcggtccggtttagggccctccccttggctttctttttgcaaaaatttttttggtccccaggttggggggggcccttttttttttcccccccccccccccccccttccctttttttgga

SEQ ID NO: 624279 - DNA, 137 bp, Homo sapiens
aggaaagatgcccagactatcaaatattattcagcattaaaaaggaggaaatgctgacatcgatgctacatacatggcatgaagatattaaagatattgattctacagtgaagataaggccagtcgcaggagaagga

SEQ ID NO: 624280 - DNA, 928 bp, Homo sapiens
ggttctctgcgataatcgtatcatgtactgaactctgctgcctgactgatacttcctccactgactcatgggtcacatgacttgatcctagcaggtactcgtgttgcatcttcagggccagccgtcttgaacgtgcttacttatcactcatagcgaggcatagaaaaatggtgctattctagatgtgatcgagacttcagtacgtcttcagaactgtcgcaggaagatattgatacgtgttcacgaatatggtgcatgcatcgaggcgcgatgttcagagtagagcgcatctgtcgccaacgtatgcagcgacagggcacgtatgtatgagaggcgatgtgcacactgcgagccacgtgcatgtctgtgctcctatgcgagcagtgcaaccaaacagcaggagaacgctccgctatacttgcagcgagatacattgctccgggaaaaacttagagattatccaaggcgcacatcgtatttcggaccaagctccgcttatccggaccgctttgctttggcgaagaacaccagatccgcattgaccacgagactcgaactcacacgtttgtggagtcgaaaaccgataacagctcgctaggaattcgctcggcaaacttcgaccaacatgctctgtagacaaaaacgcctaataataccacctacaccacgtagtctatagacgtgtgagcaggcaccgtaaggacattccctgtcgtttgggacccccccttctcgtcgtaatccataatttgcgcgcaacagttgccaaaaagtttgtttccgtctcgtgaactcccacaccattctgcggtctcgcaactgtgtggacacctcgggcagatcccagacgtataggtgcacccgacaagcatagttgccgcgcttgctcctcatcaagttctccctaccctttgctccacgctacgcg

SEQ ID NO: 624281 - DNA, 274 bp, Homo sapiens
aggtactctacagagctatgctctgaaggggttgcctggagtattctcgctctcggtcacagcgttgaggtactcgagaaggtcgccgtaaaggcagtatccagtcccgtgatatacacagacccttctcgcagtgcggtcctgagaatccccggaacaggcacacataggcagctccctcggacgcatgagcccattgaagcatggtggcctgaggcccgggttgcagggtgagctgcaaaggccgtgatgtccacctgctgcagcacgtgct

SEQ ID NO: 624282 - DNA, 339 bp, Homo sapiens
tcgatctaatgcagaatataatgtgcgggcacgggatgtctctgacaagtggtcaaaataatatactttacttaagaaattaatgtttctctggagttggggcctggctttcagagttaggtaatcagtgttgatctagatgatcaacataatggacactcctgaatgagacttaattttgtctttcaaatatactgtcttaaatcagtttattaaatctgaattttaaaacatgctgtttatgacacaatgacacattgttgcccccattaagtgttgaaaaatatctttgcctcatagaacagaaatatataaaaatatatgttgaatgttaacagg

SEQ ID NO: 624283 - DNA, 732 bp, Homo sapiens
  misc_feature (367)..(367): n is a, c, g, or t
ctggatcttctttctccttcgcctggccgggcagggccttggcagccccctcagccgagaacgccctgcctgcactgagacagcaaggtggtggaagacatagctgtggcagaggtgcactgaggtatctgtgggagctaatcctgtccatggtggaagtatggagaatttgaatgatggtgcatgaaggaaaaccggaagcatggaggtgtgtggcggacatacatcccctgcgcaggaatccgaccgactgacaacatcgacggacaatggtgtgcgatgctggatgagaatcaacgaccccacatgttgctgtgtgctcaggatcccaccagactgcccagcccgcccaattcggtcgggtagnatttgaagagaggatagtgtcgaggcgagactgactagacacaggtaacctatcgtacttctttgcgctagccgatcgttacttatgcgctagcaaagtgcaccctggatgggcaccaaagatatgggccgagcaagctccacctggactacattcgggccttgcgatatacatccccccttgcctggactctgaggctgacgcgaattccccctgtcgcatgcgggactgtgctcgagaacgtcctggtcaccctgtagtgaggagggatgaggacaacagaccttctgactgagaagcagaagctgcgggtgacgaagatcctgagaatgagacgcgcctgaggcaggagagcatccccgtgg

SEQ ID NO: 624284 - DNA, 818 bp, Homo sapiens
ctttacattttgggagacaaacctgtgtgagttttttattgggtacaaacgttggtatttaaccactaggggttttggtacagttttttggccttttcctacgtagaaaacaatggtaaaggggatttcacaatggtgacagatgaaaaacaaaattggccacttatgaccaagacgcacaggtcgtgttctgcagccaacaacggggtttcaattcaagttcaagtcggtgattcagcccgtacgaaatgcgtttctcctttactctgtgttggaggccttttccttttcttttccgtggtttggcattgtgcaagaagaaaaagtgctctcttttgggtggtgaacctgtggtgctgggtacctcgtggtagaaacaatttagtgggacttctaaccgtttaaagtgggtcttaagacaaacgaggccaacgggagaaagccccttgtggtcgggcatattctcttataaccttacattccaccagagagctctagggtgactacggtgcacattcttacaacacacgcacaacacacagacaactgtggtctcactacacgctctgagggaagccagagggcagctagtggtggttgtcaacgagggaattcttccttatccgtgttaaagggaggtggtatttcgccctttttggtgcccaagtggcggaaactctaatatctggtgtttaattgggcacatgacactatgggaccaaaagagtcatgttggtatctgggcaaggtgctggtacctttcccttgggtgccactttggcgtattaacaccgtgtcttgacgacacgaatctcctc

SEQ ID NO: 624285 - DNA, 439 bp, Homo sapiens
tctgctaatagggagggcctgtgcgattagaggcttccatcgattgggtagtgtccttcaagtgggtggcgaagagcctgtcgggcatatgtcgtgactgttactcccctcgcgtagtggtttgctgcttgactggcctagggaaataataataaaggtgaagtaaacttttttaatgacatatggggcacaaaataactggtgtcttgtatatatactgtttttttacataatacttctctactttagtctttactttaaaaatatgtactgtttccttttatgttgtataattgtttgcctctttttcttttgtactgagctcagcatagactactactaccttaatgtttaaatctgaatttcttttagcattttgcttaaaagccatatgctatttgcttattccgtgccctgacatagatcgttacaggagtac

SEQ ID NO: 624286 - DNA, 240 bp, Homo sapiens
catgtgagagggccgataaagtcctgagaacaagcatcccattcgctctatctggcaggtatattcagaggtggccataatttattggtgaggtccaggctggtcttagccgattgagtgaccatgcgggtgactgtcagacgtaaagagacaacacctgtagatcttatcttaccttctgttggataaatgcccactggacaataggaaactgatgcacaccacatggtaagagggcca

SEQ ID NO: 624287 - DNA, 85 bp, Homo sapiens
ggggggggggggggtttttttaataaggttttttttgggggttggggggggaaataaaaccctggggccctttccggttccgcca

SEQ ID NO: 624288 - DNA, 313 bp, Homo sapiens
ccttactacgcagagccgccactgacagtgagaatcaagaacctcaacaatttatcctttgtgttacaaacaatccagttatacttgtctagttatttaaaaatgtacaattaagtgatttttttactgtagtcaccctgttgtcctagcaaatactaggtctttttcattctttctattttttttgtacccattaaccatctctacttcccccactaccctcatcacccttctcatcttctgttaaccatccttctactctctatctccacgagttcaattgttttaatttttagctttcacaaataagtga

SEQ ID NO: 624289 - DNA, 826 bp, Homo sapiens
cttcctgaataaaatcgtcattccggtgactaccggactcccgaagacaggacaggctctaaggctatgagccgcctactgtaccaatttgtgccagaacaggggaccccaagatgggccattcggctgtgcccactcactgggaacccttactactacggaaataacagtcggcttactctgtgatgtatctacctaagtaagtatgggctacgatagattccgaatggaagcggagacctggaagaaaccaaccttcttgtgactagctggacccctcatctagtctggcgctggcccatcagtgaccgagccagtgtaggccattcttccactgcccttctcatcagtgggtacctctgtaaggcctacttgcctcatcgtcgcgcccgcacgaggagcaactccgaggtctgccccccgttcactgtaaacgggatgactctcaagtgaatgcccactgtggcacgctctacgaagatgaactcatgcagagtctgtctccctgttagtcctcagtcaaggtggtattcctgctgagtctctagcgcggtccatccaattatgggagttcgaccatacctagaatgtgatccagattgataaaactctgcgctggcccatatagacgcgaactgaccaaatgtgtccctcctatcggtatggattccgtacgcgtaaatctccagatagttgctagctttctcacgtattctcatgccgtaggccccttaggctgtggggcattcacgtaatgactgagtaagatgaccgcaaacgtgggataccatcttcatttgagacctgttggtggaagagaacctac

SEQ ID NO: 624290 - DNA, 396 bp, Homo sapiens
ttttttttttccaaaagtagcttttggggggggggggggaattttaaactgggataatttgtgaaagatttttattttttattccgggggaaggttttttttttggggttaccccctttataaaaaaattttttcctaaaatttgggggggtgcccctcggggtttttaggggggggcccaaggccttagggaccccctaggtccgggggtccatttttccaaccggggtttttgggggccccccccggatttagctttttaaataagaaaaaggttggttttttcccccccggaaagaaaagtttttgcctataaagaaaaggtttaaaaacctgttttggacccgcccttggttggagccccaaaaaaattttgaaggtaaatttggggtttta

SEQ ID NO: 624291 - DNA, 1166 bp, Homo sapiens
ggtggtctgacacacactgctgtggtgttcccctggatttagtgaaatgccgtatgcgaggtggagccccagaagtacaagggcatattgaacggattctcagttagacttaaagaggatggtgtacgtggtttggaataagaggatgggctccgactttgcattggttaatccgatgctagggacatctgcgaagttaggctttctaatgaaggtctttaaagtcgttgtatagcaatgatgcttggagaggagaatacttatcatctggtgcacattagtatattcggctgcctctgccaggtagctgaaattctttgcatgactacttgctcgctggcgtcctatggaagctgctaaggttcgaatccaaagccagtccaggtctatgccagacacttggagggatgcagctcccaggaatgtatcaggaagaaggtctacataaggattctactagggggttgctcctctctggatgagacagataccatacaccatgatgaagttcgcctgctatgaacgtcactgttcgaacgcgactgtacaagtggtggttcctaatggcccgaagtgaatgttcacaagccaggagcatgcttgggtatgtgaacaattttgtcagcaggttcatatagctggagtcttccgtgcaaattgtggctcgagcctgctgatactgtggtatctgtgttgaatcaaagcacacccggtagcagtgcttctgtggtccttcgaaggagagttgagagttagagaggtgtagtgggaaaggggtacatgttgggaccggtatcctccattgattgtggacccttgagtggcacctaacagggcggtaattctatgaatccggggaaaggtctacttccgaacttacctcggcctactctaccggaatatgcaagaggtgtctgaagaagacatctgggggtaaccccccagaggtaagctcgaacgcacactgtgggaccggaagttgtgcctgattggtacaggttcaaagaaaagcgcaatacgtcgaaccttgaactcttgggcgggctggcacttggtaaccggtagaaaacacgaaacagagactgggcagaggagaggataagaaataacgggggagaaacacggcagtgcacacaggaaaaactggagacatctggagcggaagg

SEQ ID NO: 624292 - DNA, 550 bp, Homo sapiens
  misc_feature (276)..(276): n is a, c, g, or t
catttgtatgccttattttgcaaaatgtctattcacagagaatgaatattctcgcttctcttttcccggggcctctgtgtggagccaccattcctcaggaactgggagggggttagtggtgaaagggtgagagaccacagacacagcctcataggccagagcctcagggacatcacagagcacagaagtccaaggggtgcccacttcctgcttcctgtcatctcacttaggggcaatgttccatccaatggcctggctaaggtttcagaactcaancgtttaaccaagattttaaatatatttgtgaaatattgcatgaaggccccaaagaaatttatactcttttctttctttttctttatggcaatcatcactgtagataacaactctgaacctacatggcaatgcttatagcttcattcattctgtctctgatttattggaagggatccacaacagtagtacaaatgcccagcatcatgtacttgtcatctttgctttttgtgggcttttttttaagagacagagagagactccatctcaaaaaaag

SEQ ID NO: 624293 - DNA, 291 bp, Homo sapiens
attgcctttatctaaagaatcgaaagatggtgactaggagtaggtccctgagaaacaaggcatgagggtaggagacgtggagcatatataagcaagattcttaatagtcagagtagatattgggtagctaattctggtattgggtttgggtttttaactcttcccactttatggtaggagcacattcatggtgcatgagagaaatgaaataagtgacagcaggtcacactcaacctttaaaacataaactcttgagggcagagctgatgacttaatggtatgtgcgtagaa

SEQ ID NO: 624294 - DNA, 160 bp, Homo sapiens
gtgcatggctggagagatagtggaacagtgaggggtagagcggtaggcattccatgcagagtactgagccctggggcctgagggtgaatgccagtgaaggaaagtgaagcgcagttaaggcactggtggggaattagatatgtgaacatactatctaaag

SEQ ID NO: 624295 - DNA, 195 bp, Homo sapiens
ttcgacgctcggtaccgaactctcgaccacgttgtgacggtgcttcctagggtggtcgcttgtggttggacgggtcctactcacgacacactggacggacgcaaccaacacgacttacgctgaacgccctcacctgtctgggacctgggacgccttgacgtcgctccttgtactgcccacaccttgtcgacgact

SEQ ID NO: 624296 - DNA, 113 bp, Homo sapiens
  misc_feature (4)..(4): n is a, c, g, or t
tcgntctagagtaccccttgctgcgtcctctttcttgaaattcatgatcacatcaaacaccttgaagatggggtccaggatcagctggcagaaggtgcgtgggggtaccgagc

SEQ ID NO: 624297 - DNA, 175 bp, Homo sapiens
  misc_feature (19)..(19): n is a, c, g, or t
  misc_feature (27)..(27): n is a, c, g, or t
atctgagccatgtctgcanacttacanactcagtcacggcaatgcctgatccttaactcactaagcaacaccaggaatctaaccctcgtcctcttaggtactagccaggttctttacccctgagccacagtagaaactcccctccctaaaatttctttaccttaactccctaccc

SEQ ID NO: 624298 - DNA, 910 bp, Homo sapiens
ccgtggtgctgtttcccagtggtccggggtgtgtcaccccgcagcgggggtgttgtgggtgccacccgacacattagttgtggcttccgtctgttgttgtccacctcccccgcctggcgctggtttcgctcaccccctggggagcggtgttttgcccgctggtcgtggaagtttcccacctataggagggcgtgcgtttagggtacaccaaggttgtgtcttagtcctgtgccgctggagccactgaagcgccgcacgggctggcttgtttgtggttagttgtgggtgcgccccccgccactttgttcgtagaatcacccccgcgttgttgtggtcatccacccccccctcggtggccgctccccacagtggcggacggccgcctcttcatgtgtggcgccatttgcccacgcgccgccgcccgcgggagtgtctttcgccggaccccgcttctttggtgggcccgctgttcttcttgcccctacatttgcccgcccgcgatggcgttctctccccctcgtgggaacacccccgcgggcggggcgctgcgtgccgccagcggttggggtttctccccgctgtgtgtgggagacgccagacggttgaggcactcctttgttgtgggatacgcccgctgccagggggtacgcccccgagcagatagggggggggggttttctgtgtgggagggccacgaagggggggcgcttagaggcggtggacccccctcctcgcctcctgcggttttccgtgccgctgatgccgtgttttgtgtccagtggccgccttgtcgtcttgccgcccgggaattttgttttcgcccccattttggttttttgttttttttttgggggggttttaaacccacccggcccaatattgggcccccaaaaaaaaattttttttttta

SEQ ID NO: 624299 - DNA, 491 bp, Homo sapiens
cgtgagttcgtttttctgccacctcactttggggctgggctggttctccaccctcgcagggtgcgtttctcaatccagacgctggggggcgctagtacctcgcgagctccgcgaggatcattcccgggacgccgcggagtcacctcccctcctagggacccagagcttcccagggccgcgcctgtaggttttccagaggtccccgaaaacgttaaagacctggaaggaaaaaaaaactgtaaaaccacacactttgatatttgacaacgtaaaagcaaggctgcaaaatcaaaatcaatgaacgcttgaaggaaatgtctacttagctagacatagtgccacctggattcactgttggctccagaatcccccccacggtgtcatcacgttggaaagtttttgtgggttagatgttctctgttgcaagaatgcctgtacatgcccaagaagcatatgagtttaatgggaccccaataacttcaaaagcaaaa

SEQ ID NO: 624300 - DNA, 1899 bp, Homo sapiens
  misc_feature (679)..(679): n is a, c, g, or t
  misc_feature (1007)..(1007): n is a, c, g, or t
  misc_feature (1475)..(1475): n is a, c, g, or t
  misc_feature (1536)..(1536): n is a, c, g, or t
ttcgtgggttctgtcatgttcgttcgtgcgttgctctttgatgttggttgctgagcgtcgtgtgttgtcgctcgtccgcttcgtagtgttggtgttgctattacctcgcatcgtcgtggtggtgtgtgtgtctctcgcgcggcttgcgtggttttttctgctcggagccttcttcttgtgccttcggggcaggaggtgccgggcggtgggtgtgctctcacttattgtttctctctctccgcctctcgaggtgtgttcgttgtcgggcgcgttgtatgtacccctgtgttactcgtctcgtggttggttcttttccgggaacatcctacgtgttgttgttccgccgagacatgtttgtttgtggagctgcttcgtctagtttgtgggtattcctgtatgtttcgctcttttgtgtccctctgcttcgtgggggtgtgtggggtttggtgggttccctttgcccgcacattggtgcgtcgtcctagagtgtctacatatgtatgcgcgatatggtttgtcgcgttggtgagtgtggcgtccgtgcgtcccgccgagtgtgtgccgcctgttctaaaattggggcgcaagaacgcgccacgaggcgagtggttcgtacagtggcacacaacgtggactccggggctcccctatcttggaggggggaccccttggtgttttntttaagtggcgttctcaatcaagaagcctgctggactacaccgttgtctaacagtgggtcgcccacacccgattggtgcctcctcccgcgcctcctgtgtgggtagaggaaatgtgtccccctccccacgcgggggttgcacacccacccgttgcacgacgccgtgggtgagacgcgcccctctctcaacacagtgggggggtaaatggatgagcgcccctctgcggttttttccacaagaggggggcaccaccacgcctggtggggagcggctggaaccccactctgctcgtgttggtggcgctcgtgcttaaacacgcgccgctgntgttgcccacgactgggtgtctcttctcccccgcgggtctttgttttcccgcagagccccccttgggagagaccccactcgcggagaagacaccctcttgtcacactttggcactctcgtgtgggctcttatacccccggcagtgtttctcccccgagccctcctcgccgctgttattccccgctctcaccctctctctgtttcaccacaaattgtctctgggggaacacaccacttttctcgcggcccacgagaggtgtacacacaccacgtcggcttgttccgcctctcgcccgtctctcgcgagagagagagtctggtgcccccctcgagaagcggagaggctcgggtgggagacgcgctcgaacgcgtggaccctcgggaccacacaccgcgcgcttatcacagcaccactcacaagagagacgctctgctgtggtgtgtcgcctcggggctctcccacagcgngggttcacacacagcgagagtctgtccccgcgcgagagagagagtataccctcgagacttnggggcactatcccgcgccacaggagagccacacaccccacaggcgcacaccaccacacacactttctactcgtgagaccacgcactactggcgcgctggcacacccgaaggagactggagaaagaagggggaacaccctcttcttcctcgcacaggtgggccccgagagggccctcgcccctggcctctcacacacacacaggagaagagccacttcgagccccttggcgggtgaaaacccaccccacagtccacagtgtttgttgttactggcggaaggtggagcggcaccccggtatctgagagccccccccctgttccccaccccctggattactccaccatggtccccccacgcccaaa

SEQ ID NO: 624301 - DNA, 210 bp, Homo sapiens
ctgaggcaacaacgtttagagatcatcactgtatcgagaccgcacgctttttgctggattgttctccctgttaaggacctgtttaaaactagtcctcccgggcacctgtgattgcattttcatcaggcattctcatttcagtcaatcatgcatgtctcattttcacattcagcccccaacctcacgtcactgaacatcagggtggtctag

SEQ ID NO: 624302 - DNA, 316 bp, Homo sapiens
  misc_feature (12)..(12): n is a, c, g, or t
  misc_feature (216)..(216): n is a, c, g, or t
  misc_feature (218)..(218): n is a, c, g, or t
tgacttcaaatnatctgccctcctcagcctcccaaagtgctgggattataggcgtgagcaccgcacccggccagcaccttgattttagatttcccagcccccagaacttctccagaactgtgagaaataaactgctattatttagattatacagtctcaggtattttgttatagcagcactaatggattgagacaaatggccgcttttttgttttngntttttttgagacagagtctcgctctatcgcccaggctggagtgcagtggcgcttttcccggctcaccgcaagctctgcctcccgggtttcaagccatt

SEQ ID NO: 624303 - DNA, 410 bp, Homo sapiens
  misc_feature (39)..(39): n is a, c, g, or t
  misc_feature (58)..(58): n is a, c, g, or t
  misc_feature (82)..(82): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (396)..(396): n is a, c, g, or t
ccaagggcttgcaaaccctgtgaccttcaagaccttcgnttggctgcgaaaacggccngcttgggcccgaagccgggagtgngctctggttttccattcgtgcgcaacctttctgaatgattccccgggcaaacagacctggcctggggggtgcaggctggccctggatcgccggacggtcttctcgccggtatggatcctctggtggtggaagagggccgggcgctcacggaagcgcggccacactgcgtananancgaaggcttctcgcccgtgtgaatagcccggtggctgagcagcactggcccttggcgaagccttgccacagtccacgcagcggaaggccgctcgcccgtgtgcaggagctggtgctgggtgaggttggagctgtggctnaacagcgcggtcgc

SEQ ID NO: 624304 - DNA, 310 bp, Homo sapiens
tcagggtttccagcagcggcattcaaagtaaagaaaccatttcttgtttgaaggattttttttttggtggacacagtcttgctctgtcacccaggctggagtgcattcgtgcgatctgggctcactgcaacctccgtctcccaggttcaagcgattctcctgcctcagcctcccgagtagctgggattacaggtatgcaccaatacgctgggctaattcttgtatttttaggagagatggggatttcaccatgttggccaggctggtctcaaactcctgacctcaggtgacccacctgcctcagcctccc

SEQ ID NO: 624305 - DNA, 231 bp, Homo sapiens
ggtgagagccagttggaccaatctatcaccctatagaagaactaatgttagtataagtaacatgaaaacattctcctccgcataggctgcgtcagattaaaacactgttctgcaattaacagtccattatctacatcaaccaacacgtcattattaccctaactgtaaaccaacacaggcatgctcataaggaaggttaaaaagtaaaggactcggcaattaccgctgtac

SEQ ID NO: 624306 - DNA, 859 bp, Homo sapiens
taacgggtacgcggggtctcgcgcagtctcataggcttcggttagaaccgtgggtatatccggcagcgcctctgttacgccactcgccgcgtgtgccgcagaccgttcacggtccaagcgcccttcccttatcaagccgcccaataaatcttctttagaagaccctcaaaaatttcgggtgagggcctttttcattatgtgactttcggggcccccaaaggggtccgtcgtttccccaccgccccccggggttttttccgtccccaacaagtggacaggacagtttttcctctcgtggcgtccgatacccaccggcgccctcttgtccccctcttgcccctctttaagcctcccccattgcccccaaactcccccggcggtttctagcaataacgcccaccttttttttgggcgaaaaataatacagagcacacatattcttcttctcccgaggtaactttaatttcttcttcccctgcaacgatggaacacacatcatattgctctcttggtcaaaattatatcaacacccctggcaccatctcgctcctacactttactccccttgtaacacaaattatacttcccccgcgaatcactgacagttgcaaacactttgcactacttctcacaggtctcgtcctttatagcaatgtgtcaaattatagtcaagactttttcccccaacacttggcctcttctgcacccccacagatcttctataaaagctgaaggtgttcttccaaaaaagtttaaacaccaatattggtattatcgttcccaagatactaatatagttgacaagtacaagccacccccttttttcaaatgggggcaaaaaaaaaaatttttcaccaca

SEQ ID NO: 624307 - DNA, 789 bp, Homo sapiens
gaactcggtggtggccactgcgcagaccagaattcgttcgctactcgtgcgcctcgctcttgctgtgttcctccgcaagcatgtctgactaatagcccgatatggctgaggatcgagaaagttcaggatacatgtctgataactgatagtaacgagcagaggacgcgatgagaaaaactccagctgccttccataatgaatgcgatttgaacaggagaagcataggcaggcgatatcagataagtgagtgcgtgcgccgtcaaaatatgctcctggtacagttccacaaggcagtggtcttcttgattttacttctcttatagctgtgctaactctttgtaaggatgcaaagacggttggaatcatcgtttaaatagagtgtgatggttgctcctctttctacatcaaacagaacttgactgactataggatatggtcggcgcactggtcttatctcacagtctagtactatctagtacgttggttgggctagggtaaggaaaggaacgttgcatgggttggtgaacggaaagaagtggggtgggaagaaaggtggggtggggtactgcaccatgtagaaaatactagcaggtaaatacacctagagcttggcccacaggttgttcctggcaggctggtaaatgccagtggtcacatcatgatggtgccaattgtgaggttttaggactcgatccggatctatacttgattgtgggaattgcaccagtgctgcttaggtatgacaaatatagtaaggtttagacatgcccaaagaacaaagattcagaa

SEQ ID NO: 624308 - DNA, 869 bp, Homo sapiens
  misc_feature (867)..(868): n is a, c, g, or t
tgatgtggtaaggcatagtctagctaaaggatcaccgtgtctcatatggctgtagtgatcgtagtgcctcaaagccggatagatgttgccatcagaataatgtaacgtgacacatactaagaagagtgaataaggttcacgtgatgagcgtctacaaggccgataatttcaggtcttatctaccgtgttagtattgtgctaatttccctatgtatgtgatgtgaaatgaagactgagtatatggtggaatggtaggtgactgaaagaaagagggtctatgtatgagggagattccgctgttctggatcggaggggtagagtgttacgagtgtatcatgtgatgatgcttgaccggtataagagattcggttgggattatttgagagagttgttatattaataaccgaagacagtatcgggtataatgttagaaaatgcagatctgtcattgcaaaagtgagcaaaatattttatgctttaaaaaatgtggatgctttcatatgtcaaaatggaatctatggagctttggtccagcagaatggatttgacttggacatgggtcattaaatgctaggtatggaggaacaatgcctatgaatttgacactgagaagagtaggtttacttaaacacttttgtttttatgaagtcatggttatccacgttagcataacctgatttccgtgaatactaatcacaggtcaatttgcggtctgcaagcgggatcctggaatgataaggtgggttataagatagattggagggttgccggaaagagcgtgggcaacagggataagggcgggttccgagaggattaatgatgagaatcgttggaaaatactatgtatgatatgctttgttaataggnng

SEQ ID NO: 624309 - DNA, 893 bp, Homo sapiens
gtgccaaggagctgaagcacaagtccagcacctcagcaactgtgctcatgacgctgactgccggtctccctgccacctgcctgtgaatgcggccccggcttgcactgtgccactatcagtgacctggtctgacatggactcgcaggtgctcacccagtctgcccagctggctgcttgtgacctggtgcgtgccctgtcccccagctgaccagctgtgccccttgtgtaaagtggttgtccacccatgacctgtaccacctgtaacttgtggcaaggcgtatcccattcaggcagccccaccgaacagactccacacgtgtactcccactgcttgctctgagtgggatacacagatcattggcctcttcctggctccacacctaccccaagcacgagatgggagactcacacccagtgactgctgtccaagaactcactgtgtcccttgagcagctggctgcacgtgacagagacaggtaagtcacggatgtttcaatggtgtgtcagatcctgcttgacagcttggatacaacggttacgaccttggaccttgtggccccacagacactcccaagaacacagtagggacccaagagaacctacgacctgggcaatccagacagcaacttagttgacaagtgaacacgacaggtgggctggcccccagtgcacatgacgcgagcacaaagcgccacaccaaattttcagggcttgccatgcccaattgcacgagcgaacccacggacgctggacacgttagccgtacaggcgccgctgacgacgggccccttagcaacacgtaacaggcgactgcatggcatccttaaggccgaacggcagccacgggagacgaggccccatggacggcacgagctgacatcgtacgacagagg

SEQ ID NO: 624310 - DNA, 395 bp, Homo sapiens
gtattactctcctagacggcatggagagcctgcagcatggatgctcttcattgttgcttgaaggattcatcctcttgatcatgcgtatgtcacggcagtgaggaattaaagtttctgcatattgctctgtggtcctgctctaggaaaccgagagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatggtatggccctcctccgcctgccctgagcaagccttgtggtgcttccaactccactctgtgaatggagagct

SEQ ID NO: 624311 - DNA, 375 bp, Homo sapiens
  misc_feature (12)..(12): n is a, c, g, or t
  misc_feature (192)..(192): n is a, c, g, or t
  misc_feature (209)..(209): n is a, c, g, or t
  misc_feature (211)..(212): n is a, c, g, or t
  misc_feature (225)..(225): n is a, c, g, or t
ttgatagcccanatcccaggagagcacatgaggagggtgtgtgggaagaatggaggtactgaggcagggtgcagtggctcacacctgtaatcccagcactttgggaggccaggcaggcagatcacttgaggccaggagttggagaccagcctggccaacatggtgaaaccctgtctcttctagaaagcacanaaaatgagctgtggcgntnntctggtgggcacnctgtaatcccagctacttgggaggcttaggcaggagaatcactggaacccgggaggcagaggttgcagtgagccaagatcgcaccactacactccagcctaggccacaaagcaagactgtttctcaacaacaacaacgacaacaacaacg

SEQ ID NO: 624312 - DNA, 226 bp, Homo sapiens
ctgttccgttagtgtgtgtgcttttatgcccgtaccatgctgttttgattactgtagcttgatagtagattttcaaattaggtaatgtgaagcctctggatttgctttttgctcaagactgctttggctatttggggtcatttgtggttccatatgaattttaggattttttttctgtttctgtggaaagtgtcattagataaagattgcattcagtctttaggtc

SEQ ID NO: 624313 - DNA, 171 bp, Homo sapiens
  misc_feature (155)..(156): n is a, c, g, or t
gtcgacctctacgacggactccccgcgaacggtcctggtcggttggacgcgacgcactcccccacacacgttccaacactgtgggctgacggacctttgacttgcaccctggttgtttttttacctacgtcacttccacacactactgacgactnngcgtgtgttaccacg

SEQ ID NO: 624314 - DNA, 730 bp, Homo sapiens
  misc_feature (239)..(239): n is a, c, g, or t
ctcgggatttggggcttgggtcgtttctcacaagcaacctggaggcctgcgccgcgggcggcgtctccctggtgggatgctcatgcgctggaggctgggtgtctcggccggggacgtgtggggtgtgcccggaccctcccctccacatcccgccccttaatgcagctttaacgtgggcctggagcctggctggcgtatttcctatcccatggaaatcccctgggccagtctgtgaccanacaaatggccctgagaccccgcccgaccccgctgagcccaacaacatgggcccaactggtccctggctccggggtggcgggatcgggcctggatcggctgccggtgcctgccagctgggcagggttacggcttgcttgacggggcacggcacccggatgtcctggcttgacgctcatggccctgatgctgcctagcggccacggggacatggttgccatggcggaggcacgagtgcaggggtggcagtggcaaggtccgtggacctgcccccttgccgtgcccgacgcagctgctcactctctactttgacaaccgccgacgctctggacggggaccctgtgtcgagctggccacagactgggcctgtggcggcgtcctcaccttcacgagcaagcctgcagacgccgagcagggtcttggccccaggccgatcattgcactaccatggctgcccagcttgagcctgcgtgccagctccaccacgagccct

SEQ ID NO: 624315 - DNA, 750 bp, Homo sapiens
aatggtgcccaggctggagtgcagtggcgtgatctcggtcactacaaactacacctcccagccgctgccttggctcccaaagtgccgagattgcagcctctgcccggctgcaccccgtctgggaagtgaggagtgtctctgcctggcgcccatcgtctgggatgtgaggagcccctctgctggctgcccagtctggaaagtgaggagcgtctccacccggccgccatcccatctaggaagtgaggagcgcctcttcccagcgccatcacatctaggaagtgaggagcgtctctgcctggccgccatcgtctgagatgtggggagcgcctctgcccggcgcccatctgggatgtgaggagcgcctctgcccggcagctgcccgtctgcgaagtgaggagcccctccgcccggcagctgccccgtctgaccacgtgaggagcctctccgcccggcagccgacccatctgggcacggttacagcagtacctatttctgacgacaggaacacgttcgcccttctggaaatcagggtctcactttgtcacccaggctgcgcgctgccagtggcgtgatcttgcgcttgcctgcacgcatccaatctcctgcattcacgtgatcctccttcatcagcttccctactatgctgggacctaccattcatgccccagctactttttatactctttgcaccgaagcgttcaccacacgtcgcccatgtgcctccaactcccttgcctcacgcactcgctg

SEQ ID NO: 624316 - DNA, 546 bp, Homo sapiens
gaagaaaaaaaacgcaggacaggcgcgctaatcggacgagggtctctcaaaatatacatctgaagaaagtctacttatgaatacattttatatataacaaacggtgaaaattttagaccaaaccatgtcttctgggttgtagtgattaaaaaatggttaagcagacatgtccctatacaaggcatatgttattaaacatgcaaatttaggcattagttttctctttgaacaattctttagatatgctgcaggttacagattggaggttacaattagcagcaaagcaatataagggaagcatggcagatggtaaaaacgatttcccctggctttacataataaatatttggcagtatctttggtttcaaactttatacttatttaaccaggcaaggatatttggcaaggttataaaactttggacggactggttagaggtatataataagtaaggtcccatggctaatactaaatggtgggttggctgaaaataaattaaagttagaatactaaatatgtgaaaagaaatattaggggtaaaatatt

SEQ ID NO: 624317 - DNA, 416 bp, Homo sapiens
tactgctgcttctcctcctcggcacatgaggctggggtgagtagcaatactggtgcccacagcaggagttgcctcacaatctccgtggctcaagtgtgtgtaaggccctcatgaagtaactgggagctgtgtccatggaagaggtcaaagaaccagggttctggggattctctgccttggattccccctaaaactccctcagtctacagagaggaggggaacacaacactggactcaggtcaaggtaaaagcatgcataccaccagcttcctattttctgcaacaagctcagtgtgccttcatgtagcattagaatgccaggagagtgggtctgtgaaaccctaaggaatctggcccccatgttgctgtaacagaggacattttacccactgttggtctgcatgggagtggggcta

SEQ ID NO: 624318 - DNA, 154 bp, Homo sapiens
tgtcatacctgcactgttgttcatatcctctcggcggcactgttgttcatacctggtcgctgtatcggggggcttactagaagtgtgaaaacgtaggcttggaggtatgaacaacagtgcacactgttgttcatacccccagatacagcgacca

SEQ ID NO: 624319 - DNA, 107 bp, Homo sapiens
ctctagatggatcccccgattctatgcgggtgctgccgggcgcgtacgcgcgtgcctgttgtcccagctactcgggcatgctgactgtgggaggatcgtcttgatgc

SEQ ID NO: 624320 - DNA, 1686 bp, Homo sapiens
  misc_feature (674)..(674): n is a, c, g, or t
tagataggaacaagggtttttttttttacacatcccgaccacaaaaaaaggcactacacggcttttttttaatttaaaaactacacattggacttcatgtgttttaaaaatgtccacaaaaatattggagtggctctctttggaaccctctttatggagggtggtgccgtgttcccattcccccctcaaaaaagaaaatacttcttagggaaaaaaaaaatatatctcacacaatatttggagtatgtgaaccacaaaagatatctccacatatatatcgctctctctctcatgctgggtggggtgtgtccctcttatttctccccacactctgtggagtggctctgggggagtatgcgcgccgtctatgaggggctgagcgaagccacctgtgtgtgagagcgcgacacaatgtgagagaaatatatccccgtgggtgtgtgagagtgggtgtgcgagggcgtgtgtgtgaagagcgcccctctgtggagagagatctgtgtgtggcgcgcgacagttgagagcggagagagaggagaagatatatcttcctctcagagagtattcccacacagagactcctctgagagagtctctatgagtagcatatgtgtgtgtgtggaggagagtccccacacagaggggggtcgtgtgtgtgcgcacaggagtgtgtnatagcacacgcgtgcgtgtatatctttagagagcgctcatattatcccgcggggggagagagaagtagtggacgggacctctctctgtgtgaaccacctataacgacgacagcccccatcatttgtgtgttgtcggtgagaataaggacaactatgagaaccacacgcggtgtggtggggcgcccaccaccgatgctggtttggatgcaaccaacacaacacacgagggggggggtatctactaccagcgaggtgagggataacccactaggaggcgcccacaccacccatgctgatgggagagacagacccctcctgctctatcccaaaaaaagatacagggaggagccatgactcctcatcggtcgcacaccaacattcaccctcgacggggggagcaaatcgttgggtggggggcagaaagaatgcacgacacgccgaacaagcaaagaattctaactccactctcaccacaacacaatcacatcaccttcttcttgcaccaaccagacgcgcggtgtggtctctgggtgggccacccaaccatacaaacagaagaagagcacctcccctcgacggagtcgaaacataatcaaacatatcaagcacatgtatatccctccccttataagatggagtactatattaccacaattctatactcttccaagcaagagagaacgccgctctaggatgtgggggagacacgccaccgaaaaagaaatatttaattaatccggtgtcagaagagaagaacagaccgcccactagtaataaaagacccgtcctcccacaccaaattatgagggcacgcacgaagaagagtgatttattcatcacatgttcgcacgcacaccaaaattgctgataaatgggcgctctatacaacaaacaagagcaggaggacgtgtacgccaacgtaaatctaacccgccgacgcgtaagagaagaaggcgcagcaatattgcatacacacacagatgattcctggctcgtgaccgaccaattatgt

SEQ ID NO: 624321 - DNA, 487 bp, Homo sapiens
  misc_feature (137)..(137): n is a, c, g, or t
tgcccacccggagttgaagccccattaaccgccaacttcaaaaatcgggaaaccattccggcccgaggtccacttgttgccgcccctgtgggaggagttggccttgaacaagttggtgacgttaaggtgcttggcangtggtttcagccccaagaatgtgttgttttgttggttgcaggggtcacaggagttgccccgcgaaaagtccttgatttgggcttccgggcgggagcccagccagggcccccccccttttgttgtgaccagcattttgggggtggcacccgaggattggaaaaagggggaccctttttcttgcatggtgggccacggggccctgccgttggcttttacacaaaagaccttggcccgtttggggggtaaacccacccatgtcaatgtttttgtttttatggggggggtggggggcccttgtttttgagccgcccgcttgtccccccccttgaataaattccatgttccccca

SEQ ID NO: 624322 - DNA, 355 bp, Homo sapiens
  misc_feature (3)..(3): n is a, c, g, or t
  misc_feature (17)..(17): n is a, c, g, or t
  misc_feature (99)..(99): n is a, c, g, or t
  misc_feature (117)..(117): n is a, c, g, or t
  misc_feature (127)..(127): n is a, c, g, or t
  misc_feature (129)..(129): n is a, c, g, or t
  misc_feature (150)..(150): n is a, c, g, or t
  misc_feature (154)..(154): n is a, c, g, or t
ganaaaggaaaggggtngaatcactttcggacttgggaataatgtggattccccagtgctttccctatctgttaaagcctaggatgaattggtattgcntccataggcagtttgacngcatgtattngngattgaaaggaggtgtagtantgcntggaacttggtgctttaaattagggtactccctgctgctgtagaatggattcccccacagtggatagctatgggtgattcagaatattatgtttagattccccatttgttaagtttataagttttgtggggaattatgaacttactgtgtactacctgcatttgtgctgtgtgaaaaataaatacaaggattcgtttagct

SEQ ID NO: 624323 - DNA, 478 bp, Homo sapiens
ttatcgtcatcatcacgcctatcactggaggttttactgatggggatgcgaaggccctaagaggagaagcagtttgcccagggtcacagagcaagttcatgattctcaacaaagggcttctactgcttcacaggctcaggatttcttttttttttttttgagacggagtcactctgctgcccaggctggagtgcagtggcgtgatctcggcttactgcaagcgccgcctgctgggctcacgccattctcctgcctcagcctcccaagcagctgggattacaggcacccgccaccatgcccagctaatttttgtattttttagtagagacggggtttcattgcgttggtctggctggtctcgaactcctgatctcaagtgatctgcccacctcagcctcccaaaatgctgggattacaggtgcgagccaccacgcccggctccaaaatggtctgttcttgagagagtgcgtgtaccagc

SEQ ID NO: 624324 - DNA, 249 bp, Homo sapiens
  misc_feature (1)..(1): n is a, c, g, or t
ntcgttagggtagtgacgatccatggtagtagggcaacgaccttgctagatcagacaacctggataccgccttttcttgcattggctcaacatctttaacaacagcagcaaccgctccatttaaacccagatgtaatagttggctaatatcgcctttacaaacaacatctgcatcaagataaagcaaacgatcaagcgttaaacccaataattgaaatgcaaataaactgtagtacattgctcttgacc

SEQ ID NO: 624325 - DNA, 139 bp, Homo sapiens
atcttacacatgcaatgcatacccgaacagatgagtacacgctctcattcaccagatcaaaagggacaagcatcaagcacgcagacaatgcagctcataacgcttagcctagaccacacccccacggtaaacagcagtg

SEQ ID NO: 624326 - DNA, 431 bp, Homo sapiens
caattcatgcacagttattttttatggatgttttgatttcagtaaatatcaaggatggggttattgagtcatcaggcaagcttatgttagttttataatcaattcccagatgtttttatcaaaagggagaaattttccagtcccatcagcagtgtatgagaatttggtttgctttttatggtttccaacatttggtattgccagtcattttaatttgcattttggtgggtgggtagtagtatttcaatatggttttttttgttttgttttgtttttgttttgagacgaagtttcgcttttttacccaggttggaggtgcaatggcccaattttgtcccactgcaacctttgcctttgggttcaagtgatatttgtgtttcagcctccccagtagctggaatttcagacatgggccccccccccttttttca

SEQ ID NO: 624327 - DNA, 168 bp, Homo sapiens
ggtcgcagggaactggctacttagaagctacgtggacggtttagaaggcataaggttcctgatggaaaaccagaaaatgagttggcgtttaatgcagaattaaagataaggacttggccattgatattattaaaagcactcatagaccatggagaaagcatttagtga

SEQ ID NO: 624328 - DNA, 122 bp, Homo sapiens
agctggtaccggtggagtccttaaaagctgtttggctcagcagaatgttcccttaaaaatgttctgcccgggccgagtgtagtggctcacacctgtaatccagcacttgggggctccagggt

SEQ ID NO: 624329 - DNA, 339 bp, Homo sapiens
  misc_feature (147)..(147): n is a, c, g, or t
  misc_feature (189)..(189): n is a, c, g, or t
  misc_feature (226)..(226): n is a, c, g, or t
  misc_feature (230)..(230): n is a, c, g, or t
  misc_feature (232)..(232): n is a, c, g, or t
  misc_feature (234)..(234): n is a, c, g, or t
  misc_feature (286)..(286): n is a, c, g, or t
cggcggatctgtctttattttgaaaaggtgggaaatatctatttctggagtggtattaagttattgcatattttaggtgcaggagggtggtgatatttaattgtgagggtggcatttacaatcctgccatgtagtcccagctactcnggagggtaggcaggaaatggtgtaacccggaggggacttgcntgagccaagatcgcgccattgcactggggggggggcnacanancnagactccatcttaagggatatagcccagctgtgtccagccaggggggagaancgcatcttccttctgattcagtccgtcctgggttcgtctgctgatgctgagca

SEQ ID NO: 624330 - DNA, 146 bp, Homo sapiens
cggtctcagtctttaatcgtggcagggcctcagtgacgagcgcacgatactcacactcagcgagcagctcaagtgtgaacctggcaataagctcactctgcacgtgcagctcgatcttggtgaagtggtcccacagccagtctgtc

SEQ ID NO: 624331 - DNA, 404 bp, Homo sapiens
  misc_feature (128)..(129): n is a, c, g, or t
  misc_feature (148)..(148): n is a, c, g, or t
  misc_feature (185)..(185): n is a, c, g, or t
  misc_feature (189)..(189): n is a, c, g, or t
ccgtcccgggttgcgggtgtcctgggctttgctgccatccacaacctttactcaatgttcgactgtgactagaagatcctgcctgtgctctgcggtctcactgtagatcctgagaaatccgtgcgagnncaggccttcaaggccattnggagcttcctgtccaaattggagtctgtgtcggaggncccnacccaagtgtaagaagtggagaagaatgtccatgcagcctccagccctggcatgggaggaaccgcagctaggtgggcaggctgggccgtgatcggggtctcctcactcacctccaatttgatccgtttggtcccaacctttgcccctcccttcatccattccccatgggaaatgtttaccagtatgaataaactcccccccttagtgaaaaaaaa

SEQ ID NO: 624332 - DNA, 194 bp, Homo sapiens
cacccaccgcctacacagaaaagcggaggggtcctgctgcctcaaggcgtgcgctgagcctacaagaaagttcctatctgggccctgctcacgaggtgctggagtccaggcaggcagccaccctggggagagaggaagagaagccaagaccactaccggagaagaaacagctcatgaggctacggaaacagccg

SEQ ID NO: 624333 - DNA, 285 bp, Homo sapiens
caggctcccctcggtccccagcgcgttctcgagttggctgagctttccaggcttgtgcctcgaccctcccgagtcccctccaggtgtgcgttgtggcaggggcctggtctggcctttcctggtgtcagcatcgggcaccccaggtgggggcacatgtgtggcacaccagcacatggcacctcgtgctgtgggcacaagctcactctcagttcgccagcctaattgtgtttggagcactattccttgttgtcatcccggtggggcttactcgtgtcactgcgcagg

SEQ ID NO: 624334 - DNA, 193 bp, Homo sapiens
ctacgtgctggtgcttgctgtgctatcatctaggaaaatggtggagcaggaactgtatttccttgctatttgtcctggaggatgatggttaattgaagagcactcttgctgtatttctctcacgtactgtctgagatacactgatgaatattgtgctggccctgaggatgatctgagggatatgaataccctg

SEQ ID NO: 624335 - DNA, 133 bp, Homo sapiens
  misc_feature (19)..(20): n is a, c, g, or t
  misc_feature (28)..(28): n is a, c, g, or t
  misc_feature (56)..(56): n is a, c, g, or t
aggtaccccggtttcggtnncctcgtantgggtattctcgtgagtgtttgtatcantgtgtgcatgaaactaaacgacgtcctgatacgctctttgcagtcaacctttgcaaaatagttcttggcttcattga

SEQ ID NO: 624336 - DNA, 519 bp, Homo sapiens
  misc_feature (400)..(400): n is a, c, g, or t
gatacccgagcgatgcctgcaccagccctggatgacttctctggcctaggggtttacacagcccctctggatgggattgatgctgggggttcacagccagagcctggacagaccccttgcaggttggcttgggaacttaaaggcctcccttgtgctcttgaaccccaaggggctgccccttgggccccttttgaaggtctaccccgaatgcaagcagacagcagggcagggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggagcggggnggctccctgtccatggagttgggggtctctacgggtgttagtccagcccgagatgagggctccctacggctctgtactgactcactgccagagactgatgactcactattgtgcgatgc

SEQ ID NO: 624337 - DNA, 781 bp, Homo sapiens
  misc_feature (338)..(338): n is a, c, g, or t
  misc_feature (368)..(368): n is a, c, g, or t
  misc_feature (493)..(493): n is a, c, g, or t
ataatggtacaatagaccgttcgtccctgtgatagccagatagtagatttatatcagggcaacatctttcctatatagagtctccgtgaggtcctcattccgctaagtcctggcatcaattgatcatgcagcgcaggatcggtcccttgcaattatctcattgtcaacctgagtacaacccaactatattagtcctgcttatcagactacaattgaatcgtgtcgccgaatggtgcaccaatgcatcagttcgtatcagatacaggcgatagagagatagactaggacgatgccggaatccatgctcatgcaacacatacctgtcgacgtgcatcgcngactcctcggcggcgatgcaacatgcattnttcatgggctcatgtgaaacgattcacagtaagacgatatttaaggttcgcccacatgttggaaatggcataccatttgcgtttggagatacgtttcaatgcagtcacactcatccacgtacttntatggttacatatatatagcgcgacctaagaatggattcgtacgtttgcgtccgaagtttatggcatgattagggtcatttgaggagttcgcccggactacaaacatatctcgcatatgaggaccgtactactcaacatcccgtcgagtacaatcatctcctacttatttcactatggagttcactaagggcagaagatcatatcacagtgcgaaagcccgaatgggtaggatccctgtgattcggcgtaacttcgtatacacccatggggggggttgaaaccataaa

SEQ ID NO: 624338 - DNA, 88 bp, Homo sapiens
tggtgtgggagagaatttacaagtcctttattgaaagaataattgttgcaaaatatattgcttctactttgcctggaaaaaaacaaaa

SEQ ID NO: 624339 - DNA, 226 bp, Homo sapiens
gcctaagatcaacaatgaagtattttataatgtatttatgctgctagactgtgggtcaaatgtctccattttcaaattatttagacttcttatgagtctaaactttgtaatctctaatcaatcatgtaaatgaactgctgctcattgagtagtctccacctactatcagatggctatatgctaaacgagaaactatggtcaggtctaactggctaattgtctatga

SEQ ID NO: 624340 - DNA, 514 bp, Homo sapiens
  misc_feature (408)..(408): n is a, c, g, or t
  misc_feature (416)..(416): n is a, c, g, or t
  misc_feature (420)..(420): n is a, c, g, or t
  misc_feature (425)..(425): n is a, c, g, or t
  misc_feature (428)..(428): n is a, c, g, or t
  misc_feature (440)..(440): n is a, c, g, or t
  misc_feature (443)..(443): n is a, c, g, or t
  misc_feature (472)..(472): n is a, c, g, or t
  misc_feature (485)..(485): n is a, c, g, or t
  misc_feature (497)..(497): n is a, c, g, or t
aaggcttactatcattaacgaacaaggtcgcgccatctaacgttatacccatcaaacggtaacctacgaataccccagggttatcgtggatcaaacaggtacccgatgccatagtcgccgccgccgacggtttaacatcgttaaaagtttcgttggtcgtgtctgacatgttgacagtttcgttggtaggagagccataaccacatcaaaaaattatcatagcatcatcatccgccacatcagatcaaagacaaaacagacagtgtgctatagagtaatcatatattattagtcccgctgttttccatcgtgacagggtcacacgcacattattaacgttaaaaagggctgaaaagtaggaatctccgttggcctataatacccggtatgtccgcgggtttgcaacgnaagtattngttncgtcnggnatcatcgaggcnggncatagtaattgtcatgttagcggccggtnataaaaccggctntcgcggtcaaangttaaggggagcaccat

SEQ ID NO: 624341 - DNA, 528 bp, Homo sapiens
taccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattgttcagttaaatgactgta

SEQ ID NO: 624342 - DNA, 552 bp, Homo sapiens
gtgttgagccggtgggattttgaattcaaagatgaacaatgcttgccctgtcctatgcctgtcctgagagtggctaactgtacagggtacaagggaaggcatccttgtgtgacttggaagaagaggcaaggcaatgaacatgcatagagcacctgcttgtgcaggggactgtgctgtgttctttcaagattttatctcatttaaccctcttgactttgtgagatggcatttttacctgtgttgtgactttctcagaatcacacaaccaacaggattgaaacccagtgaggcccactacacaccctatgtgctccccccactcatgtgtcttcatgtgtgttgggctggtgggggcaggtcagtgaggtcagctgtgggctgttactacaccccatccatgtgcatgctgtggggcacaggtttcctcctgggttaggggccaggtgatgcttaaggctctgcccccatggtggtccctattcgggatctgcctcttagacagtaggtgacgccttatgcagggacagtggttctctgtcctcctgaggtgac

SEQ ID NO: 624343 - DNA, 425 bp, Homo sapiens
cagacctttcatcctaacatttcgttttaaatcttggaagtcaatctattcgcactggcattgttttctactcctatttcattttttttttttacagatattgagcaagagaagaaggccggagagggggcaaaatgaatctaacccgtcacacctattctcacatcctcacaattcctgtaccatgatctacacatcagttctaattctgtatatgagattcatattaacagcagctttaaagccataacactgaggtatcatctattcatcgcaactgtggatatcttcagttttttaaacttgtgatttgtataggagatggataatgcccatatcattctggtgccgttttctgttggctcttctttaaataacatgtgagattatatttttgcttaataaataagaatacagaagctcta

SEQ ID NO: 624344 - DNA, 950 bp, Homo sapiens
gtgagagtgccgcttgtactgttgccgtcacctcgcggaggagataccaatccggtagaggagaacgtcgtaggttcacaggggacactgggaagcatctttgcttgtcttgactaaatctaagattgaggggtgcgcggagatagttgcgcgcgatcagtagagataatttctatcgttcgtgatcaaagccatacaccgatactcgtcatgagaagctgtctatcaaacaatcacgcgagccgagcgtagccagcgacgcgaccatgcaagtaaactatgcgagtcaagctcggatgagctatcgtggccagagtagcgccataggctgtataatgcgttgcaaatccgtgagcaactcgcacaaagtcgagtatgtacgtgcaacgggctttatgaaccagttatatcttgtccctccgttgcatagctacacctagagtttatgccataacagcatctaatggctacggcactggagtatagaaagccagtgtcaaggggcactactaccgggagaaggacgcccgttatcgctaatagaggacgggtgagagcgaattacagtcgcctttctccctttgcccgtccgtggactcgacttcataccattcgataatagttcgccattcaaaaaccacggccgtcatgagtgtcccgaacagcagctcaggctaaacgctcggcaaggtcaacaccatctcacgttggcagaaaattccgatgatggaaagaagtggcggttaccgggaaaagatgtaaacgcccgatctgcccacactaatttgcccaaacttacaacgcgtgacgaactttcacggcaaggggggatattcaagggcggatacataactaccaacatcccacggggtccgcataaccgtgtaaacgcaatactacccgccggagaaacactcgcgcacttgtaccggcccttgtggcgaagcgaa

SEQ ID NO: 624345 - DNA, 297 bp, Homo sapiens
cttgtcgatccatatcctcgagtgctggtgcttctccttccatgcctccagctactctggaggctgaggagaatcacttgaactcaggaggcggaggttgcagtgagccaagatcgcgccactgcattccagcctggatgacagagcgagactccgtctcaaaaaaaaaaaagaagggaaaaaaaaaacctagataaaaaacttgcttggaaggccttactacacacacgcgcgcgcacacacacacacacacacacacatatatcttggatggccttgggggaatggacccgaata

SEQ ID NO: 624346 - DNA, 194 bp, Homo sapiens
ataattagtcacactcataaaaacatgacatggccgggcatggtggcccatgagtgtaatcctagcactctgggagaccaaggcaggaggatcacttgagcccaggagttcgagacccttggcaacatagtgtagaccctgtctctacaaaaaaattataaaattaggtgtggtggtgcgtgtttgtagttcca

SEQ ID NO: 624347 - DNA, 819 bp, Homo sapiens
  misc_feature (1)..(1): n is a, c, g, or t
ngcatattcacatgttgctcgaagtcccgcaatgtgcataatgcgccggatccccgctgctgggccggggttcaacacgggtgttcccaagagcacacccgtctacgcaattgtttaatcggctcgccgtaactgggtgctcccttatgcagcaaacatctgtgggagcacaagggtccaaccgaggctgaatggagcctcttgttgacaaagacaggagtcgtctcctgcaggggatgagcccgacagtcagagttctcagcggacagtgtcgcccgatccggggcacactgggtagtccccagggcagtcagcaatggccgcgtccgccctctaagagcgagtgagctcccccccgcctgtgccgaccaattggaggggggccccccagtgttcgccccaatggggcacgacccatccctcgtgcgtggtgtacaaggtgtggtgtccccgccccatgttgtcgtcgcctttcgcctccttcggcgtcccgcacgcatctttcgcccggcggcgccccttttctttcacaggagggtcacctagggctgttagacccctcgggtgatggactgtcgcccttcaagcctcgtggagtctacaggcggccctccaccgccccctccaagaggtggtgtcccacgggccccagatgacagtgggctgtcgtgcgaggtgggcagcagaggtggagacgggctgtgtaccccccccccgacccgatgagacagttttattacagacccgaggcaccgctatgcacaaatcgtttttaacaaccatacgaaaaaaagaatcttttttcccccaacaaagaca

SEQ ID NO: 624348 - DNA, 478 bp, Homo sapiens
  misc_feature (464)..(464): n is a, c, g, or t
aaacctatccccaaaggccaagggagcttacaggccaaagaaagaagctgacaaacctagtttctcagaaagaaatagggacttacaaatagaaccagtgtctccggcagctgagagatggtggatccctgcacttggcctgcaaaaaatatctttacatagcaagctttagggcaaagacatgtgcaactggtcatttctaagacttttttgtgaaatttgtgacttttggggaggttagatacccatctttatgaggggttatctgtgctataggcattgcttctttgtgaggggttatctatgctataggcattgtttctttgtgaggggttatctatgctataggcattgtttctttgtgaggggttatctatgatatgggaacacattggtcatcacagaggttttgtttcaagatcgagtcactccagcctgggcaacaaactaagattccatctcanaaacaaaaaaaaaa

SEQ ID NO: 624349 - DNA, 573 bp, Homo sapiens
  misc_feature (559)..(559): n is a, c, g, or t
aaacctatccccaaaggccaagggagcttacaggccaaagaaagaagctgacaaacctagtttctcagaaagaaatagggacttacaaatagaaccagtgtctccggcagctgagagatggtggatccctgcacttggcctgcaaaaaatatctttacatagcaagctttagggcaaagacatgtgcaactggtcatttctaagacttttttgtgaaatttgtgacttttggggaggttagatacccatctttatgaggggttatctgtgctataggcattgcttctttgtgaggggttatctatgctataggcattgtttctttgtgaggggttatctatgctataggcattgtttctttgtgaggggttatctatgatatgggaacacattggtcatcacagaggttttgtttcaagatcgagtcactccgggtgaaaacagcctgttttcctgcatgcaccaggccctgttctaagcattgaacaaatatctcatttaatctttacaacacccctttgaaatccagcctgggcaacaaactaagattccatctcanaaacaaaaaaaaaa

SEQ ID NO: 624350 - DNA, 860 bp, Homo sapiens
  misc_feature (12)..(12): n is a, c, g, or t
  misc_feature (67)..(67): n is a, c, g, or t
  misc_feature (73)..(73): n is a, c, g, or t
  misc_feature (79)..(79): n is a, c, g, or t
  misc_feature (82)..(82): n is a, c, g, or t
  misc_feature (97)..(98): n is a, c, g, or t
  misc_feature (129)..(131): n is a, c, g, or t
  misc_feature (133)..(134): n is a, c, g, or t
  misc_feature (136)..(139): n is a, c, g, or t
  misc_feature (144)..(145): n is a, c, g, or t
  misc_feature (147)..(147): n is a, c, g, or t
  misc_feature (152)..(152): n is a, c, g, or t
  misc_feature (156)..(157): n is a, c, g, or t
  misc_feature (166)..(168): n is a, c, g, or t
  misc_feature (173)..(174): n is a, c, g, or t
  misc_feature (181)..(181): n is a, c, g, or t
  misc_feature (185)..(185): n is a, c, g, or t
  misc_feature (187)..(187): n is a, c, g, or t
  misc_feature (196)..(196): n is a, c, g, or t
  misc_feature (199)..(199): n is a, c, g, or t
  misc_feature (207)..(207): n is a, c, g, or t
  misc_feature (210)..(210): n is a, c, g, or t
  misc_feature (216)..(219): n is a, c, g, or t
  misc_feature (226)..(226): n is a, c, g, or t
  misc_feature (238)..(238): n is a, c, g, or t
  misc_feature (249)..(249): n is a, c, g, or t
  misc_feature (254)..(254): n is a, c, g, or t
  misc_feature (263)..(264): n is a, c, g, or t
  misc_feature (291)..(291): n is a, c, g, or t
  misc_feature (298)..(298): n is a, c, g, or t
  misc_feature (304)..(306): n is a, c, g, or t
  misc_feature (313)..(313): n is a, c, g, or t
  misc_feature (315)..(315): n is a, c, g, or t
  misc_feature (320)..(321): n is a, c, g, or t
  misc_feature (329)..(331): n is a, c, g, or t
  misc_feature (337)..(337): n is a, c, g, or t
  misc_feature (340)..(340): n is a, c, g, or t
  misc_feature (346)..(347): n is a, c, g, or t
  misc_feature (361)..(363): n is a, c, g, or t
  misc_feature (375)..(375): n is a, c, g, or t
  misc_feature (400)..(400): n is a, c, g, or t
  misc_feature (414)..(419): n is a, c, g, or t
  misc_feature (512)..(512): n is a, c, g, or t
  misc_feature (528)..(528): n is a, c, g, or t
  misc_feature (533)..(533): n is a, c, g, or t
  misc_feature (539)..(539): n is a, c, g, or t
  misc_feature (638)..(638): n is a, c, g, or t
  misc_feature (645)..(645): n is a, c, g, or t
  misc_feature (707)..(707): n is a, c, g, or t
  misc_feature (726)..(727): n is a, c, g, or t
  misc_feature (731)..(731): n is a, c, g, or t
  misc_feature (752)..(752): n is a, c, g, or t
  misc_feature (769)..(769): n is a, c, g, or t
  misc_feature (818)..(818): n is a, c, g, or t
caggtaatgaantcacacaggaagtgttatagtgtgtacataaacccaacaccatacagacggcagncgccgnccccangcnccctcccaccctcgnngtggctgcctgttcccatactcactgtttgnnncnncnnnnctcanncnctgcnatcnnccatcgttnnncactnngtttgtntttntncggatttgnttntttttgtnttnttttgnnnntctcttncttccctgtttncgtcacttctngtttngttgttgtnngtttcttttttttttgggttttggggnaggttcngccttnnnggggggntnccagnntttttgtnnncaaggnggntttttnntgttttttggggtnnnatttgggttggncatgtgggggggggcaatttttgtnatttttcttgggtnnnnnngctcggggtctgtggtttttgttttgttattgctgtttgctttttcctgtttaagagctggttttggccaaggccacacatgggtgctcaccngcgtgtgtcttttttntgctntcttcntattcctcctgcgagctgcccagaacaggaagattatatcacctgataagccttaggcacaaggctcagacagctcccagaatatcctaagccccaggnaagaagnacagaaacttccagagtacagctgactgctttctgcatggtaagcactgggcagcctggtgnacaaggcagaggtcaaatnnggcnggtgctgcttccttccatttntttagagtgttacgctnagaattcctctcctggagtgggatgcatttcagtgtggttttgcttcantctttttttgttgctataacattagcttttttattttttagg

SEQ ID NO: 624351 - DNA, 877 bp, Homo sapiens
ggagaactagttcgagtctttttgtatctttgtttgagaaggcgggtgtttatttctcgcatcaaccatttgtgccacgtgcggcttaaaagcctatgccaaagacagtttaaaaccagtcaggggttggtcctacccattcaggggcctgagcggggggagcggcaaacacagtctctaccgggagtcagtgcggaaacgcatcccaggctctacagtaagggaactggctagagactagggccatgaggggtcagccggaacgagcctctacaggatacgcagtgctggaaccgtccagaggctggagtagacagggaaacgtacacggacggcgggaggcagtccagtttcggcccgtgagaattcctcatcctggtggcacggcccgttctaacagcagcagccggcgctctcggttccaagctcttctccaaggatctctggagaagcgtacacgatacaggaggactagacctcccagggggtggtcgcacgggccaaagacgggtggccacagcgatgcggcagaaagttgtcccggaaaccaggaagtccaccacaatcaaaccctagggagggagctccctggtggttcgcccggggcagggaaggtccaccatagccgcagaaggacgaattccggtggtttaccccagggcgcacagggtacggtacgcgtgacgatgaagatcgcctccgtgaaaaagctcgtggggtgtcaagcccggggggtcacaggtcccaccaagaagccgagggtccccagaaaaggtagcctggacccgggtccggaaacggtcccgggatagagtgggccgcatgggggggcccattgggaggacaatcccgcagccccgggccatcccggggacag

SEQ ID NO: 624352 - DNA, 290 bp, Homo sapiens
  misc_feature (22)..(22): n is a, c, g, or t
  misc_feature (52)..(52): n is a, c, g, or t
aaagaaccaaccagtgacgaanttgtacggggggcactgggtggccaccctnggggccactttttaaatgccgaccctggctttgtgcactcaaatggccccctcagccctcatgacatgtatgattacctgcatttgaaccgcctggggtacacacctgtttgccggggtttgcactccctgtttttgggtttgttggcccaaaaccagggccaaggtgttcccctgttggagcccgccccctaagcatcctgttgcctttccccaacattaaactttccttcctccga

SEQ ID NO: 624353 - DNA, 925 bp, Homo sapiens
cgtgacgcgtgggctgccctgcccacagccccaccagtcactggtgaccagcctggatgtacaccaccctgaccagtgccctgtcagggcccagaccagctggtggaggtgactcgcagtgctgtcagctggtgcacgcctatgtccctgtgacccatgatgtgttgttgcacctgtggtgactgtggcagggtgccccatgtggctagagctccaatgtgccatgctgaagtctgcagtggaaacactgcattgcttgccctgtgtgccctctggcctccatgatacgccacaccatcatgcctgactgaccggaacccatgactccccatcatcgccattactactcatttactctattttgaggtggttgggattacttccacacaatgacacgtggcttgcctgtatatggtccctcttcctgtgacggacttggctggcaccagcacaccttcggcttttgcatctcggtagacggagacaacggcaagcacatgacccactggaccacaaggacagtgcgggtgtgcactggggccttgcatgtggctgcttgtgagtgtccagtgcctggtcttgtggctgccgaagagccccctgacactcaagggacacagttcccattcgaccaacaggcatgcactggagctggtcctgggactcctggggttgtcatgtccagcagaacttggagatgacgtctacctcgacgcatctcctgaggacctgccttgtcaaactctgaggtgtctcctcgtactgtgccgacggtgcggctaccacggcgacggcgcctggcctggtactgaaccacattctctccttctaattctaccactgtcctcggacactaccactcttgcacgccttacatgttgattacttacctgcaaggctgtaacaaatgcacttcactgccctg

SEQ ID NO: 624354 - DNA, 353 bp, Homo sapiens
  misc_feature (46)..(47): n is a, c, g, or t
  misc_feature (154)..(154): n is a, c, g, or t
  misc_feature (179)..(179): n is a, c, g, or t
  misc_feature (185)..(185): n is a, c, g, or t
  misc_feature (188)..(188): n is a, c, g, or t
  misc_feature (190)..(191): n is a, c, g, or t
  misc_feature (193)..(193): n is a, c, g, or t
  misc_feature (198)..(198): n is a, c, g, or t
cttctctctccagaaacagctgcttctccccccatcccagggtccnnccccaacccccagaggtggcccttgtttacagtgaggactcggccactgtgtctctgtttcctgaaatataaactgtagcgaccccagactgtagagatttttatgngtttggatacatctgctgtgtggcncacccnccncnncnccacncccctaattttgtacatactgtatttttactattgaactgtattctagtggctgttcatgctccaagactttagttaccgagacatgaatactatccatgtaataagcacttgcctggataaaatataaacctgaaataacctgcactgaacctg

SEQ ID NO: 624355 - DNA, 409 bp, Homo sapiens
  misc_feature (223)..(223): n is a, c, g, or t
  misc_feature (278)..(278): n is a, c, g, or t
  misc_feature (300)..(300): n is a, c, g, or t
  misc_feature (345)..(345): n is a, c, g, or t
  misc_feature (360)..(360): n is a, c, g, or t
  misc_feature (378)..(378): n is a, c, g, or t
  misc_feature (399)..(399): n is a, c, g, or t
ttctttttaaaagtttttatttttggcaataaagagcacaacataatctccttcatgcgtcatcgtgccactaactgagccagttttgcctccctcccaaagggttgggcccatttcttgtacaaactagctgacctctgggtggtcatttcctgggtcacagagttgggctggctgtgcacctccctggctctagggcaccccctgggaggggccccttatnattctgccacacatgtgaacagtggttatttacaaggtctgttcccacaaatcangaacccctaaagtattaaaaancagaaacacgcaacaaaaggtttgatgtgaattaggaaagatagnccttctgcacggtantcaaataaattacccagncacttagaaaatccaattgcnttaaattgca

SEQ ID NO: 624356 - DNA, 381 bp, Homo sapiens
ctagaggatcccctactaatggctgtccaggaagagcttcccactccatcccccaattggaaaaccgtacattccagcctgtttggcctgaaattcttaagaatctggttaagaattaactcacttatgtgtcaaggtcaaaacctcctagggggttgtcctggggagtcaggttcacgggtacagaagatgaatctcagatgtcactcaaactgagccgtcattctctgtggcagggctggcctgggtttctcttactcaatccctggagtgtaagcatttggattgtgtcacagattacctttttaccttttctttctttttttttctttttttcaatatccgggcccacaagcatttaagtagggtaccgactcgaat

SEQ ID NO: 624357 - DNA, 712 bp, Homo sapiens
  misc_feature (95)..(95): n is a, c, g, or t
gtcacgacgagcactcactttcctgtgtctactgagtctcaagaacccaggtggaggctctacagttctctatcctgcagagacactatctgcantgatgcatcatcgatgactattcgggctcttgcagcctgcaaggctgttactctagatcatcttcatgagactcagcgatcagctgaatatgctctcgatgctcaagcatggatattccacctagaacgagatgttcaagactccctagaactcttccagacatgtgcagttctagttctgagagagctgcttacctcaagtatgtggacagatcctgatttcttgtgggatatcatacagctgccattgatgatatcatgaagcagctcatctcagccacatagatggcgagatcagcctcacctagagcatgtacatatacctgaagcagttcaacacggcacatgaccagaggcacaatgccctgaatctgaataggctcgatctcgacttatataatgctgctgaagatccgctagctggatggagactatggcatggtcactgcagtccacaagatatctgtggagttctcaccagccagaacgcattctgacatcttgacgacgcactgactcatgaccctaccaatacaatggattccatgctgtgaggctctggccttctatatgaactgccactgcactagagggtgactgaacttgaagcaaggtct

SEQ ID NO: 624358 - DNA, 101 bp, Homo sapiens
atgagctcggtcccgggtggggagttgagggaactgggcaggcacagtcacatctggctgggatcgtgtagcgcttcacgtggcatgtcacggacttgccg

SEQ ID NO: 624359 - DNA, 342 bp, Homo sapiens
cgtgaatactcctctcctctttatattcactcattgtgcctgtttcttgctgtcctcacatttactgtaggagcctctcgctaggaagtaggccccttgctttgagtgcagctctgggtttatagtgtgaggtcagcccccgctgtccctgctggtcagtgtgtggggctggagttggggaggcatgtctggagaatcgaggtctgaccacactcctctacctaccgacctggtgattgccagctctcccctccaggtcttgtggagtgaaattttttcactccaagtttgatgatgattttctgaatatgttcttatgctggaaaagagatgctctgatgt

SEQ ID NO: 624360 - DNA, 247 bp, Homo sapiens
ccccccttttttttttggttaataggaaggctttggttaaaggtttttgttccctttttggggcccccccttggttttgcgggcccccccctccgcggccctacttttccctcttttgacttttggcccccttttggttttggggggttttttgttcccccggttagtttttttttcttttgggtggggttttttttggaggtttccccaagggtttgtttaaattaaaccccggggtttttttcca

SEQ ID NO: 624361 - DNA, 488 bp, Homo sapiens
atctactgtagtacttcgtgtagatcagcactcgatccaacatcaacatgaatacctcataccataccgatgaatccccagcaccgcatcacggtgcgggccgtcagatttcaaaagccagattacccgccagtgcctgtacggatgccaggtcttggaaggcattggcgagcagggttacggtgttcagactgggtagtacggtgaagatctggtcggacggtgaatcaccagcttggcgggactcggcttgagatgagattgaaccagttagcaagttgtcgctgatcatcattaaactccatatggaataggctcctagtgacttttcaggcttgcagtcccggtcactgaattggcagcgaatcgagaaggttagttgtgcgagttccgacggacaacctgaacggcttgtcggaaagtactgaggcgcttgcgcagacgacatcgcaggcaagccagctcccacatgggattgatgtacggtc

SEQ ID NO: 624362 - DNA, 425 bp, Homo sapiens
  misc_feature (42)..(42): n is a, c, g, or t
aggagactgggcaacaaagcaaagactctgtctcaaaaaaantaaaaataaaaaaaaatctttagttccaatggaattttaagcactgttccccctctaacctatgtcttaaagaattaaaagaatttggctgggtgcggtagctcatgcctgtaatcccaacactttgggaggctgaggcaggtggatcatgaggtcaggagatcgagaccatcctggctaacacggtgaaacctcgtctccactaaaaataccaaaaaaaatagctgggcatggtgcatgcgcctgtagtcccctgtagtcccagctactcgggaggctaaggcaggagaatcgtttgaaccagggaggcagaggttgcagtgagccgagatcatgtcactgcattccagcctgggcaacagaggaagactctgtctcaaaaa

SEQ ID NO: 624363 - DNA, 881 bp, Homo sapiens
gcggcgggtaaggggagaaggctgcaggagaccgagggtggagccgggccggtggggccggcgccgactgcatgcagtgaaatcatcgccagcgtggaccacatcaagtttgacttggaagatcgcggtggagcagcagctgggggcgcagcgatgcccttccccggcatggacaagtcgggcgcgtgctgtctgtgaattcttttctgaaagctgcctgcaggcaaaagggggcatgtgtccgtatacgccacatcagtggtgagaagacagttgtgtgcaaacacatggcatgaggtggcctatgcaaagacaggggaccagtgtgagttccatgcattgagtatgacattgaccaagaattgccccgagtgctacttcatactccaagtacggggacgtgcagcacacaaggaactgtcccttactggcacatcgagaccgagtccaagatcagggaacatgaagcatagagtattgacgaggagaggatatctgggaaagcaacgtgatccgacattttgcagggggaaccgggaagaaagaagagagatgataatacatgagatgaaataaagtcagattgagagaatatcattgacaaggaatgaggaaaatacggatggtaaagattacaatagggtaaggacattcggagaattgtgggaaaaatgggaatcaatattgggggtaaagcaaaagagcagaaagaaaaggagacagaaaaagtgtgccgggaaagagaaaagagaaagaagggagattcaaaagtgaaaaatgagacgaggggataaaagaaaatagcggagaggaatttataagagaagagggagaaagaaagataaagttagtaaagacgaaggtaaaaaaggagggattga

SEQ ID NO: 624364 - DNA, 294 bp, Homo sapiens
agctataaggctgatgtgagagacgatgggcttctaggagccatctctctggagaaacccagtgatgaggttcagcctgtgagggctgggatgggtttcgtgggcccaagggcagacctatatctgatgggactgtgtggaccaaggagcttccatctagtgacaagtgacccccagctatcgcctcttgccttcccctgtggccactttccaggctggactctgtcttgttcactgcagtatcccaactgcaggtccagtgcaggcaataaatatgtgatggatcaaaaaaaa

SEQ ID NO: 624365 - DNA, 105 bp, Homo sapiens
ggatttgctggtgcagtacaactaggcttaatagggacatgagggcttccaatgtgctgcccccctcttaatactcaccaataaattctacttcctgtccaccca

SEQ ID NO: 624366 - DNA, 170 bp, Homo sapiens
  misc_feature (23)..(23): n is a, c, g, or t
  misc_feature (75)..(75): n is a, c, g, or t
  misc_feature (160)..(160): n is a, c, g, or t
ttggactcagatcccttcggganggatggtagcctctggtccttcaactacttcttctacaacaagcggctcaancgaatcgtcttctttagctgccagttccatcagtggctccacctacacaccctcagaggcaggcaacgagctggacatggagctnggggaggaag

SEQ ID NO: 624367 - DNA, 141 bp, Homo sapiens
cgctcgcctcgcgctcggtccgtagcctctcctcctcttcctttttaccctctactgccgccttactacgggtatctgtctactgcgcggctccctctgggactcctctcgacgtcgccctgacggcctgcccgcttggac

SEQ ID NO: 624368 - DNA, 105 bp, Homo sapiens
tttgggcagggatgcggtggcgtacgtgtgcctccagccggtcagctccaccaggatgctgatgtaccactacgaagattggttgatagtactaggtagtatgga

SEQ ID NO: 624369 - DNA, 983 bp, Homo sapiens
ggcatattatactagccatccagcagtctcactgactacgaataatagtatcgcgctcacagctcatatgctccctactatgcctacaaggattatatactatcgcgtgtatcgattatagctagctctcataacccgtcaacagaccactccctcttagccacatattgtgcgtattgccatactagtctttgccgcctggatcctacggtgggcctagccagtacttagatctcatagtctctgacagctttatggccatagacgtatcgatagcattaacacataccacttgctccaatggctattgccctaaggtcgtctcgcaaggaatttacattacgtaccatcttgacatggaagtgctaaaagagaacacattaattggaactctaacacaatctaggccaggagtccctaaatcatgatggatcattccccctacgtatgtgtcattccaaaagtcaaccaatgaatgctatttagcgtgtaccggccaattcttagatctccttcgaaagccactaatgaatgcgcccattctctaatactaactatgcatgatatccctagcgcaccgtacactagaatcgattggcgaagggccaattagggccaagttattgcatgtggaaagccagcgtagtccacagatataaaaaaattcgtaacgtcctgcttaatacctatgttggccttaccttcatctccctaaacttatgaccatgtctcctgcctgcaagccaactaaactcatgagtgcactaatgtctgagtcgaaaagcccagtttattcccccaactttggctaattaatcaccccggatgaaggcagccaggccacgaacgctgtaaacgaagcgtaaattaacttctaattatacatgcatagtagggtccctttgccgtaacttacggaaaattaagtacaaagccccagggtcctaaaggtccgtgatccctgagtgccggacaataatctg

SEQ ID NO: 624370 - DNA, 635 bp, Homo sapiens
gaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaacccttgaaaacatatcaagtgaagaatgccagacatgaaaggccacatattatatgatttcatttatatgaaatgtccagaacaggcgaatatatatagagagaaggcagattagtggttgcttagcctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtgccccgtagattttatctcaaaatgttataaaaaattaaattacaaaagaaaaaaaaaaa

SEQ ID NO: 624371 - DNA, 444 bp, Homo sapiens
tcgagccggtaccccaacttatgccggggaacggaagtaacagcagtgtgcagcagctctgactctaggcggtgggaataagtgccgttgtaaccacagtaccagcccaaacggggcttactctgtctgtaacaatgtagagttaccttgcaggtataacagagccaaaaactcttaagtcacaaagcccaggcatgcaccatagaaaaagatttgatctctaacaaacatccagaaccaactattcgtctccttggaacgaagaagactgggacatgactggaacccgaacattcgaactctcagaagggaagggtctcttggcccagaagataggggctaaaatccacctcaacataccgtaccataaatggccaaatttgaaggccttcaaacagatcctgcccagccaacatttctaagtcctttccttcgccctctgct

SEQ ID NO: 624372 - DNA, 563 bp, Homo sapiens
gcgccatgcagggttatgagtgtcaagatcttcacaaactttctgataattgatcctccaaattctgtcccagtcattgacatttagtgtgtagctggaatccccagtcctgtagcccactgcaaagttataccttgtcagcttagatttggcactgtcaaaggtcatctggtgtccagcaagccagccctcataaccaaagacaggtgaaccatggattgcaggtccagcaaaatcaaagtcaagatcacaaccaaggttaatacactccctcttgtcagaagacttgatttgaccactttactttcctgtgttgggtgagcaggtagtatcacatgtcagttccaaaccttgacaaatctggtctacaattgcgatttctgtacccagagtgtaatcagtgtaccactttactgtgaaagtcagaccatactcacaccacttgtattgggtctccaaggtcccagtaactttaccagtgtcggtattagatgaaccggacgttgaaaattccacgccactcgagaactttgttttcacatccagtttcgcaaaccaaaaca

SEQ ID NO: 624373 - DNA, 908 bp, Homo sapiens
  misc_feature (680)..(680): n is a, c, g, or t
  misc_feature (830)..(830): n is a, c, g, or t
  misc_feature (854)..(854): n is a, c, g, or t
gttcatgatagagtatctctatccctgtggatatgaagacactggcatttcatctatttttccctttcctttttaaaggattaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaanaaacaaaatttattatatatatatatatatatatataaaggactgtgggttgtatacaaactattgcaaacacttgtgcaaatctgtcttgatataaaggaaaagctctggataacattattactacttgaatgcctctgtgactgattntttttttcatttaaatataaactntttgtggtatgctcatggtttttttcctttcccattccttgttacttttgtctt

SEQ ID NO: 624374 - DNA, 474 bp, Homo sapiens
ttcgacggtgtctgttactggtccaaaaatatacgaactgataataacatgtccagaactcttacgtaagttcaacattcctgggacatcaatacttgtgattttctaaacaaactggaatttaaaaaaaaaagtttcttcggcatagataatttgagaagtactgacctagacatttaggtccagggttaatatggacatattttctctatacttaggttagcttcactaaccaatgtatttcatcatcttcacttcatttatctctttcaacgtttccttaaatgggtctgctcatttcagtgccttatctaaacttatttttaatattaaggtttgaaaaaccttctggtatctgtattcttgataaaaatttttattatgggtttaatatctgaatgacaacttggggggatttaaaatctaggttctcttcaaaccttaaaaaatgctcccagaactttgggaggccaa

SEQ ID NO: 624375 - DNA, 313 bp, Homo sapiens
  misc_feature (38)..(39): n is a, c, g, or t
  misc_feature (66)..(66): n is a, c, g, or t
  misc_feature (155)..(155): n is a, c, g, or t
  misc_feature (192)..(192): n is a, c, g, or t
  misc_feature (260)..(262): n is a, c, g, or t
  misc_feature (268)..(268): n is a, c, g, or t
  misc_feature (298)..(298): n is a, c, g, or t
gacctggtggagatcaagggtggagaccgagtgccagnngacctgcggatcatctcagcccacgcncaaggtggacaactcctccctgactggcgaatccgagcccctgactcgctctcccgactgcacgcacgacaaccccttggagactcggnacatcaccttcttttccaccaactgtgtggaaggcangctcggggcgtggtggtggcccggcgaccgcactgtcatgggcgtatcgccaccctggcatccaggtnnngaggtnggcagacgccatcgccatcgagttttagcntttcatccagctatt

SEQ ID NO: 624376 - DNA, 139 bp, Homo sapiens
gtccacgaccttacctgctttttagtcttaccagcgaaattgagtcccgtgacgaggggcgcctaaataccaagacgcagaagagcttatcgcagtttaatttattaatgaacaagcagtcacagagcaaggcctacct

SEQ ID NO: 624377 - DNA, 307 bp, Homo sapiens
  misc_feature (20)..(20): n is a, c, g, or t
  misc_feature (90)..(90): n is a, c, g, or t
  misc_feature (117)..(117): n is a, c, g, or t
  misc_feature (126)..(126): n is a, c, g, or t
  misc_feature (246)..(246): n is a, c, g, or t
  misc_feature (250)..(250): n is a, c, g, or t
  misc_feature (303)..(303): n is a, c, g, or t
caccagaatataaagcagcntttaaagcattaaaagtaagacaacgcttaactattcaaatgaatttcattgctttcttctgttcctggntatatttatttgtcctggggttatggnaaaaagcanttatagttctattacttggtattctatctctatttgttggtgcactaattggcgttaacattctgggaattgccgtagcagcctatgttgctgttaacacgaacaaatggttctatgagnaagnggtaaaagggttaaaatacctggagcctttgaataacaggtggcttagccagnacta

SEQ ID NO: 624378 - DNA, 369 bp, Homo sapiens
  misc_feature (77)..(77): n is a, c, g, or t
aaggaaatgaggtcgagggcatggagtggctcagcatcccaggatgctccaggagggggtaaaaagaatgttttcantatggacgaaaaagtccaggaggagcggtggcatcgcgagaagggatgagagggcgagttgatctaatattttgtatttaaattccaagaatttaaggatgaattcgtaaaaaatatgcaggaacttaagcaaattgaatgaaacaattattaactccagggaaaacaaaaagttgtataaggaaaaacctcaatcattggctgttacatgacctggcataaatggtaggtagaagtaaagactatacataatataaagacagtgttatcaatgtgacaagtcaccaacaat

SEQ ID NO: 624379 - DNA, 748 bp, Homo sapiens
  misc_feature (47)..(47): n is a, c, g, or t
  misc_feature (62)..(62): n is a, c, g, or t
  misc_feature (65)..(65): n is a, c, g, or t
  misc_feature (77)..(77): n is a, c, g, or t
  misc_feature (86)..(86): n is a, c, g, or t
  misc_feature (133)..(133): n is a, c, g, or t
  misc_feature (160)..(160): n is a, c, g, or t
  misc_feature (163)..(163): n is a, c, g, or t
  misc_feature (166)..(166): n is a, c, g, or t
  misc_feature (172)..(172): n is a, c, g, or t
  misc_feature (192)..(192): n is a, c, g, or t
  misc_feature (194)..(194): n is a, c, g, or t
  misc_feature (220)..(220): n is a, c, g, or t
  misc_feature (244)..(244): n is a, c, g, or t
  misc_feature (292)..(292): n is a, c, g, or t
  misc_feature (571)..(571): n is a, c, g, or t
  misc_feature (611)..(611): n is a, c, g, or t
  misc_feature (639)..(639): n is a, c, g, or t
  misc_feature (666)..(666): n is a, c, g, or t
  misc_feature (681)..(681): n is a, c, g, or t
  misc_feature (733)..(733): n is a, c, g, or t
acttgttttctttgtggcggctgggccctgcctccactgtgcttggntgggttcgcaaatangtngtgacctgtggnttccctgtnacttctctggctctcctctcctgctgggctttgtttcctatttgggntcttctgccgctgccgtggctgctgcngcngcnggggcngccttggcccccttggtttngnggttttgcgaggttttggcctccccngccgtgggggccggggcttctgcntccgggttttcctcccttcgtgggtcccgagtttggggcctggttgtngtggttcccaaaatcattgtggcttccaccacctccaaaattgcttccatcattaccaaatccattatagccatccccactgccaccatatccaccaccaccacggctgccaccaaagccaccacgaccactgaagtttcctccacgaccgaagttgttattcccaccgaaaccacctccacgaccaccaccaaagtttccagaaccacttcgacctctttggctggatgaagcactagccatctcttgctttgacagggcttttctaacttcacagtngtggccattcacagtatggtatttctgaatgacaatcttntccccggggtcatggtcgtcaaaggttncaaaggcaaagcccctttttcttgccncttcctcggtcagtnatgatttccatcacttccatttttccatactgttccaaataatctcttaggnggtgttcttcagtgt

SEQ ID NO: 624380 - DNA, 232 bp, Homo sapiens
ttcccccccttttttaatgcctccccaaaggggggaggggtgttttttaaacttccaatttgttaagggcccaaaaaaaaacgggcctttttttcaaggcaaaatccttcccagattgggtgcccaagtgaaaaagcccccatataactgtttttgggttgtttcccaacttaaaaaagctaacttgtaaaaagggtttatggttaatttataaatgggaccttttccccca

SEQ ID NO: 624381 - DNA, 413 bp, Homo sapiens
  misc_feature (5)..(5): n is a, c, g, or t
  misc_feature (13)..(13): n is a, c, g, or t
  misc_feature (49)..(49): n is a, c, g, or t
  misc_feature (70)..(70): n is a, c, g, or t
  misc_feature (165)..(165): n is a, c, g, or t
  misc_feature (188)..(188): n is a, c, g, or t
  misc_feature (196)..(196): n is a, c, g, or t
  misc_feature (279)..(279): n is a, c, g, or t
  misc_feature (320)..(320): n is a, c, g, or t
  misc_feature (382)..(382): n is a, c, g, or t
  misc_feature (385)..(385): n is a, c, g, or t
  misc_feature (393)..(393): n is a, c, g, or t
  misc_feature (409)..(409): n is a, c, g, or t
tcggnagaatgtnaggctttgaatgatgatgccttctgtcctgcatagnagggggaccccagggcagagntttaaaatagctcctacagtggtcccctccccttattgacaattttgctttcccaaaagttacccagcttgagttacccagccatcaactgtggnccaaaaacataaaatggaaaatnccagaaanaattcatattttaaattgcacctcttagccacttagtagctgactcagttatcaaatccactgtggcagcattgcagtgcatntgttcaaggaacccttattttacttagtaatggcccctggntgcaagagtggcagtgctggcaattcagatatgccaaagagaagtcataaagtgcttccttnaantgaaaagntgaaagttctcaatgnggga

SEQ ID NO: 624382 - DNA, 104 bp, Homo sapiens
gcagtgctgactctaccctttgacgtggtaaagacccaacgccaggtcgctctgggagcgatggaggctgtgagagtgaaccccctgcatgtggactccacctg

SEQ ID NO: 624383 - DNA, 539 bp, Homo sapiens
tgtgaggagctgacatgggacgctggagtcggactcatacgcagtgtcaggttggccaggggacgcaacccccttcaagacaaggcacacactatttggacaggagagatgcggggtgggacgtcacatgtcaatggacatgctcagggcaggccgtgcgttacatgcaccaggaggatcattcaggcaacttcagctatgaggctgggccatctgtgagggctagaaggatcaggctgttctcaaaggcttgtgattcacctggaagatgctcacgcctgtagagtctttccacaactctctggcaggcgagttagaatgtccagtacttccccagtcacttaggctgcccccatggtcccactagccgctggacaagcagtgtgatcttataggctgaagtcaagggaccactgatctcctacagctcgagatgaccttgccaatcctaggacctcttccacaaatggtacgcacctagacgggtggacaccgggaactatttcttgtactgagtcaggtgggcatcctctacctcc

SEQ ID NO: 624384 - DNA, 1676 bp, Homo sapiens
  misc_feature (739)..(739): n is a, c, g, or t
  misc_feature (1676)..(1676): n is a, c, g, or t
ggccgtgagaacgtcggtgtcgatgatggctacccctaacaagccaaattgggagaggaaaagactgcatcatcatacatggatcggatcatcgtgacctgctgctagattcgtggcaaagatacgcaactcacctaagccgggcccattcatgattctagtcacctgcggtgggcaatctgctatagacgcagctcagtaggaagacaattgttgaggatacgcgcacggactcgtcttggatgcatagtgcgcaacaagtggtcgttccatttcccttgctcataggcgctgcggtcgtagaaggagtgacataggctgatacacgacgttggatgcgatagaacacctgcttggcttaatacgaaaccagtttgaataatgcgttccctatggctagcgcggatactatctctgtacgtacccccacggcaatttgaattaactcattcgtttgcatctaatactagtgttggaatgacgctctccagggaaactacctaggaaaggaacttatctacttcgaaagatatacccattcgtagtatgaacgaaggggcaacaaatggtactaccgcggcgtggaagcctaggtagccttcgctccccattggaactttcgaatagacgtggacgctgccgtgatgagagtagacccattgtagaagggaggctcgcgtcaattcgtctgcacccgaaaagtggggttacgacgcactccaggaagaagggacactangcctcgtttacgtggccttctaacaaacgaactcagggggtggttaaagacacccatacacgtaactgccgtgtacgaggtcggtaaaagaaccggaaaatgagggccattcctcacacttggatggacacggctcctgaccacgacccagggagaaagcaagatgacttgaagcgaagaaactaaggtagatgggggccggatccaggtgggaatatagcttgtaaaagtgcacctatcctctggagctcaagagggaacccaacaggccagagggaggaattgtcatttctatttggaacccgctggtactcgcggttctgtgccaatctgcgtgaacccatatgtatgtaggcttgcaggaggaccccaaacgttggagattaccacaaataaggatctcttgccaacttcaaaaaggctgtagtgagttagcccctgttcgggactctgggtggcaaggcgtattgtttgccaaacttgaccgccgtggaaacatttccttttgccatagtgcgttgtggcagcggtctcatggggcattctgggaatgcgttacacaccacaacacagaatgcgtcaaggcgacaccgacttggtgaccatcagaaaccccctttaggttaggcgtgagacctaatccccatgaagacattgggcataagcgcgagaaaccggcaggggtccacacccgaggggaaccaggactccccagcgtaggcgtccgggagtggtgaaccccaagggctgggggtgcaaggaagcccctctgcaattgcgaggagccatgagcatatgggcaggcacacgaaaaaagcatgtggtgcgtcagcgacgagagagaagagactctggtggcatggaaaaggagggccctggcaggatatgagaggagtaatacccctctggacagtttgcccgcaccacatagagtagn

SEQ ID NO: 624385 - DNA, 968 bp, Homo sapiens
  misc_feature (318)..(318): n is a, c, g, or t
taaatattatactagcagtttagccatctcacttctaggaatactagatatatcgctcacaagctcgatatcctggcctactatgccttagaaggaataatactatcgctgtgcattgatatgctagtctcataagacctcagacagcccactgccctcttagccaatattgtgcgctattgccatactagttctttgccgcactgcgaaggcacgctggtgggccttagcccatacatagctctctaggggcatctcaagacatcagtagtggccttaagacatacagtgacattaactctagagaccctacgtccnaatgctaaaacgtaaatcgtcccaacaatttatattgacatactcacttgacatgagcgtttccaagaaaacacattaatttagaagtcaacacaattcaccgcacaaggtcgtaattgtattatgcgagtccatcccctctactaatttttgtaggcgcgagaagtcagagcaagcaaagcctatttgagcatgttgccccaaaggactattgtccttccgaaggccccctaattaatccggcttctcttaatactaaaacataggtgtactcctaccccatcacaaatacatggcggaggccaagcgccatatatccacgtgaagggaggtatcacgaaaaaaaatctagctctctaatgctaaatctccgcgtacaaatctcctgtaagttataacattccacagccacagaactaatcataattaatatcttcttggaaaccagggttatccgcgcacttgggggtatcatcacccgaatgaggcgagcagccagaacgcgtgaacgcagggcaaataatgtactaaattacacctagtaggtccctttcccctagtcatcggagtattttacatcacaaaccctagggtcagtaaaaattctatacaggcttcatgccagaactatcaactctggcaaaagtata

SEQ ID NO: 624386 - DNA, 361 bp, Homo sapiens
attatagatacttgtactgcccaccacctagtgtacaataaaatcaagtaatacaatcttaactgtatgtggccttttattgatcataagagttggtactagttataaggcccaaagtaacagtataaatagatctatattagttacaactccagcttttacaataataaaggatatgtactgcattgggtttataaacttttggtttgtgaacttcatatttgatcttttctcttccaatcaaatgtactaggcttgtatgaattaccacccccaatggtttttcactactattttatttacttcatttacctttaataacttaatctcttcatgttcagtttatacttacactcgaaaa

SEQ ID NO: 624387 - DNA, 844 bp, Homo sapiens
ttaattctaatccctccttgtgcgcttggtgtggtaaaaaaaaaaaacaaaaccggggttgtttcacacgcttgcgctcggtagcgggacactgtttctcctccgctcttgagaattttgtccccccccccatctgtgaaacaaatggggcccccaccagaatacactaatcagatgttctgggttacccaccgcgagaatatttacaaaacacatcacactgtgtggttgacacccggggcgcacacaatagcactttttgtgcccgccccctcaaaaatttctccacccttcataagcgatccgccctcccatccacgctcatattagatatactttatatagcccccgcgtaactcttttctccctcgtgtggaggccccacctcttgttgttctatggggggtggtcaccaccagacccctcttttttgagaccgacccgttaacacccctcactgctcgtccgcccccccgccttgtttgttcccacacctctcttccccccaccttgattaaacaataggtggggtggcgcagcacccccccggggcaccagcaccccccaccatagaccggcgcccaccgtggagcgcggttgtagcaaaaaggacttcccaccagagaggaggtattttgtgcacatcttcttgtcaacaaaagacattcgtgtcttgtcggcgcttttgcggagaataacaattttttgtttggtgtttccccttgtttgattttttccaaaaaaagggggggaagggggaaaaaacacacctttttgtggttcccaaccccaacaaattttttgcacaaaatttttttttcaaaaaaaaattttcccagaccca

SEQ ID NO: 624388 - DNA, 990 bp, Homo sapiens
taaacaaacccgtgtcctctgggtgggtgtgggtttaatcctaatttgaaatgatatcatttacggggggaaggccgcttggtagaagtaggccttatttctcttgtcctttcgtacagggaggacatttgaagtacaatagaaaccgacctggattactccggtctagaactcagatcacgtaggacttaaatcgtgtgaacaaacgaaaccttataatagccggcgtgcaccatcgggaaatgtccgtgatccaacatcgaggtcgataaaccctatgtgtggatatggactctaaaataggattgccctgtaatcccttagaggtataacgtgtgatatcacctggagctcaaagttatatgggaactccaattgcagttattagactagtcgcgacatatggaacgtggcatgaagctctttaccatgtgttacgtgccatcagaagagatagaggatacatgcctcacagaaggacacacaccacaaacagcgacaaatatataaacagtgacagcgaattgcgcgcaacgatacaatagaaccccaagagaggataacgaacagaagaaacgacgaagagaaaatatgagcaacaataaacaagcccacacacaacggagaaccaacaaaacgacacacatcagaaccgagaaccaaaagacccaccgaagataaacaatccacaagaggacacaaagagacagtcaaaaacacaacaacacctgggcgtcaacaaaacagtgtgaaaggaggcacccacaggcggcaaccacccacgaccggggggggagaacaacacaaaagaaacaaaccggaggatacccccataaacgaaaagaggacacacaaaggcagacaatcagtacgacctgaccactagagaaacaccagcgaaaagaggaaataccccatgcgagacggagataaaacgaacagacgagatcaccagggagaaagagagggggggccgcccaataaacatca

SEQ ID NO: 624389 - DNA, 436 bp, Homo sapiens
caggggactagcactggattaagaaaacccatatagatttcatgtgagagccacaggaaaaacaaaacacatcatgtgagtatctgtaaatggtgggcaataataagtgtgtgctgagaattaacatgtcatgtttataccagatgtcaggtgtactgcttctctctctgagttgtcaaaaagcataatacagagagaaaaggtcaaagaatcctgggggatgtaagtggtgcttaaaggttataatgattgaaaaagatggcttgaagtctacatgtatcaccacttcagatgtcatttcatgtctcaagtggaaacagaataggccttcttaagagattggtgggatacaatatgtttcggcagtagagttgaaaacacactatggttaccgtaagcctgccagaatgggtcccttatctgaagatcatgatac

SEQ ID NO: 624390 - DNA, 105 bp, Homo sapiens
cgcttcaggaggcagagatgagagaatcacttaaggccaggagttgaaggctgcagtacacccattgatccatgggctggtgaacaggccactagcactccaagg

SEQ ID NO: 624391 - DNA, 935 bp, Homo sapiens
cgcgcgccgtctgggtggtgattgggggagtatttctgggcatacccccccaatttgggttggggctctggagtggatggcagaagcgatatttttccggaatctcccgcgggagaatccccggcccggtgtcgcgattgccgcggcggccgcgccgccgcttgtgggggaggggggaccctctccccacgcccaaagggttgtagaacacggggcgcttggctggcaatccgcccccgatgttctctgggtgtaaagttattataaggagaatgagtgttgcgccacaaaggcgccctctgggtgggcggcggcacttatcccgccgaggggtagaggtgttggggcccagaaagaccgagggctttagaggggacaatctttctcttttcgacggggatgtttgcctttcctcgtccccctggcggggtttcttagtggggggagtaccttcttgttagcgcgccgccgccccgcgggttctccttggggcggcgcgcatattaatgcgcccccttatgggtttctcctctcgcgccccgcgggggggggccaccacacttgtgcaagatagagcttggtggggcgtccaggccccagccccgggccgaccgcgggggtgaccaataatttttttgggaggcgcccccgggatgtttgtccagacgcgtcttagaggcgacggccagatcgctggaaacgccgtgatttcatgggcacggcgtgtggccacgtgggcaacgcaatccctactctggagcgttagacatcggggcttttggaatagggtatcaccccaaatcatggggggaaaaaaccccaatttaattaaaaattttggggtttccattaataacaacttttttttggccaatttattatttttaggattttggaaaacaagaaagacaaaaaaatgggttttttccccccca

SEQ ID NO: 624392 - DNA, 152 bp, Homo sapiens
gcatagcctaccccttccttgtactatccctatgggctttataacaagctccatctgaatcgctcattgcatactcttcacagtacaccccctgaaagcttcacccggcgcagctcattcctcataatcgcccacggggctatacatcctca

SEQ ID NO: 624393 - DNA, 906 bp, Homo sapiens
gccgacatgtccccgctggggcaacattttccacagggcccccccgggctgtttgccccggaaatggccttgcgagtgcctttattcacggacggcccctctccccccaagtttgatattgctgggaaaagtccaagcatcgagtggtgccgcgccatgtgcaggaaaatcgcctcgtggcacaacctccctgtgctggcgtaataattcctccgccgcacttcgcgcgggaagattggtcgaacttagtgcatgacagccgctcctctgcatactgcccgccgctccccatgatccgtcgggcaggtttcttgttgatatgcacagagcatggtctccccccaataatgcaaccagtagggcctcaagcgaaaatgatttccctggcgggacacccatttattgttagttgcagtacactgtgcccacgcgatgggtccctcacgcccgagtgttgctcccgcgtatgtctgtgcagcccgaccgttgcgagtgccatggccaccacaaagagatattgggaggcccccctccctatagagaagagagtcagtttcgagcccactcgtccacagcatcgccttccttgcgagatagtggaactcctcaccatggttgtatcacctgaacctttaacaccctcttatcgagaaacaaagccgtcccgaaaattttttcctctccctcccccaaaattcttgtgaacttctttattgacccaccctttcgagatacgtcgctccaactatcctcaaaaacgccacaactacacctcttgggtaatccacccccagaagacgtaaaacgcacccattgctcacccccactattttttacagcatttccaaagtaccccaaggcaaatgggccccccaaaagggggaaaaccccgcgaaccacaaaaca

SEQ ID NO: 624394 - DNA, 896 bp, Homo sapiens
tgctgttttcttttaaaaaaaacaaaaaaaattcatttccttggggttagagctagagagaaggccccaagcttctatggttcttctaatctaatggcttaaaggtatgagtatgtcacttacccggtgcttcctgttactggtgtactcaacaacggggtagtactggtttacctaactacctcatgggatgtgtcaggcatatggagttaaatctcatataaggttctcaatctggttaaaagctcaaaatttggggcctatttggtaatgccagtgtgacactaagcatttttggttcacaccacgcttgtgataactaaattgggaaaacaaaggtgttaagtacctctgttctggatctggggcagtcagcactcttttaagatctggtgggggctccctattttaatagaagtggagggatgcacctatttcacaaggtcccaagattgtgtttcccagatattttgatgactgttgtgtaactactacagggatagcactatagtatgtgtacgtcatgagacttacagtggacttaagactattttttgacaaaaagatgccattaaatttcaggatgttagagcaaattaaatacctcagggtaattcagtgttaacttgggtgtgaacctttttttagacagagagggggtaatggattgcattaagggagtgctaaattccgtggcgttaataatatacatggattggtataagggaaaggaactctttctgaaattatgtaggcttggatgtaaccatgggtggggggatcaatctttgagtaaattatagaacttaacaataaagtttttttttaaaaagccttgtgaaacaatgttttaacaaacgaaggttggcagaaacttagagaatttgaaggaggaa

SEQ ID NO: 624395 - DNA, 641 bp, Homo sapiens
agcggattgtgacagcacaccgaggttagttcagttacctgcagttcttgtcaataagaaatgcgtagggtgtccatcaaatttgcaacaccacacctgcaatggaagcatgtaatcgcttacctgcacacagttgttccttttctaacattgtggtgatcattgacagattcaagggtggggtgttgagtacggggtttggtgatgtcctcccttcagtattttaaccttattaatatctgtctataatctatgtactatgactttacttcctacgtaaaacataaatgactcaatttggggagcctattacattttgatgtcgcctcaggtgaatttaacatataataaacttgttagtctagcaacttttagccttgttacaagacgttgctgaacaactttggcggtcgggtcagtggatcagagagagtggaaattgtacacggcactggtttggccttctaaattgagcacgcaagctacataccgcacaataatgatgccccctcctgatgtgtactcttgttgtgcagcacagaaactgtacagcaattggagctgttccagttgtttcctgtgtattaactaagaactattttgcagcaccaactgctattaaaccattgaggggtgacaca

SEQ ID NO: 624396 - DNA, 913 bp, Homo sapiens
gaccacctcgctgattcttctggaagcgagcgaggtctccaggctgagctcctcgaacccctgaggaatgttggcctgttactagtgagtgtcacacttctcgctcctctggtcgagattccacctctaacgagagagactgagcccgaacgtttagtctgctggccggtgtcatgaccaacgatcggataattactgaacaggtaattagaagatgccatcaaacatcttaggtgagtgttatatgtctccacttatacacatcaagttggtgtgcatagcccgaagattcaggaagcgtgagcactctttcgaagggagaaatcagagaagcaagactagtgcagagttacagtgtggcacgctgcgagagcatggccaatcagcaagaggcgtggtggctaggtccacatggagtgctaggccaaataaggtacacctggtgttattgcgcgtacgaccctcactgcgattgtgatcttgtggcaagcgtgaagctctgtctctgtacgaaaaaaggagaactctattctctttaacggacaattggctgtggcttatagtgctccttcttcgagaaacgctcaatgttaagactactcttggctactgatggatagcctttctcatcctctattgccatgtgaaggagccgtctccacctcccataagttctcccgcgtctggtttggccccgtgtgttccttttcctatacctccccaggcagtctgtggaacgtggttggtcagggttgaacgagagaaaatgacccacataaaatactgtcttaagtgacgaaacaagaagcctttttccgaaaacaaacccacaaagggggaggtcagagaagacaaacgcgggggactttaacaaaaaaagagttttaggggggagaggcgggatatacaaaaa

SEQ ID NO: 624397 - DNA, 808 bp, Homo sapiens
ggccagaagctgcctccgtggtttggtcaccgtgtgcgaatcgcaccgggctgtagaatgtggcagacgcagtcctggcggacaggcttattaatttaatgtaaatagtttgggtttccaatgaggcagtcttctggtatctcctgatggcagattatctgactcatgacttttctttgattgtgataagaagaaaaatcaaactcagcatgttcagtagctagaggaggggatgtacgcccgatgggcgaccgtggcctccaggagtcagctgtgttcgggaagacgccggccacgcccttgtgctcttaaatcgtgtgttgaacatcccattttgggtggtttggtggattgtaacccaaactcagtgcattttctaaagatatgttaagaatccaagtcgagaacacttgaacacacagaagggagaccccgcctagcatagatttgcagttactgggctggatgccgagtcgagcaagcccagcctgttcccctcgtggaacgatgaggtggtggtggcggcagtagtactgcgatcaaaattctgcatggtcacatggtagagatccccgctacgtcgctggtccttgggtcaccctgcattccatagccatgtgcttgtccctgtgctcccacggttcccagggccaggctgggagcccacagcacccactatgccgaggcgcctacccaacttcaggcagcctatgggacgcagggcccatctgtccctcggtcgccgtgtggcagaggggggttcggcgtcccaaactcgtgtcgtcaagaacatttggcaggatggctg

SEQ ID NO: 624398 - DNA, 192 bp, Homo sapiens
gggaaatcccggggggcttgtggcccccttaggggggggtggggggttttccccttccgggccccgttcccaaggggggggccccttttgggccccgggttggtcccctttggggggccctggcttttttttcccggtttttttttgaaatttaaaaaaaccttcccccctttttggggtttttttttccca

SEQ ID NO: 624399 - DNA, 353 bp, Homo sapiens
tctcataaatattggtgatgaatcagtgaatacaggtctaccagaataatggaacatcccattaaacactcagctaggcaacagtttggagcaaaccctgagggcaaggttgttgtttccagtatgtgatataagcataacaacagcgatatattgtactgtgttctgtattagtttccgcactctgtgaaaatttgcataacttggtgactagattatctctcacagttctgaggcagagtctgaatcagtacctgatcaagtcaaggtgtggcaggacaactcttccagaagctctagaagcaaatccatttcctgcctctctcaccttcctggttcctgccagcatttct

SEQ ID NO: 624400 - DNA, 143 bp, Homo sapiens
ttttcccggttcagctcagatacttgccaagcttggagcgcatagaggcaagggattgactgttcttggaaggaatgcccccctggggccattcacgcccaccagtttcccccggggaggggcccatcccaccaaggtctttc

SEQ ID NO: 624401 - DNA, 207 bp, Homo sapiens
catgcgacggactgatcctcttattttacaacccacagaacgtctctgaaaatggcagccccatcccttccattgatgataccaaagcctaggaatccactttgtctctctccctctctctcataatccacaccaagcccatcaacagatcaccttggctctaccttcaaagcataaccagaatctggtgatcagtccgttcgcatg

SEQ ID NO: 624402 - DNA, 101 bp, Homo sapiens
tcaagttcgttgtgttagacccgaaacctagagatctattcatgagcaggttgaaggtgaggtacattcactctgtactacagagtgaatgtggttctttg

SEQ ID NO: 624403 - DNA, 1049 bp, Homo sapiens
gggaaggtgcggtgttctagcaagtggctgttttctctgggctggctgtgggaggctcccgatggtggggacccggacgggatggctgcagtggcggacgaggctgggagctgtggccctacggcggcgccgagcgagaacggcagtcttcctgacctgcgcgctggtgagttgtcttcatcgacaacccgtgcttctggccgtgggaaggacaggtggtgcggtactgctatacattggacatgacacgtcataagatggagagaatcagtgtttactttgacatgagtccagatggaggacgtggcagaacattggtctcacgtgaaatacgcttggtgggagtacactagtcgctaagactgaagctattgagtcccagtgcgtaccggacggagaagaggactccttctctcgcgggatcccagtgggatgatacttgattacctcccagtgggaacagtgttatagagcgtgtcccataaatttggtgggtctcacatgctgttacacaagaactgtacatacctgcaggtaaggtctcccccgcgacggcgtatatgtcgtttgcatggatcttctgggaggcttcactggaggtatgaccggcagcggtgcggaatcagtgcgaaagacacaggggtaagaagcaagagacaaggtggctgtggccgatgtccaccctctcggggcgtccttctcttctctcctccttgagcagggagaacatcggggtgcaagcctggtgtggggcgcggaggaggtgcatgggctggccagagcagggcctggcacgggaaagggatgggaaccgcgagggcggagaggtgagcagggggcagccggccgggtgtgagtgcggtagggcacaaggacgcgagagccaggcgccgaaggagcggcagccgggcacccggcgagaggcgtggacggatcgaacgccagcggagaagggggcagctacccaagagagcccaagagagacgtggggaactagagcaggagtgccgggggaaccccaaagagtgtgggagaaccgagagcacaga

SEQ ID NO: 624404 - DNA, 159 bp, Homo sapiens
cccccccaaaggggggggggggcccccttttttttggggggggggggggggttttttttcccctttttccccccgggtttttcccccggggggtttttttcccccccccccccccccctttttgggggggggggtgggaaggggtccccccctttttta

SEQ ID NO: 624405 - DNA, 1185 bp, Homo sapiens
  misc_feature (7)..(7): n is a, c, g, or t
  misc_feature (26)..(26): n is a, c, g, or t
  misc_feature (272)..(272): n is a, c, g, or t
  misc_feature (561)..(561): n is a, c, g, or t
  misc_feature (816)..(816): n is a, c, g, or t
  misc_feature (821)..(821): n is a, c, g, or t
  misc_feature (1050)..(1050): n is a, c, g, or t
  misc_feature (1060)..(1060): n is a, c, g, or t
ctactanggagacgccgccatttgtngtgtggacacccccgggaacattcggcccatttatgggccggggagggcgcagggagtaccctccatgctcgccggcggcgggaggcaccgatagtgggcacttagctaatcattggtttaaatgacctagagagcagcagtcaccgcaccacctgcgagcttcgtatgcactgtcaaggcatacggagtaagtgttaccaacgcaaggcccggccaccgccgccggtgggggagacataatgctnacagatgcacgcgcacttcaaacatgttctttcaatacgtgtccgccggagccaccacccgcccgggcagggagagggatgttggtagtatttgggtaatacgcattgttttacgagaacatagttataagtgaagacggggtagaaggcgggcggaagcgcgcgcgctctcgtcgacatgagccgccaccgcacgaagcaccatcgaacacaatcacaagtacaacatcactaactaacttcttacagaggactagcgacgcacctgtggcgagtctgattatggttntgttgttattgttgttgttgtgtggtgggcggagggaagaggcaacgagtaggtgaggaagatgaaggtagtcctgggctcacagggagagcgatggtcgattacattctcccatatgagtcttgtatacatcaagtaatttattatgatttgagtggttgttattatatttaatttgatatcgtttacgacaccgtgtcacgactacgcactgattgaccagtcaatttcgatagccgaagcagtgatacgggngagcnccagacgcgcgcgcgatcgcgtcgggcggcgtttggcatgcaggcgatgacactgcgcagaacacactgaccacgagagaacacgtaacacagcccagacgctacgatctcgcccatccatcgcgtcgcagcgcaagaacaggattcacagtgattgatagagttatacaaaggtacagcccgtctcgctggctcgcgcgcgttagcgtcaagtgcgtactacagcacnatatctcttntttactaacactacatgcactcgccacgagtcgactagatgttagcagcgcgtgaatcaggtacgagccgaatcacacgagacgcatattcgcgctcaactagtgctgtataatatatatacatg

SEQ ID NO: 624406 - DNA, 172 bp, Homo sapiens
cccgactagcccgacagggcagtagcaacggtttacagggactcagcagggagcctataagcggctgggaccctcagcttggactggcagagcagaatatctgtgtgtctgtactttattcatctgtcaccgggtcaggggtctgcaaggagtgctgtcgggctagtcgggg

SEQ ID NO: 624407 - DNA, 323 bp, Homo sapiens
  misc_feature (209)..(209): n is a, c, g, or t
agaatagcttgaaccccggaggcggaggttgcagtgagctgagatcatgccactgcatttcatcttgggtgacagagcaagacccttgtctcaaaaaaaaaaggggccgggcatgggggctcacaccgtgtaatcctaaacacttgtgggaggccaaggcggttgaattggctgtgaggtcagggagttcacagaccaagcctgggccnaacatgggtggaagccctgtgcctctaatggtcagtttccggcgggatccttctaagaagtcggaccttggcaggctatgcgaagcttgggccactgggccggtcggtttacaa

SEQ ID NO: 624408 - DNA, 264 bp, Homo sapiens
aagaggctactaattcaaccctcagagaaacagtggacgctcattcatggcataatatgtcgaagatttgcgtacagcgattaaatagtactaatcattatttaatcgtcctggtttcagaattaataaatacaaaaacaatataaaaatatacaaccagttgataatgactgtactgcagatgctcggaaagttaaatctcgctctcatatgtatgcaggtatgtctggagctgtcagagatttctggggtagctgtcggctg

SEQ ID NO: 624409 - DNA, 366 bp, Homo sapiens
  misc_feature (6)..(6): n is a, c, g, or t
  misc_feature (252)..(252): n is a, c, g, or t
caaccngtcccccctttatccctgatgtcgcccactcccccactgactccgagaccacccaagattttttggaaccattccctttatattcctgcctggtgccctgtagaccattgagcttaggactccttagccaggtattaggattacaggggctcctggacgggactttgccttcttttttttttttttaaactgattcatgacttccacaagcttagtggtattcccctccttcctaaaggtgaaggnagaatgtatcaaacatcgagaatccagcacttgtaagttctggttaccgaaggtgatgttgctacagagagcaatttagtgcaattttaaaaacattttaaattgaatttaaat

SEQ ID NO: 624410 - DNA, 420 bp, Homo sapiens
tacctgggcggcagccccaagggggacgtggacccgttttactatgactatgagaccgtttgcaatgggggcctgattttcgctggactggccttcattgtgggggtcctcatcctcctcaacaaaaaattcccctgtgggggcaataaaaagggcaggcaaatcaattaaaattagccgtaacaacaacctcgggggtgcccccccctgccctggggccaactgggaaaccaagcatggccctgcctttggggcctcccctttttccctggggtttaaacctttgtccccgtccctgccagcgcttggggtgaaggaagctccaaactcaatttgacccccaggggggatcgccaactcctgcctcgggccccctcatgcttataataaaaccggggtcaaagacccctgcttccccca

SEQ ID NO: 624411 - DNA, 1444 bp, Homo sapiens
  misc_feature (816)..(816): n is a, c, g, or t
tcccggcctcaggtttatttggtacaattagcacaggaggaccccagccccatgtgcagatgtggttagcccaggggcgggggtgtggggggttcgcaccagctcctttcgtgctcctcatgtgttgtggcagagattactcatactcgtgaagcctttgtgtaggggccgtgggatacgtttggggagccgtgagcttggaacttgaacgctgtggggcttgcacgcctgtggcgccttgtggattggactcctgtgtggccttgtggccttgtggccttgtggccttttgggccgggccacagctcttgagcccccttgtggacaatacggggccacagagcacgcttatcccaaagctgtgtgggggtggcgcaatgtgtagcgacaagctcagactcagagcttgtgcgggctgtgaccacccttttgtggagactcttggggcttataacctctcctgtgggggctttttacagagggcgccttgtgaatagcctctcgggcaccgtgtgcacttcatgtggcctttgggcattgtgtttgggcctgtgaattcttttctttagggcccttttggtgggtgggtcgcttcttggggcaaacgcggccatttgttccctttcagggacactttggggggctccacccccccttttaagcgcagatttccggaactccttggggagacacgggggagtaatcccttggaatacccatttttcctgggtggccattattttcgggggaaccttagcgtattggagatcgacagagaggggggacaccttggagaccttgggggccaatggtttnttggaaattctttaaacccgaaaaaataaagcctggtagaggggctacggggtcctacaaacgatagaaatccttattttcccccgtgtattatcacgttcttccaattgtaagaaggcactgatattaaccacccaaacaaacagatgaaacacaagacagaagagaaacacaacgaataagaagaacagaacaagacacacaacgaacaccacaccacaccacacaaatacaagagcgcgcggcgcgacaataaaaatcaacctacggaggagcgaaataataaagaagaaccacaccctcttttgtttcggaacaagaagggagccccccacaaagaaggagagtaaaacaaaaaaaagagaagggggggggtgttaaaaaaaagagtgaagggaagaaaacgaatgtgacgtttttgaggaaaccacacacttctgggtggtgaggtgagtagggagcaacacgaacagaagagtgacaacgaaaaccagttaagtaaagcaacgtcgggagttgctagaatcaatctgacattattcaataataaggagggaagaagatgagtgcagagagatcgagcgtcgtgtttatcttgtattatacagtgaaagggagaaagaggagc

SEQ ID NO: 624412 - DNA, 592 bp, Homo sapiens
ttacggaaggaggcctgggtgccccctggcttctgcgaggagatgcttgcggattctcggcttagtcggaaccataggcgaggatgacgaggtgccggtggagcccgagtctgactccggggacgaggaagaggaggggcccattgtgctggtgcagacgactaaaagctttggggaagaaccgcagtgctgatttcaaccctgatttcgttttcactgacgaaggatggggacgtacgatggcagctgggccctggctgatgtcatgagccaactcaagaagaagagggcagccactacattagatgagaacgattgagaaagttcgaaagaaaaggaaaacagaggcataaacgaagccaagtctgggaacttggaaacacggagaaagaacgcaaacggacggctctgataccactaggagcagcgaacgaccttcaagagaactgctgaggaaggctcagaacgatgaacgcctcggcgcactgactactcatcaggctgatgcagaacatcctcacccaaagccagatacactcacaacgtaaaggatcggacgcacgacgaacacgaccggacaggaagcaggagg

SEQ ID NO: 624413 - DNA, 103 bp, Homo sapiens
attgtggggctactgtagccagactgaggggcagctgcattggaagcttccagtgatgtatgattgcagcggtaggagcagatgtggccccctgtgttgggca

SEQ ID NO: 624414 - DNA, 124 bp, Homo sapiens
tgtatggagcaccccatccacagacagtgagcagaaatgacagaacacctcaagcttcccagctccctcaaagctttggatgcaaagaaggcaccctgacttccacaagacaccagaattcaca

SEQ ID NO: 624415 - DNA, 123 bp, Homo sapiens
  misc_feature (24)..(24): n is a, c, g, or t
  misc_feature (26)..(26): n is a, c, g, or t
  misc_feature (37)..(37): n is a, c, g, or t
  misc_feature (77)..(77): n is a, c, g, or t
ttcttttattacactttcttggcntnacaggaaagtntctgcagtaggggacccagagtcccaggcccctggagttnttttttcgcaggggccttgtctctcactgcatttggtcagggggca

SEQ ID NO: 624416 - DNA, 263 bp, Homo sapiens
acctggggttttttgtttaagggggcctatttagagttggaagttgaccagctgttgccttacatccttttgcttttttattgaaattttgaaatcaaccgtcttgatttttctgttctgttgaattgctatgttcaggatgttttagggggggggggcagggcctcttttcgtaataagcccttgtttttttttgggggtgtggggtataaaggctcccccctttttgtaaaaaaataataataataaaatgaaagaaccca

SEQ ID NO: 624417 - DNA, 127 bp, Homo sapiens
ccaagttggaacaatccttggaaactggaagagcacaagaggacccccagggcaaggccattgggatagtctgaaacttgaatattttgtgttgtgcagagataaagacctttgccatgccccctca

SEQ ID NO: 624418 - DNA, 460 bp, Homo sapiens
  misc_feature (33)..(33): n is a, c, g, or t
  misc_feature (410)..(410): n is a, c, g, or t
ttgagatcggcgacatttaagtagcccatctgntattgacagcttagaacagagcagcacaggccaaacatcaagaaataggcagtgtacacgcagcatcattttaataacaaatgaaagcataaaacacagcacatactgtacttcttcaggttactgacaggcatcttcagtgtgcagtacgagtgagggtgagatggagtttctataagtttggtcagaccagaatcattgctggctacttgtaagtcaaggctaaatccttagagctgagaaacaagtgagttactcttaaaaggtgagtgtttgtttgtttgtttgtttgtttgtttgctttgagatggagtttcggagtttcgctcttgttgcccaggctagaatgcaatggcccaatctcagctcactgcaanctccccctcccagattcaagcgattctcctgcctcgcgctcctgagtagc

SEQ ID NO: 624419 - DNA, 168 bp, Homo sapiens
tagatgactctagaggacccgacggcgtcaacggaactttaaacacatccacattacaaatgctcctcactctctgttctaaagtgcataacgcatgtggattaataaatacatatggctaatagaaatagtgaaaatcaagttcgagatcataacctaggcaattcc

SEQ ID NO: 624420 - DNA, 214 bp, Homo sapiens
agcatcctcaccctcaaacagttccgttgaatttcaccctgacaatgactaacaatttatctactgaatatgagcaagcagtcaaatatgcatttgtctcaggtgagccgaggtatacttctggtgctatcctttgtcccgttcttctgaagatgaattgtttgtgattgtcaggctgaaattcaacgcaactgtcctagggagttgccgtgct

SEQ ID NO: 624421 - DNA, 174 bp, Homo sapiens
attcataaagaattcactgacttctttgttctagttgatccattgcattctgcacctgcaggtccatctcgcgcatttccgtgaacggtcccgcagatccataggaagctgctcaatcatttccagatagtcttctaggtacaacatcgctagcagcacccgctcgactccggc

SEQ ID NO: 624422 - DNA, 174 bp, Homo sapiens
ttcggtcagaaatgcttccttagaacacggaaatactgtacatgccaactattatgtcagctccatggaaatatggttctagttaataaaatgtcaattacgtgtaaagtattagtacactgacagaaataacatgttttctcacagaactcacataacagcctctcctcccca

SEQ ID NO: 624423 - DNA, 141 bp, Homo sapiens
ggggggcccccatgcccccccccccccccaaaggggggggggggccagtttttacccttgtttttccggggggtttggaccggttttttttaaagcttttgccagtaacggtttgcccattaaaaataaagggggccccta

SEQ ID NO: 624424 - DNA, 779 bp, Homo sapiens
aagtgccttatcgctcccatgccgtaattctgaggtctccccagccgtgtggaactagtaagtccaacttaaacctctttttgttcccagttttgcactatgctcttctatcacacagggtgacagaacaacactacatacagctaacattggctaccagtacgagtgcgggcattgctgcaaacagactactcgcaaacatgctggacacgctgcactctttggacactgggctaccacacgggcagccaggcttgcgacaccgcgctttcgcgcagcgcgctcagcaactacagacacggcaacacactgttggtgacaaacgattatggaaaatcctccttcacgagcaccttgctatcgacacgtggccttttcgaccaacacaccatgcctgaccacgcaacactaatggcaccaattacagcggtaccccagcgccccaacaggattggttccctaccacagcactgcgccaccaacttgcaggcgcacacctctggctcatcggggcccaccctgggccagtccaaaaagcgttgcaacctccctatggctctcaactgcctatctctaagggccgcaaccacgcacccgaacccttagagattagccgcccaaccttatcatctcggccccagttcaattgaacaccccttaaagcacgcaccttatcccgcttacgcgcaacacccttcatcacgaacaactgcttctcacaaccgcactcaaacgaacttggcacctctttacggcgacggctaacttcttgggggaca

SEQ ID NO: 624425 - DNA, 953 bp, Homo sapiens
gttgacgcgtgggtcgacccacgcgatcggcgctgtccgcccttcccctactgttacttccggtccctcgctgaggggtgttcgtgcggctcccaggaggcgtgaacctgggaccatgagcgtggtgcttcatcgtgggccggccagctggcctatgctctgtgcgcggtggcttcactggccgcatggcatcctgtctgtgctcacaatgataatatgccaggctccccagaaatgaacctgcccacggttgtccgctgctcagtgaagatgggtgtgaacctgacacgcagcaacaaggagacggtgaagcacagcgacgtcctgtatctaggctgtgaagccacatatcatccccttcatcctggcatgagatctggggccagacagtgcaagccagacacatcagtggtctccatgtgcactgctggtgtcaccaatcagcactgtggagaagaacgctgatggcaataccagccaagaccccaaaagatgattcagctgcatgaccaaacacagctgattggcacggtgcacagaaagtgcgctaacaagtgtacgccacggggcatcccattgaccctggatggcacggatgggacaggagtacatgagaagccacattcatggatgcccggcactcgcgtccgacatggaacattgagagtcggcaaaaaagagaacctacagtcagaatgccatcaacacaagtgtactcaacgtggcgaggagaacactgcaaaaaatccaacaaatgggcatccaggacagcgccaaaggagcacgcactagcacgccgagccacacaaaccgaggagtaggcccaccacgcgcacgatgcaacaccgacaaaccgggccaccacgcggcaaaccgagaggacagacaggccccaagcaaaacgagcggggagccgcaacacaagcagccaagcaagccaacagggacgaaat

SEQ ID NO: 624426 - DNA, 612 bp, Homo sapiens
ctcaacgcttatacttcaataaagacaaaatttgatagaattcaactatgaaactatataagcctggccaggcgcagtggctcacgcctgtaatcccagcacttcaggaggctgaggcagagggatcacctgaggtcaggcatataagaccagcctggccaacatggcgaaacgctatctctaccaaaaagtacaaaaattagctgggcatggtggcacgtgcctgtagtcccaactattcaggagactgaggcaggagaattgcttgaacgcgggagatggaggttgcagtgagccaagatggtgccactgtactccagcctgggtgacagagcgagactccatctccccgctgccaaaaaaaaagaaaaactaatatttcaggtgttccctcatttgtgtaccaggtctgtttgctctacaacaaaagggggaagccctgtatggctactgcaacctcaaggataaatgcaacaagtttcatgtgtgcaaatcctttgtgaaaggagaatgcaacttcagaactgcaaatggtcccatcagcttatcattgctgcatcctttgaagctgctaagtgaccatgactgaatattcaagtgttgtaatttcag

SEQ ID NO: 624427 - DNA, 177 bp, Homo sapiens
accattggaaagacattggcgagattcctgatcaatttatatcccaacattgtatgacattaaggaagaaattttcagtcacttcaaaattgatttcttaagctgccaacttgcttatactattatggtaagaacttataaagcaaataaaatcgctttctacctaaaaaaaaaaaa

SEQ ID NO: 624428 - DNA, 283 bp, Homo sapiens
atgctcgcttgagtgagcgtttgaggagttttagacggaatcttagttcagctccccacagtctcctaaaccccctggtgccacttctgggttcctgagattctcgacgagccgtggtcccgagagtggcgcggtggcctgggccagactttacctccaacgcgagagagtgatttcttccaatgcccgggccggttgatacgttccggttggttggatgttggtggttttcttgcgtacaaagttggtcgacaccatctttcaaagcaacagtgttttgtag

SEQ ID NO: 624429 - DNA, 575 bp, Homo sapiens
  misc_feature (91)..(91): n is a, c, g, or t
  misc_feature (127)..(127): n is a, c, g, or t
  misc_feature (218)..(218): n is a, c, g, or t
  misc_feature (243)..(243): n is a, c, g, or t
agaaatattcccatcagacgttgtggagctatttcttgattgtgactgtgtgtttcaacccttacctatgaagatgtttgttcatctagcnaatatttattgaagactcattagatgttgggatacnaaggtagacataggtgttcttatggtctccttatggagtttattccagtggggagtataggtatttgataaatattgaaatttagactganacaagtattctgaaggaaataaacnagggctgacagagggaagaaggagtgaggcgagccctgggtatttacagggattagagtcttcagtcatagcatccttaatccccttgaaaagttggaatcacgaatcataattgcgtaaatttaagtttccttgctgccatctaagtcttcagtcttcatttaagattgattgctacatgtaatatgtgtctgatatttaatgtatgataatactgggttttacatagtcacaggataactaggacttataaatatctagcatgcttgactaatgagttaattttttactttttttttgtggcatcgatatacccggtaccgagctcgatc

SEQ ID NO: 624430 - DNA, 238 bp, Homo sapiens
cacaccagtttgcgaagaggaaaacaaaactgtcagtaaatatatgaataagtccttaacctcaaagccatcctccttcttcatcaacaatgcttgcgcaatttcctgggagcagcacggtggtacttgacggatgcgctggcactggcttcagcacggtaggagcccaagggcagcgacgtgctgtagcagctcctgccggtcccgaaagaactttggctgctgcttgtcccgcatg

SEQ ID NO: 624431 - DNA, 122 bp, Homo sapiens
  misc_feature (122)..(122): n is a, c, g, or t
gaagcacagtgttcagcaggtcctgttgggatgattgttccattggcaagctacaataatggggccaaatgacagtccctatcagggtggagtattttcttgacaattcatttcccaccagn

SEQ ID NO: 624432 - DNA, 128 bp, Homo sapiens
ggtagcgatggtgtggaactgaggaggaggaatatccatcttggcagaaaccacaggataggtttgtttctactggtgtgtctgggggaatgaacgcacagatctgttggactgggttataaaaatag

SEQ ID NO: 624433 - DNA, 316 bp, Homo sapiens
  misc_feature (54)..(54): n is a, c, g, or t
  misc_feature (106)..(106): n is a, c, g, or t
  misc_feature (216)..(216): n is a, c, g, or t
cagaagcacttcagttactcccataggaaacttaaaattcagaagctgggtggnggctgtcacgccttgtaatcccagcactttgggagggtggatcacatgaggnccaggagtttgagaccagcctggccaacatggcgaaaccccggctctactaaaaatgcaaaaattagccagcatagcagtgcatgcctataatcccagcgacttgggagnttgaagcacgagaattgcttgaacccaagaggtggaggttgtagtgagccgagaccacatcattgcacaccagtttgggtgacagagcgagctctgtttc

SEQ ID NO: 624434 - DNA, 108 bp, Homo sapiens
ctcttacaaaagcctccagatgatctaaatctagttagcaatgtcagcctttggactgcagctgttgggacatgtatccttgttgtctctgtgttctgaaggattgta

SEQ ID NO: 624435 - DNA, 378 bp, Homo sapiens
ggtatgagtgggtgtggagtggggtgtggttgttgtgtgcctttctccggtggggccggttggttggggtggggtgtggtgtcttggtctgaggtacctggagtcgtgggagttgggtcggtaggagtaggacggtggtggtggtggtcgtaggtgaggtgtgttgggcgtcggagcatggtggtaggggtgtctcgggcctctgacgtgcgtaggtcccctgggtttgtaatcggtctctcccaagaatcgcgattcgacgcggaagtagagtacacggatactgattactcttagttactcggtcattaagtactctaaggggaggttcttcgattccggtcggtgtggtcgtttcggacgggatcttcggcacgt

SEQ ID NO: 624436 - DNA, 865 bp, Homo sapiens
ggccaccctcagcatgaggaacacggagcggtcatgaagaaagggggcatattctcagcgagaagtttctgaaagcttttgccttccatctctgtctgctctctcatttgcgtggccatcggatcggggtatctagtattggaaggggtcgtgacgaacctcctaccagacacctttggatgaagaactggagtctgtacttggttcgttaggtggattacttcgtgagcgttgcgacatagctcactgaagagctgttagatcctggggatgggcacgtcgacttgtgtgtatattgttctgtaaatgctgggttggcctaattgaggtaaaataaggagaatagacactaagagatcagtgttgatctataattacagcctatgggatcaataagcatgtcagactgattaatgtctactgtgaaaattgggtagtaaattttcattggagtatgtgagagtagtaacagtgatctggaagtgtaacatcatattaggagtatgaggtgagtcgatggatgtgtgtgggtatgcggaggaagatgatctgcaagctggaattcagctgaaggtactatatatttcaaaagaatgaataagattgattagataaacatcgctagtttaaggggttgggtccaaaatagatatggtggccttatatatcacagaaaaggaggtaaagaaacacttggagggctcccaaaatgccggggtgccggagacacggaggtctctgacagggggcagggggcaatagcgtgatccccgggacgcggagttacggcacacagggggtaaaccggcgggcccccctatggggagccgggataaatcaaaacaggcgggttagccggataagg

SEQ ID NO: 624437 - DNA, 277 bp, Homo sapiens
cagtagaagtcagattaaccatatctttatttactttagttttaaatgctatccagtggactctcagtttactgagggtgatggaaatcagtgttcgtattctacctccctcctttttcccctcttactcttcctagatttttgctagctggagattttatacatcatctaagcatatcgttattgacgatctgttgttaccctaatcctattttagtcttagtacctactagtttagttcttttctatgtgctcactgtatgttgtctccgggtct

SEQ ID NO: 624438 - DNA, 1430 bp, Homo sapiens
gggggaacgccattgacgtgtaccaggcgtctgtggggctttgtgtgtgcagatgccccatgagagcacggtgttgccaatgactcgcgtgtgtacgtgcacgtcagccggtggtggaatactccaaccggtgctaccgagttgggatggacatgggtacgagcatgcccgtctgtgtgcttggtaacgacggcccaacactctgatgcagcttacctgcacgcatggtcgcgctacgaatgatcgccgattcgacttggccgctgactcttggcggtagacgtgcatctgtccttgagcggagacgtagactcgtgcgacatcgatcttagccagaagggccttggttggaagtcccaattcgggggcagtcattcgcctggatactccataattcatagatcggatcctctggatgagtagagtaggcgatctatgatcgatgcgttgaccgatcggagtgtcgtgatcagcaatctatcgcaggacatctacccgtgtgacatggcgcatggtccattgggaaagtctcccaatgcggcttccactacggatacttggtcgattgggcctcgatggggctgtgccccaagggactcggcttcgccttggaaccactattggctctcccagattacccaccgatcgaaggaaccccttggaggcaccacttccaaaggttgtactcctccagcaattgaccgttcgtgcaactagcggaggaccgtctagcacgcacttgctgttgcattctcattggcccaccattcaggaaatgcacacgcttgcgaaggatgttcgacgcatagcaaaagaggagggcgccaattcaaatccctttgcctccgtttgcggtaaggttggagggcaacccccagatggtttccaaaggttctggggtggctgcccccattccccaaaggtccttcttcgggcggaggggaagggacaaggcttatccctaccccccggagaggatgccgcaatgggtgttccttaccacaccaccttggtgcctggcttaccaaagctggccttggggtgtaccggggactggtggtcggagatggtcgccgcatttgggccatgtgagcccttggggttgctttctggcctgcggtttggaaccacggagcttccacgtccggtggtcctttgggattcccacctcgggttgtttttccccctttgaccatgggataagttcgctccgagactcgcgggacgatgggcttggtctgtagaatctggtcctccaacacgcggaaggacagccgctttgtttgtcccccggggtttcgcccgaccgcggtgcccgtcggtttgtgtcccgccttgtggacccgggaacggactttcggctcgttttcgacccccggagacgtggctgtgtggcgagacgtagttccggtttggggagggggcccacc

SEQ ID NO: 624439 - DNA, 207 bp, Homo sapiens
actactactactaaattcgcggccgcgtcgacgaagatattgacacaaatttaaaaaatcagtaaaggaatgtatataatattgctctcgggttttacagaaagatttgttgctctcagactgtgtaaaacaaaatgtattcatgtattctgcatattaaaaaatcttattgtaccaactggtgaactattaaatgcctataaaact

SEQ ID NO: 624440 - DNA, 208 bp, Homo sapiens
tgtgacgattcgagctcgtaccctttttcagatttagtagtatttggattacattaacagttgagcatcccatatttgaaaatctgaaatctgaaatgctccaagaaggattttctttgaggggtatgtcagcactcaaaaagttttggattttagagcattttggatttggattttcagacctggaatgctcaacctgtactatgaa

SEQ ID NO: 624441 - DNA, 551 bp, Homo sapiens
  misc_feature (460)..(460): n is a, c, g, or t
ccccatgcacagttctcaatacagtggatgctatcttgggtcctaattatgtgcttctgggatgtctactaatttggtggtggttatggtctggaataacgggtaataagcaccaagggagggctgattctatctacaggtaagaagctgggatgtttcctcccggatttggtcatttctttccaacttcccaaaggcatgtcatacagcagggaagaggcatctctcatgtctcaagaaagcttaagggcacagatggatgtgggcacggaaggtggtacagtagtggcaaccagccgggaaaatccataggatcatttcagaccgcattcaacacagatactcatgtagccccgacgtttctggtgaagggaatggatgtatggctggagggggtcgatctcgggttctaaggtgtttggttggtttccatcgtgactaccagaaaattatagaaggncagacgcagtggttcatgcttgtaatcccagcactgtggaagggtgaggtgggcggatcacctgaggttgggagttcgaaaccagtctgac

SEQ ID NO: 624442 - DNA, 886 bp, Homo sapiens
tactgtgcgcaataaggctcatatgtttatgtatttagttagaaataacctagctattctcacttaatgtactcggtttgaagatgaacctcgcttccttgaagaaggtgatacagtgcagatttaatgatgagttaaatattgagttggctgaaaatgtacgatattatgaaccttctggtcaagaagaagtactttctgactctgaattatcaaaaacatacctaccttgagcccgctgccatctattgttaactcgctgagaataaacgacatatcttggtttttattccccaggaagcttgagagaaatgagtctattctttttttttctcacaaagacaaaatgtaactttgggccagtttaggtttcacgataacgacgtgtgttgttaattaactgcttaaatgcggacgctcgtagtattttgctatattcactggcactttacgtacgaattacatgatccaatatttggattttcctctggaataattgagacctcgactatcatcacactgactcgctactcctccatatggttattatcccgcgtcaatccggatactgcgtcgtcggtgtgctcactaatatacgtcttcgaacatttcatactgtgctcacaaacactgtcttggtagcaagaaataatacaggtgcggggagtctcatcttgatgtccctcgtcaagcaacgcggtatctattgatgtagaggtcgaggtgtcctatatccccattctctgttgttgtgatgctcagtgctgctctcatgccgcgcctcgaagacgttgcgaggtgacaacaatcatattcacctttccgcactccatccgttcatggccctaaccatctcattcttaacgccatttttgttgtgcgattt

SEQ ID NO: 624443 - DNA, 386 bp, Homo sapiens
ggaccctgtctatggcaaggcaagctggattttctctcccttccttcctcatttctccctccacaggttggcagctttgggcaccaagtggtggaatctgggagttgatgactcagtcacctttgaccagctgtccaaattgagatgactgggctctttgggaagttggaaaggcacaccaggatctgagtgtcactgtggtggagagtgaaaatgaccacagtgcagattatctgtttgtcatattggttttgataaattgtacttttcagggaatttgctcatttcatctaagttgtcatatttattgacataaagttattcataatagtcttgttctcttaatgtgtatgggatctataattacttggccttgccatatgcaa

SEQ ID NO: 624444 - DNA, 1347 bp, Homo sapiens
gaacatgcgctaccaggctacacgggacgaaggagatggcggcatatgaagcagctggggattcgcatccacagacccgcggcactgcatgcatccaggacgtccagagcccagcgctgccgggacatagccgatcgttgctccttgtggatagagcagtgccaggggtaccctggcatattattgcgccagctatcctctcgatgacccccatgcaagccccgtagcaccatttccctcgagacatcatgtccccgctcatgatccacttagtgtctgggcgcaaggacgaaaacacccattctgtcaatacgttggcctctgcacctcttccgaacctcctatgggtcacacctcatcctgcgacacacgcaacgtaatccgcccacgtggaaatacccacagcttacattggaaccggaccctggtacataacacagacggggcgccccatgtgaccgagttacacacactccactttagacctgaccgtttgacgcagttaactaatatggactgagcgtcacaatgtcacattagatccaatactaaagacacgcgacgcgttgacatgtcaacctgggtaggagtaccccccctttcacactcatcggaggccaaggctcgccagccaacttgaaacatctccactagcaaacggggtgtctaccacagcgttcattgtaaaacgcaagatgcaatacgcaaatatccattgtaaacgagatcggcggctaccggacaaagatgaatatcccaggatacgtatcaccccactgcagccacaaatggcaaccaagttccaatacaatacgacgacacaaccacagcacacggaacacacgggcaacacccggcacgaagcgcacgttcccgataccgactaatacaactccaaagcgcgtgtacagacccatgtgccgcacccgggaccacgccacacgacgaccgacacatgcacaaccgctcaaccgatcacaacgccgctgtgctcaccgcgcaagaaacgaaccacacactccacccatcacggcctaaccctgctcaccgacctcacggtagactcagcgaccgccccacacttagcgagaacaacaagcggcggacaccaacacacttagtgcgcgtaaacagccaactaaaacagcgacaacgccacaacatagaaaagtaagcacgcaacgtgaaggtacccacaacaacgaatagtaagcaaccgggcaacgaatcacccgcagctccgcaagagacggtaccgccaacgaccatgaacgacataagacagcactcaggcacacaggaacagtaccaccaccttggcgacaacaccacacagcgaactataac

SEQ ID NO: 624445 - DNA, 857 bp, Homo sapiens
  misc_feature (3)..(3): n is a, c, g, or t
  misc_feature (147)..(147): n is a, c, g, or t
  misc_feature (235)..(235): n is a, c, g, or t
  misc_feature (240)..(243): n is a, c, g, or t
  misc_feature (245)..(245): n is a, c, g, or t
  misc_feature (255)..(255): n is a, c, g, or t
  misc_feature (267)..(267): n is a, c, g, or t
  misc_feature (270)..(271): n is a, c, g, or t
  misc_feature (281)..(282): n is a, c, g, or t
  misc_feature (285)..(285): n is a, c, g, or t
  misc_feature (293)..(293): n is a, c, g, or t
  misc_feature (299)..(299): n is a, c, g, or t
  misc_feature (301)..(301): n is a, c, g, or t
  misc_feature (308)..(309): n is a, c, g, or t
  misc_feature (311)..(312): n is a, c, g, or t
  misc_feature (321)..(321): n is a, c, g, or t
  misc_feature (329)..(329): n is a, c, g, or t
  misc_feature (337)..(337): n is a, c, g, or t
  misc_feature (344)..(344): n is a, c, g, or t
  misc_feature (346)..(347): n is a, c, g, or t
  misc_feature (354)..(354): n is a, c, g, or t
  misc_feature (385)..(385): n is a, c, g, or t
  misc_feature (414)..(414): n is a, c, g, or t
  misc_feature (421)..(421): n is a, c, g, or t
  misc_feature (432)..(432): n is a, c, g, or t
  misc_feature (438)..(438): n is a, c, g, or t
  misc_feature (440)..(440): n is a, c, g, or t
  misc_feature (448)..(450): n is a, c, g, or t
  misc_feature (457)..(457): n is a, c, g, or t
  misc_feature (466)..(466): n is a, c, g, or t
  misc_feature (505)..(505): n is a, c, g, or t
  misc_feature (516)..(516): n is a, c, g, or t
  misc_feature (532)..(532): n is a, c, g, or t
  misc_feature (536)..(536): n is a, c, g, or t
  misc_feature (564)..(564): n is a, c, g, or t
  misc_feature (575)..(575): n is a, c, g, or t
  misc_feature (589)..(589): n is a, c, g, or t
  misc_feature (693)..(693): n is a, c, g, or t
  misc_feature (698)..(698): n is a, c, g, or t
  misc_feature (709)..(709): n is a, c, g, or t
  misc_feature (713)..(713): n is a, c, g, or t
  misc_feature (715)..(715): n is a, c, g, or t
  misc_feature (718)..(719): n is a, c, g, or t
  misc_feature (725)..(725): n is a, c, g, or t
  misc_feature (786)..(786): n is a, c, g, or t
  misc_feature (837)..(837): n is a, c, g, or t
aanctgtagtaaatgttcagatatttaaatgagcaccaaacactacaaagtgcaaccaacatggttctattaaaaactctctttgactatggcattcaaggacagcaatacaatcttttttttttaacaaagcaactaatataaaantctgcaaatgccatatattcatatctaggctattcttctcatataggcatgtcattagatagactttctttctattctttcctgaggnatttnnnngnggtttacttntattgtactgcnggnngcattatttnnggncatccttncctaanangatttanngnnctgcaaatnatattatngcaaaggncactatngnngacacanagggtgggggcggcaagtgtgtggcattggnacaagccttacaaatattgcattttaagnatacacncattttttacngtttgncncttttaannnatttgangttatagcnacgacttaactacgtacagtgaagcattttagggatgtnaagtgattaangaagaagatgaatganacanagaaaagaagccaccattcttgccagcnatatattgctnttccttcaacagcnactatacatgctgccttcagttcatagttaaatatttctagtaatctgttttgggagaacaaatgtctttcaaggtttcaagttcctctataagcttcttgttntgganttccagcactncaantnggnnctccanacattttacatattctttctttcgacgtcgaaattctttggcagcttccctgaaaaaaagnagaagcaaagggcaaacaaagcattttttgcatgctattgacaaacagatnaaagtaagctcggtaagtgt

SEQ ID NO: 624446 - DNA, 401 bp, Homo sapiens
attttatacatcttctgaaaacaagagcaaaactaaagtgactagatttgaccagaaagtgtgggctgctgaaagcaatgacctaagatagcttagtttcccaggcccagtgtcttccagtattatcacaatcacattgagtctttcactgagccgggtccataatagacattccttttgtgaacttcttgactgttggaggttggccagagcgtcaccatcttcagatgggccgagggaggttggctggccgcactggcttgtggtggcctgctgactgagtccgcatcctgttacccctaaggctgggttcctcactgcttggttgactgatctttccttctggcctgcttaggctggtccacggggacgagcagtctggttagtttctgctggcaggc

SEQ ID NO: 624447 - DNA, 906 bp, Homo sapiens
ggtcgtctgcgtgcggcggcggcggctgaggagtcccgtgctgaggcgccagctacctcggtgccggtccgcatttcgtctcttccggtcttcgtggctttccctcggacccaggcacgccccggaccctggcgcccgaggcctctcctggatgcccgtcggcagaccggtctccggcgcgtggcgcctctgacggcgacgtgtggatgactgcatggtgcttggcgctacgagctgcggggacttgtgagctgctgttgaaggtctccaggacggagtagggactgaggtgcgaggtgatcatacaatgcaatcagcgcaatcgccgtcgagatgagtgatacacatgacacgtctcggtaatagtattccgcagcggagttcctatgttaactgacggaagcatttactcgcgcttcgacctacatgggaagggccgcagcctaagtgcctatcattgcatgtggaaagaaagcttgtgaactgacaaactgggaatgtttggacacattcggaaccggaccttggggtaacagacacgataactttgagagcacaggtacaactactcgtggactcgaccagggcatcttgcagcacgaagtgcgtagggccgaccccgagaatggtgtgttcaccacccttggttgtttaacacacttaccccgtctgggggacaccgttggtggtggccacggaaggagaactcttcttaggaagagggttccacatacgggccatggatgcaaagttgtttaccatatgggtgctagtattgttcacccattttcagggaccgcaggacgtaggggcccacttggcaaacacatatggctatcgagccgggatattacggacaacaggggccctatgttgtgaaccctaatgtcggggcacgatttgacc

SEQ ID NO: 624448 - DNA, 102 bp, Homo sapiens
gtcagtggcaagggaatgagtctctctgagcctggttttgagactcagctcacaggaacaaaactgaaacgcagttgctcacacctgtgttacttttatttc

SEQ ID NO: 624449 - DNA, 365 bp, Homo sapiens
  misc_feature (216)..(216): n is a, c, g, or t
  misc_feature (222)..(222): n is a, c, g, or t
  misc_feature (225)..(225): n is a, c, g, or t
  misc_feature (247)..(247): n is a, c, g, or t
  misc_feature (275)..(275): n is a, c, g, or t
  misc_feature (294)..(294): n is a, c, g, or t
  misc_feature (332)..(332): n is a, c, g, or t
ctcctgtctcagcctcctgagtaactggtattaccattgcacaccattgtggtgacttatttaattttttaattttttgtagagatgggatcctgctttgttgcccacgttgatctcaaactcctggctccaggcaatcctcctgccttggcctcttaaagtacagggatgacaggctgagccattgtgtttgacccagatactttttttttttgngacggngtntcgaaagtgattcttgtgcctnagcctcctgagtagctgggactacaagngtgcgccaccacgttcggntaatttatttatttattatttattatttatttttttgngatgcactccaccctgggtgacggggcaagatt

SEQ ID NO: 624450 - DNA, 1518 bp, Homo sapiens
atgcgagacgatactaaagtttgtagcacacattccaataatgatacgtagtcatctagagatgactgtgtcagtcgctatcaataggagtaggcgttcaatttcacttgaatttgccccttaattctcagggctacaaccctagaacacgagagaccataacggcactacacatgtcccagtgtatccagtgactcgaataatttcgagtcgggctgtagaagtactgagaccttgttgcgttccactcgacaagagcagctttgttcgtcagggccgtgactctcgggaagattgggcctcggcgacacgatttatcattctgggaactttagcacgctcggattggctagtaacaacaacaacgattgtacatagcatctcattactacaatgcttcgatagcgacttcatttgccattgtgctactaggcatggcctacgtatagttcattgtaattacatctatgcgatggatgtggggcagggacagcacatgtcggggtatgcgatacaagctgtagaagacgttcccattaatttagttgagagagacgcacaagcccctgcgcagattcaacaccttatgtgaagattcgcacttcatttattgcgtatatgccgcacacgcatattccattgaaacataccatgcgaatcttgcggcaaatgagatccgccctgggaagttcaacactatttgagataatttcttaacgaaggagataaacatacctgtgggcacggcgcactctttccacggaaaaccacgcgcaacgcgaatcacgcctttggagattacagtccccacacagggcgcaaggagcccccccaaagtgggggtcggcctacggcaattcggacccttcgtttcggtacatgcattggttacaccaaaactgttggacaccacataccacataacagcaccatgggagggaacagaagagtacgagaatggctgtagtagggaaacgccaccctgggacccccttccaagagacaccacctacggagaaaaacaacgacatcgcaccaacaggagaacaacacatagcaccaagaagggggcagggacgggccgcaaggggggcacccacacaagggactacgtgtgcgcagagcaggagcacagaccgcgcacgtggagcaagcccacaaaaaccgaggagcggtgttcaccgcacacaaagaaagaacgacgaaaacccgacaggaccaaaggaaccgtagcaaaaaagacgacgccgcacggggcggtactgcaaaaccaacccaccacatactaacacgagacacagacgaaagctcaccgttggggtcggatacacataccgaaggacgacacgagctcttgtaatgcgatgaaaaacagaaaatcacgaccagcaacgaagagggaggaaagctccgatcaagcgactgcacagcgacacatagccaacacgacgaccagacatagcggtatccaagcataggaagaagcacagacgctcctcagacgagcgaaggataaca

SEQ ID NO: 624451 - DNA, 163 bp, Homo sapiens
gtcgaggagcccattgaagcattgatgagctcatctgccagtgcactcagcaatggtctcactgttccggaaggcagactcacgagcgcctgtgacagaaggcagatggcctggttcacacggcgcaggggggacacctccacagcctgtcgtctcacagtcc

SEQ ID NO: 624452 - DNA, 130 bp, Homo sapiens
ttatgggctgaatctgcatgccgaaagagccgtggcttgtgaaagggccacaagttccaccacactattggtggctctcgccgtggcagcttggagaaggctgcaatactctccatgctccacctgttac

SEQ ID NO: 624453 - DNA, 277 bp, Homo sapiens
  misc_feature (11)..(11): n is a, c, g, or t
  misc_feature (112)..(112): n is a, c, g, or t
  misc_feature (139)..(139): n is a, c, g, or t
  misc_feature (147)..(147): n is a, c, g, or t
  misc_feature (168)..(168): n is a, c, g, or t
ctcccaacctnagcctcccaaagtggctgggaattaaggcatgagccactgcgccctggccctgtgtgtaaattcatgtgactaccaccacaggcaagacacggaagacttnccattaacaagcatccccctgtgttgnccctactncataatcattgaccacctctnctaccctggccctcctccttaatgccctgcacaaccacttactgttctccatgctgcagtgcattttgttattttgcagcaatgttatataaatggaatgcaatatata

SEQ ID NO: 624454 - DNA, 655 bp, Homo sapiens
acgttccatccttcccactgctccacggcatgctcgggcaaccactatcgagcgtgagcgtcttcccaaagtcgccaccctacacagctctaactaggacacctaccctatgatgttacagaagagtcaattaaggaattctttctgaggattaaatatcagtgcagtgcgtaaccacgtgaagccagcaatccaaagaggttgaaaggtttaggatatgctgaatttgaggagctggattccctgctcagtgccctgagtctcaatgaaaagtgcttctgatatgcccagacgtacaaggtcactcaagggatatgtgcatcatggggcaaaaggtatggttaatatggtcctatgctctcagtctctaggtaacaggagaattcgagtggacgtttgctgatcaaggccacaggataaaggaccgggatgatcgttcttttgggccgtgatagcaatcgggattctgacaaaacagatacaggactggaggggctcgtcctgctacagaccgctttgatgactacccacctagaagaggtgatgaatagcttttggagacaagtatcgagatcgtaatgattcagaccggtatcgggatgggtatcgggatgggtatcgggatggcccagccaggatatggatcgatattgtg

SEQ ID NO: 624455 - DNA, 306 bp, Homo sapiens
attcagtgacggacgaacgctaactgaccacagacacttatgaaactagacttttagtcaggcctttttctggcctgcaggtactgaaagtcctttcttcaataaccggtacgctgtggaaccatgaaactactgcaatgtcttcctggctttatcttctgccacccttcctcatgtttctatgttgacgtagctgggaatgtctccttaatgcagcacactcattcaggtagccagtctttgcagatgtctgtctagaatgcctttccttcactactccttgggccacactgtctgtcctctgta

SEQ ID NO: 624456 - DNA, 374 bp, Homo sapiens
gcctggtggcaaagcgaactcgtgaagttggcgcaatctgatggtccacacttctctcagtgacgggtaaaccgcctgagtataggaagagcctacagatggggttgccaaaaaagtaaggggaaccccagtaagatgaagtcaaactcagcataatgtcataataatcacataatgcttttcattatcacagacctcagcacctgtaaggtgtccaaaaagggattgaggggtgaaacacgaggaagtctatttggcaaagtctggatggtcaccacaggtcttatctatgtgtcttagccataacattcgtgaacaggctcatcatgagttctctgaacactgtaatcacatctaagtagacatcaagtcat

SEQ ID NO: 624457 - DNA, 548 bp, Homo sapiens
agatgagaatacgtcatgaaagggcataagataataccaggcctagaagcaagacgattgtagctaaaatctaaaatctataccttaaaaattacccaagttctaagcttgttgtatttcttttttattgtatttgtttattggtatttagaaggagtctcactcactctgtcacccaggctgtagtacagtggcacaatctcggctcactgtaacctccaccctccgagttcaagcaattctcctgcctcagccgtcccaagcagcctggactacaggcacaggccaccacacgcctgactaatttttatatttctagtagaggcggggccccaccatgttgcccaggctgttctcaaactcctgacctcaggtgatccgcccaccttggcctcccaaagtgctgggattacaggcatgagccaccgcgcccagctgcttcttgtatatactgagtttatttatttctctgatgctcatattagtattgtagtatgcctttttcagcatgcccagtgaataccaggggcaggtgattggtaatctgt

SEQ ID NO: 624458 - DNA, 277 bp, Homo sapiens
cgagctagctaggataatgaacggctccggacgcagcagcacgccgcgcttgcctatcccctctacttggcctcccatattcctaggatccgcatacgggcgggctctgccccaggagcccggcgggggcgcagggcctcttctggcctctctcctctctctctccatccactgtgcccctcgggcctcgctgccgtgctcggcgcagcatgccgtgcggcgtctgtgccgcagacgggccactcgttcacttaatgccgctagcgcgggtaccgag

SEQ ID NO: 624459 - DNA, 490 bp, Homo sapiens
actgacgtggaaagtactctctagtcatcttcagtatcaagccttctgtagtggctttcgtggaccgtggacatgatcatctcatccccaggtgtctcgagatacttgtcaacggactcaggggtactggctgctgtagtaggaagtttaacaggatctcgggcaagaggtacctgggtagtcttgagtaaactttgggacgtggcgctgacacacacggacatgcagtactcttctgtgtcaaagttgtcccggttgccgccacatccgccgtaaaagaatgggggcacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcattaccatcctc

SEQ ID NO: 624460 - DNA, 208 bp, Homo sapiens
cacggagcacagtatacaagatgttacgtcactttatttcaactgtatgattcatcagaacaattattaacacatggagtaccattcagctcaactgcaggtataggcagtgacaaatatctaattctttaggaaaatgacttactcttacaatctgtccagacacattgccctaggaagagtcataaatagagaacatgattttcac

SEQ ID NO: 624461 - DNA, 339 bp, Homo sapiens
cctatgctagatgcactctgaccctgcagtctccagccatcagtgagtccagtcaccagttgcaggcaattgaacattcagcgatagagaaagactgaacagtgattagcagtgcttctagatctatgtaatggacaataatgggtagtagtgtagatgcagatgagagtcagagtgtatatggaaactactaagcttagtgttttccttttcataatatttattgtactcctactgtgtacgtaatactcccagctctcaggaggctgaggcaggaggatcacttgagcctcaggggtttgagccagcctgatcaacgtagccagaaccctctcatca

SEQ ID NO: 624462 - DNA, 424 bp, Homo sapiens
  misc_feature (84)..(84): n is a, c, g, or t
ggtcactttatactcaaatcattgctgatagtcaactcacggcacactccacagatgacattcccatgtttgatgactctccanctccccacacaacaacaccagtggattatgaagatgaggaggctgcagtagttcagtataatgatccatatgcagatggggatcctgcttgggcccctagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttcttttttttcttttgaagtagattcttattactcagtcatactgt

SEQ ID NO: 624463 - DNA, 449 bp, Homo sapiens
caacatcccttcaaggtgggtgttataaacccattgtacaggtgagaagaaacagagctctggcaggtaaatgacattcccaaggtaacagtcatggtagcaccatgattttacccagtctgatcctggcctcctctctttcttctctcccgtattgtgacccattcattggagagagaaaaccccttaaggtgcttccatctcactggaaagagaaaaatgacatatgtgaagcagtgactatggtgaaacgtggcaaagctacaattattcaagatgacagcaggaagaaaggagccagctctgtgcctggaatttcatatttattatcatattgaattctcctgcaactccatgagaaaagataaataatatcctctttttaccagcaccacttaatacagtatcacataaatatgtcacataaatacaaattggcagtcataaaa

SEQ ID NO: 624464 - DNA, 152 bp, Homo sapiens
  misc_feature (56)..(56): n is a, c, g, or t
tggacagctggacagcacagaggaggtggacagcacagaggaggtggacagcacanaggaggaacctgatctcttatactagtatccttaatcatttttattgccacaactaacctcctcggactcctgtgctgtccacctcctctgtgctg

SEQ ID NO: 624465 - DNA, 146 bp, Homo sapiens
ctgaactgacatgttgtgcacataaatacagaagcgatgaacagaaggctcataaccaatactggaacagggccaactttgagcccaggtgaatcttctgtatagaatcgccacatccccccggtgcctgccgaggttgtgcggcc

SEQ ID NO: 624466 - DNA, 182 bp, Homo sapiens
agattcccggtcacgatgcgccccagtgtgaacttaaatctgaaagggtgtcaaacatcgcatttcctagagttcgagtctggagcgttgcacgacaaccgaaccactccacctagagctgcgggccggcgtggttcagcggtccgctcccgggaaggaggccccgggcgcttcacaatagc

SEQ ID NO: 624467 - DNA, 84 bp, Homo sapiens
tctaaaaggacaatttacaaactaagaatagtaacatcttgttttctttttgtaggtataaataaaaacactgttgacaataaa

SEQ ID NO: 624468 - DNA, 114 bp, Homo sapiens
ttacgtgggggaagggggtttacccctttggttgggtttttccccctgtaccggttttttcgggcttgggcccctttggggggggaatcctttatttcccccccccccctccca

SEQ ID NO: 624469 - DNA, 108 bp, Homo sapiens
gacatgatacaatcgagctggtacctggtgtcggaaataccatccatcctgggcgtggagacttctctctgtcgacagcagagctcggcgggtgtccagaaatgttct

SEQ ID NO: 624470 - DNA, 185 bp, Homo sapiens
  misc_feature (126)..(126): n is a, c, g, or t
  misc_feature (134)..(134): n is a, c, g, or t
ttcgactgtgggctcagaggggaggagggctggggactcctttaaaacctactgagggcctgggcacggtggctcacacctgtaatctcagcgcttggggaggcggaggcgggcggatcacacctngaggccanggagttcgatgaccatgcctggccgaacatggtggaaacccccatctctac

SEQ ID NO: 624471 - DNA, 479 bp, Homo sapiens
  misc_feature (136)..(137): n is a, c, g, or t
tttcccctattttcagggtacaccctagccaaaccacgccaaaatccatttcacttggtgcggaggttaataaatttttttttcccccactcaggcgggcggggcgggtgaaggaaagaaaatttgttttcctttnnaaacttttttcccccaacactttttgggcctaccggaatgccccgcgttattcgggtaccccgagtgcaaccccccatgaaacatcctattcatctggagggtcattcatttttctaacagcagaatattaataattttcatgatttgagaagccttcgcttcgaagcgaaaagtcctaatagtagaagaaccccccataaacctggaggggctatatggatgcccccccccctcccccccatttgaagaacccggatacataaaatttaggcaaaaaaggaagggatcgaaccccccaaaggtggtttcaagcccaccccatggcccccatggctttttca

SEQ ID NO: 624472 - DNA, 911 bp, Homo sapiens
caaaccgtcatctactctaccatctttgcaggcacactcaatcacagcgctaagctcgcactgatttattacctgagtaggcctagaaataaagatgctagcttgtattccagtgctaaccaaaaaaataaaccctcgttccacagaagctggcatcaaggtatttcgctcacgcaagtcaaccgcatccataatcgcttcttatagctatcctcttcaacaagtatactctccggacaatgaaccataaccaatacgtatgccaagtcaatactcatcattgaataatcataatggcgtatagcaataagaactaggaagtagccccctttcacttctgagtcccagaggttatgcaaggcacccctctgatatccggtgtgcttcttctcacatgagaaaaatagcccccatctcaatcagtataccaagatctctccctctactaaacgtaagccttctcctcactctctcaatcttatccatcatagcgaggcagttgaggtggattaaacaaagccagctacgcaaaatcttagcatactcctcaattacccacataggatggataatagcaattctaccgtacaacctaacataaccattcttaatttaatatttatattatcctaactactaccgattctactactcaacttaagatccagcacacgacctactactatctcgcacgctgaaagaagctaaatgataacagcctttatttcatccaccctccttttccttagaggctgccccgtaacggttttgaccaaatgggcattatcgaagaattccaaaaaaatagtattttcgcaacattatgcaataactcttaactaattaacaagtaataacaccaaaatatccctccatgaaaagaggggtaacccttccccatgctcgcctcc

SEQ ID NO: 624473 - DNA, 452 bp, Homo sapiens
tgaggatataggggactccgttcatggtgaaggtgacatcagagacatgacgttaaggttgacacactccacagcatattatccagtgcaatatgacagtaagcttgcttggtgactagggacccaatacaagctcccagagaaatgggagtggtcgtagccaccacaaatcagctcgctccccgcaccaccttctgggttactacatggagagaaagacaaactgtccaggaagggccactgcaaaactctaggggtgagcctcagctaggaccctttgcttcttggtctcatgccaagcacacaggtaggcagaaacatcagtctgggctttgagaccgggactctgactactgcaagtgaattggtctgggcctttttgacacaaggttagaaacaactccccttgaccatttgtgaatgtgtttctgcttcttgagccctagaggtgt

SEQ ID NO: 624474 - DNA, 120 bp, Homo sapiens
tgactctagaggctcccgctccaacaggcgcgggagggcaatcacatgcactttatacgcacggtatggtaagggggaaaaggcaaggtcttaaataaaactatttaggatgggcaccat

SEQ ID NO: 624475 - DNA, 325 bp, Homo sapiens
  misc_feature (17)..(17): n is a, c, g, or t
  misc_feature (40)..(40): n is a, c, g, or t
  misc_feature (172)..(172): n is a, c, g, or t
  misc_feature (177)..(178): n is a, c, g, or t
  misc_feature (184)..(184): n is a, c, g, or t
  misc_feature (187)..(187): n is a, c, g, or t
  misc_feature (192)..(192): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (226)..(226): n is a, c, g, or t
aactttaggaaaacccnttctagacattggcttaggcaangatttcatgaccaagaacccaaaagcaaatgcaataaaaacaaagataaatagctgggacctaattaaactaaagagcttttgcatggcaaaaggaacagtcagcagagtaaacagacaacccacagagtgngagannatcttnacnatctntacatctgacaaaggactaatanccngnatctanaacgaactcaatcaaatcagcaagaaaaaaaacaatcacatcaaaaagtgggctaaggacatgaatagacaattctaaaaagaagacatacaaatggcc

SEQ ID NO: 624476 - DNA, 773 bp, Homo sapiens
  misc_feature (1)..(1): n is a, c, g, or t
  misc_feature (77)..(77): n is a, c, g, or t
  misc_feature (174)..(174): n is a, c, g, or t
  misc_feature (185)..(185): n is a, c, g, or t
  misc_feature (189)..(189): n is a, c, g, or t
  misc_feature (195)..(196): n is a, c, g, or t
  misc_feature (198)..(198): n is a, c, g, or t
  misc_feature (205)..(205): n is a, c, g, or t
  misc_feature (210)..(210): n is a, c, g, or t
  misc_feature (235)..(235): n is a, c, g, or t
  misc_feature (252)..(253): n is a, c, g, or t
  misc_feature (257)..(257): n is a, c, g, or t
  misc_feature (259)..(259): n is a, c, g, or t
  misc_feature (268)..(268): n is a, c, g, or t
  misc_feature (272)..(272): n is a, c, g, or t
  misc_feature (280)..(281): n is a, c, g, or t
  misc_feature (288)..(288): n is a, c, g, or t
  misc_feature (291)..(291): n is a, c, g, or t
  misc_feature (294)..(295): n is a, c, g, or t
  misc_feature (297)..(297): n is a, c, g, or t
  misc_feature (299)..(301): n is a, c, g, or t
  misc_feature (306)..(306): n is a, c, g, or t
  misc_feature (310)..(310): n is a, c, g, or t
  misc_feature (313)..(313): n is a, c, g, or t
  misc_feature (317)..(317): n is a, c, g, or t
  misc_feature (319)..(320): n is a, c, g, or t
  misc_feature (322)..(322): n is a, c, g, or t
  misc_feature (331)..(331): n is a, c, g, or t
  misc_feature (333)..(333): n is a, c, g, or t
  misc_feature (336)..(336): n is a, c, g, or t
  misc_feature (338)..(338): n is a, c, g, or t
  misc_feature (342)..(342): n is a, c, g, or t
  misc_feature (348)..(348): n is a, c, g, or t
  misc_feature (350)..(350): n is a, c, g, or t
  misc_feature (358)..(358): n is a, c, g, or t
  misc_feature (360)..(360): n is a, c, g, or t
  misc_feature (364)..(364): n is a, c, g, or t
  misc_feature (376)..(376): n is a, c, g, or t
  misc_feature (378)..(378): n is a, c, g, or t
  misc_feature (383)..(383): n is a, c, g, or t
  misc_feature (390)..(390): n is a, c, g, or t
  misc_feature (393)..(393): n is a, c, g, or t
  misc_feature (395)..(395): n is a, c, g, or t
  misc_feature (399)..(399): n is a, c, g, or t
  misc_feature (407)..(407): n is a, c, g, or t
  misc_feature (413)..(413): n is a, c, g, or t
  misc_feature (416)..(417): n is a, c, g, or t
  misc_feature (420)..(420): n is a, c, g, or t
  misc_feature (423)..(423): n is a, c, g, or t
  misc_feature (425)..(425): n is a, c, g, or t
  misc_feature (434)..(434): n is a, c, g, or t
  misc_feature (438)..(438): n is a, c, g, or t
  misc_feature (440)..(441): n is a, c, g, or t
  misc_feature (449)..(449): n is a, c, g, or t
  misc_feature (451)..(451): n is a, c, g, or t
  misc_feature (456)..(456): n is a, c, g, or t
  misc_feature (459)..(459): n is a, c, g, or t
  misc_feature (467)..(467): n is a, c, g, or t
  misc_feature (480)..(480): n is a, c, g, or t
  misc_feature (483)..(483): n is a, c, g, or t
  misc_feature (488)..(489): n is a, c, g, or t
  misc_feature (492)..(493): n is a, c, g, or t
  misc_feature (513)..(513): n is a, c, g, or t
  misc_feature (537)..(537): n is a, c, g, or t
  misc_feature (540)..(540): n is a, c, g, or t
  misc_feature (544)..(544): n is a, c, g, or t
  misc_feature (551)..(552): n is a, c, g, or t
  misc_feature (559)..(559): n is a, c, g, or t
  misc_feature (561)..(561): n is a, c, g, or t
  misc_feature (564)..(564): n is a, c, g, or t
  misc_feature (568)..(568): n is a, c, g, or t
  misc_feature (576)..(576): n is a, c, g, or t
  misc_feature (578)..(578): n is a, c, g, or t
  misc_feature (583)..(583): n is a, c, g, or t
  misc_feature (587)..(587): n is a, c, g, or t
  misc_feature (589)..(589): n is a, c, g, or t
  misc_feature (592)..(592): n is a, c, g, or t
  misc_feature (596)..(596): n is a, c, g, or t
  misc_feature (603)..(603): n is a, c, g, or t
  misc_feature (606)..(606): n is a, c, g, or t
  misc_feature (630)..(630): n is a, c, g, or t
  misc_feature (632)..(632): n is a, c, g, or t
  misc_feature (637)..(637): n is a, c, g, or t
  misc_feature (671)..(671): n is a, c, g, or t
  misc_feature (684)..(684): n is a, c, g, or t
  misc_feature (689)..(690): n is a, c, g, or t
  misc_feature (694)..(694): n is a, c, g, or t
  misc_feature (705)..(705): n is a, c, g, or t
  misc_feature (757)..(757): n is a, c, g, or t
ncggcgggaacgcggggcctccgtgttctgctgtcttcatcagcgtgggccgcgggccatcatgaggaagccacgancagccgtgggaagtggtcacaggaagcaggcagccagccaggaagggaggcagaagcatgctaagaacaacagtcaggccaagccttctgcctgtgntggcctggccnggcngccggnngnggtggtnttgcnggcctctgtctcctcataccatctnttcagagacgtagctgnngtcncngccttccgngggngcctgctnngctggtncgnccnngngnnncgggncctnccntggngnngncgggctgtngntgngntggncctggncnggcgggcntntgcngtgtgggtctcngnggtcntgctgcngcngncccnggttgccnctgtgntcnnctnctntnccggatggntgcngnngtggcctncnctgcnggncctggccngtgcttccctggnggnggtgnntcnnctctgggctggcctgggctncttttctcgtggccggcggctgcnggngggngctcggnnggtggtngnggngctngggggccncntgccncgtncngcngtgnccctgcngcngctcctgcctggcgtggggcgctncnctgcnggggcctttgcctctttcgcctttggcctggctnccggtgtggtggntggcnncgtngctcgggggcngtgccgtgtccgtgcctttggtgctgttccctgctgctcccttgtttccctnctgctctgggggtctt

SEQ ID NO: 624477 - DNA, 401 bp, Homo sapiens
gaaatggactgaagagatatttaatgtgtcaagagctctacttccgggagaccaatatttcttttttattcagttatttcaaggagggctcccagtaaattttgcttggtaaggagattaatttcagagccatggactcccgtaggatatatcctggatgtttacgttgcaaaaacccggggcattgttatttatttcttctgtcagaaaagcaagacagcaataaactaccgcttaacttgtaaatcacagaagtgactaacctgaacgaaagtaatttgaggacaaaggaagagggattacttattctactgttaagaactgatctacaaagagatgatacgttttctgatcatgcttagcttctcaaataagttaattcttttttctggtcaaaaaaa

SEQ ID NO: 624478 - DNA, 330 bp, Homo sapiens
  misc_feature (4)..(4): n is a, c, g, or t
  misc_feature (297)..(297): n is a, c, g, or t
  misc_feature (323)..(323): n is a, c, g, or t
tctntatggtggtagagaacgtgatgggaatggtggtagtggcgatgatgatgtcctcatagttgtaaaacaaaattttggttattttcacttctctagtctggaaaagagaattttttttttaagtcttaagcagattgcgactacccagattatgaaatgaactatcccctctcttaggccagggtagggaccttgggtatttagtactttacctcagttacctttctcttactattttctggaaaaactgacatctttttttcctcgttttaatttctttaagggttagggagnattacctctctaaggtggttaccggnccaattc

SEQ ID NO: 624479 - DNA, 1038 bp, Homo sapiens
  misc_feature (7)..(7): n is a, c, g, or t
  misc_feature (9)..(9): n is a, c, g, or t
  misc_feature (24)..(25): n is a, c, g, or t
  misc_feature (29)..(29): n is a, c, g, or t
  misc_feature (38)..(38): n is a, c, g, or t
  misc_feature (48)..(48): n is a, c, g, or t
  misc_feature (65)..(65): n is a, c, g, or t
acagtgngntctactcggcctcgnnggcngtgagcgcnaaagacccgnacaagcagcccgggccncagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggctgcctgtgcgttcctgtatcgagttatctccttctctacccggaaactggtccccatcgccatcccccaatggacacgcaaggcccgtctccggccagtatagcgacatcccggaagaagctcctcaaaatcgaagcccggcgttgtcgggctacagggttcgcctcctccgcctgagaaggcaacctcagcgcccccccgggcggcccagccgagcgcacacctcaactcctgctcgcattattgacaaatattaccccctaatgagtttgtgttaagcgtttggataaaaggaggaatgcaacaattatacagaaaacaagagaaaagagcaaataaggcgaatgagcgccttttaaaaaagtgctacacccaggtttcacggcgtggctttattaccttaagtatcaccctccctctgcactcaggcgaaatattcctagctttgatgtttgcaaggggtttgaactttcgtagtctaccagtgcgctgggggcagctgacgagattcccaaagccggtgagccccgttttgttttggagtcctctaaggaagctacggtgggggaggggaaatgaaggctttctgttgtggatatcatgtctgaagaaggggcattcagaacgggaaaggttgacaggcagtagaggaaatcattgctgaccccttattctcctccaaccactctccaagctgtaaattatatataacctagaaaatcacacctataattattctgaaaattggtgaataaaagtataagcctagtgaatcccaaaaa

SEQ ID NO: 624480 - DNA, 107 bp, Homo sapiens
ggagagccgaacagctgaagagagttcactgactcccagccccaggtggcctttgtgcacaattcattggacccagttctggaggttgcttgcacagaaggagacca

SEQ ID NO: 624481 - DNA, 175 bp, Homo sapiens
tgtaatccccacaactggggaggcaaagcaggaggatggatagcttgaggccagcagttggagaccaaccggggcaacatagcaagattccatctctacaaataaataaataaatacacaaaaagaattcattgagatggatgaatcttgacattatgctcagtgaaataaatca

SEQ ID NO: 624482 - DNA, 607 bp, Homo sapiens
tccccactcttttcttgaatctcggaccccgtccgccgtttttttttgtttgtttagcagagtccataaagaggatattgacaccgtatgtactgtgatacttcagcattaccgtagtgagaatccaccaatgggattcaccccaggcacaatggttaggcaccgtggaatattatgccgcccttaccaatatgttacaaggaattttaattacatccgaaaatatgtatgtgaacaatcatgataacaggtgttcaaaggggcatataggatataaaggcaagtacgttagaatatacatacataggccgggccaatggctcacgcccgtaatcccagcaccctgggaggccgaggtgggcagatcacgaggtaaggagattgagacaatcctggcccacatggtggaaccccgtctctacccaaaattaaaaaaaaattaaaaaattaaaattagccgggcatggtggcgggcgactgtagatcaaagactactcgggaggctgaggcaggagaatggcttgaaccccggaggcagagcttgcagtgaacacaagatcgcgctactgcactccagcccgggcgacagtgcgcgactccatttcca

SEQ ID NO: 624483 - DNA, 285 bp, Homo sapiens
tccagtgcagaaaaactagaatctgaagaagatgtgtccaagctttccttgaggctgttgctgaggaaaagctcatgtaaaacctatttctctaagaacattcgcgatttagaagttgtggacgggaagtgctgctagatttgattgcagatttgaaggataccagaccccgaggttgtctggttcacagctgaccagctcaatcagggagtcccggccacttccttttacactacgatgaggacgggaactgctctataaatattagtgatgtatgcggggatg

SEQ ID NO: 624484 - DNA, 2435 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatttctatggaagaagaagatgacatgaagattgatgagaaatgtgtggaagcagatgaagaaacatttgaatctgaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaat

SEQ ID NO: 624485 - DNA, 921 bp, Homo sapiens
  misc_feature (485)..(485): n is a, c, g, or t
tttttttggatgtgaaatttgaaagggtttatttcctaaactacaggccaggctttaaagaaggtgattatctggcacgaacccccagagctgggagagcgtggagcaggggcagggtgagaacaagggggctttgggggtcgaactcctgggtggaggggtaaccctgggggccccggctggtggcctcaatcggcccttcctggtagggcggttcttggatgatgggcgtttttgaaacagcgtcaccaaggggcgtctgggctcttctcggagggtcatgtaaaccgtgcgtagacgcttggtcccttggtgctgggcgtggcccaagctggaaagttggtccaatccttggtaggtggcgcctccggtccttcattactctgggctggcaaccaagcaagtgcgtggtgcgtccaagtgtctgtggcctgtggcgcccatgtgcgcctgtcaatctggcaaggtggcagtgcgtggggcantcttctcctccccggaagtctgctgtggcaagtcaagctctcctccttgagactccaagggtggaaagggctctgggcgaactctgttctctggcgcgcggttagggtacaaccttcaactggtgcgcgcggttcattggccaaacggtgttggcccaagcggagagtggtcccaatggaagtaagaagcgcttggcctctgcgcgggcccgggttggcaacatcggtgcgggggttgggggcggcctcaaggaaggggccgagtcttcggccggtgagaagtctcgcgcttctggctggggcgtggtgccgtggtggtgtggtgcggggacgattcggccagcggattggccatgggactccggggtctcggcgtggcgtcgcattccggaactgggagtcggggaaggttgttgatgcggtgcccggtgtccgg

SEQ ID NO: 624486 - DNA, 852 bp, Homo sapiens
cctgtctacatatttgtttcttacatgtgtattgggcaacagatgtgaaaatacgagacacacacacttatttatcatacgatgtcccacgggcacatgtactccacagggggacgctgtcacactgaggccgcgtccttttggtgaccccggccacatcctttttgccgggggacacttattgacatccgacacacatcatggctgggctgtgcgcccgtccacaggcctgaatggtgacaccggactggacaaggtgccgctgtgccgaccccataagccccccatcgcgatgagaccaacctgctggtgttcgacctcaagaccacgcgggagctgagcggctctgcagtgcgcaccgcgcctacaccccgacgacgagtgcttcttcatcttcctggactcaacaggggacttcgtgccaccgggcggagcaccaggcacggctacatctgcgaccgccactacaacatctgtctgaccagagctgctggcacgaggatctggtcaactcacgtggtcttcagtccccaggagcaggacctgctgctcacggccagctgacgaccccaccatcaaagcctggcgctccccacgcaccatgcgcgtcctccagtcacctcgcccacggcctcacaccttcttctcctggcttgccacgccagaggccctgaggtcgtgctggagtgcactggagccaccgggaccccttgaggacatcgccagagctctgtcgactttttcccgagcgggagagttcggagatgcttatagcagttacgccttaggaaggggacacaccaggccccgccacacgctcacacacaacctgctcacgcagctggtgatgct

SEQ ID NO: 624487 - DNA, 2505 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccagcctgggcgacagagcgagactccgtctcaaaaaaaaaaaaaaaaaaaaagcaatgatgtatgtatttctccttcccccttcatcacccccatctttttttccaaatccaaatgcacatactctttgatagcaagatatgcacactgttctgttcctggcttttccaacttaacattctgtatcttggaggtgactctatcttagcacataaagagccttgttttatttttttaacagcttattggttattgtatacttatacaatcatttatttgtaggcattgtgttatgtccatttgtttctattataaacagtgctacgatgaattgccttataactatatcattttacatgcgtgagaataccttagatgcagcattgcctgatccaaggacgcatgcattggtaatgttgccatgtatttcaaattaccctccatgtatgtttcttaatccttaatctctctttaaaatgctaacaagagttgttttaactaatgcggaagttggtttatctcacatccttctcagccacctgatcaagcctacgtaatcaagtcattcatatgctcactctcctcgtcatcacccccgtttgtgggtccgcaactcttcaggcagggtgcacccctcctacatcggcaagccctctgcagcaaagccgagcagtatccaacagtctctagggatttccctgacattccactttccccttccctctgagctgctttttacattttattttattcaccttctattattttatttattttgagctcctgctgcacccctgactgtcatcatggctcaactgccgaataccatgtgtttcatgtaaagctgatatatgccatagagacaccatcgattcgaccttgatttaggaaaaaaactttacaaagatgaagaaacatttgaatctgaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaat

SEQ ID NO: 624488 - DNA, 871 bp, Homo sapiens
  misc_feature (509)..(509): n is a, c, g, or t
gcaccgtcagcccttatgctactctcactgtgggagatagttgctcataaaaccaaggagtaattatacgcaatacttcagacaccctgtctgggatgagagtgcctgctcttggactcagtgcaggaaacgctacacacatgagaagcctagagtagcgggttcggggtgagggcactggactgtgcagggtctcattgatccctgacaccctcgtcagagactcgctcggggctgaccacgctactagatgtggaccgttggttgtacagctcagacaagtgtgtcagagggcgaaggtgctactggatgaagctagatgctaaggagatcctggaagtcccagcactcgggacgtggaagctcatagcgacagctacagccatagctcctcatcgctgagtgaatgaaccaggagctctgcggagggacccccctcacattacctcttcagccccagagcgtccagtgcagagcacttaacagatgttggacagtccgcactatgnaggtgtccagcgcggggctcgtggagccaggtgaatacttgattctgcgggacctaccagtggaagaacgaaagctaggtcgagcattgttcatggtgtgctggtgtcccgttatcgacagaatggaccgtgtatcgctcctgatctctatgtgtcaggtggggtattggcagacaagaagcgaggtagcaagaggaggactctcagtgtaagaagaggaccctaggagtcctgaatttcatgagacgggttggggtggggaatcccgcctgggaatgaggcccaggagaggaaaagtggggtgtatctggcagtctaatttcctcctttatgttaagaaaagtggagtgtgggggaatgtg

SEQ ID NO: 624489 - DNA, 103 bp, Homo sapiens
ttgtacttgctgagcctgtatgggtgtcagggtcagtctagtgacagcctagagaggcggggacgaggggtgcaggtgcacagtgagcaccgcatctttacga

SEQ ID NO: 624490 - DNA, 113 bp, Homo sapiens
tccaaatgttttaaataaggcatgacttttttcggcctgttttaactagcaaggactagggaaggtatttttataaacctattatgataataaatttgtccctatttccctta

SEQ ID NO: 624491 - DNA, 189 bp, Homo sapiens
tgtacccgtcgtataagggccacagaggagtgtatgtgccatcataggatgctatgtgcacgtgagtttcgcctatactgcgagtgctgaatcgctagaccaatagtacgccagagtccattagcgtagtcatattcatcggggtaaatcgtaactttgttcccgcgacacttgcttggccgtatcggg

SEQ ID NO: 624492 - DNA, 500 bp, Homo sapiens
  misc_feature (40)..(40): n is a, c, g, or t
  misc_feature (46)..(46): n is a, c, g, or t
  misc_feature (281)..(281): n is a, c, g, or t
  misc_feature (284)..(284): n is a, c, g, or t
  misc_feature (354)..(354): n is a, c, g, or t
  misc_feature (400)..(400): n is a, c, g, or t
  misc_feature (418)..(418): n is a, c, g, or t
ggtcttccatcacccttaattattatggctgctgaggtcntccccnttccagatcccaacaatggaaggtgaagacaaactgagaagcaggcatgagtcaggtgccattgtggtaaagctgtctgttcagcagagggaggtacccaccaccatgcacctaattaatctcaacaggggaaaaggaggtttcatggtagcacagaagatcgtcttcctcttatgggctacaacacgtcccctctttaacaaggaatcagccttcatagacattccatcgcaancancccccctccatacatgtgatccctgtccatgaaatggtgacgtgaaataggaacatactcttcatctcanagtcaggcctgagcatctgctgtgagataccagacaggatgaagtnggtctgaagaaatgtgtntccacgaaagggaaaaaaatacagaacaactcagaaacaggagtcttagcttggttgaagcataataaatttagggtcgatg

SEQ ID NO: 624493 - DNA, 277 bp, Homo sapiens
  misc_feature (12)..(12): n is a, c, g, or t
  misc_feature (237)..(237): n is a, c, g, or t
  misc_feature (252)..(253): n is a, c, g, or t
gggcttacttcncctcctgcttccccgccgcggcgccgccaattcaaaattttggaaacgggggtggaaaaaaaaatttccgggttggacaacctttttggcccaggcccgtggcatgtgctggcaaccaaatcggcgccaagtttagggaggtgatcagcgatgagcacggcatcgaccccacgggcacctaccacggtggacatgcgacctagcagcgtggaactgcatcaacgntgtacgtagcaatgnnaggccaccgtgcgtggggtccccc

SEQ ID NO: 624494 - DNA, 107 bp, Homo sapiens
aaggttatattttggtaactttcacacatattttaaataacttaagaagaaaaatatatatattatatttactcagatatgggccatttctgtgggttctccttcat

SEQ ID NO: 624495 - DNA, 884 bp, Homo sapiens
agaagtgaaacaagagatgaacggaatgttgcttgaaagaaggaactctcaaagttcctcagccctaatctaaacacaaattgcacttagaggttactggggggagggtgcggtcgtgagggttcacatttgtccagcaatggtgcaacactgggttgagtgaaaggtagagacagtgacctccactacaccccgagactctcacccccgagtatgtagtggaagccctaccagtccactcccatcccctacaatagcatgactgatgaggccggctatataggtcctgagtctgtggaagtcactgcgcggccagtcccccgtcacgtcacgaccgtgcaggcgcctttcgagcaagacgcagctggcgggaaaggagacgtcccctcatcccgagatggtgacccgggcagggggcgccccctgtccttaagttcccgcgtcttctattccgtcctgtccgttgccgtcaagtacccggatcgatcaacgctacgggaagatgtcttgtagttagtaaggcttggcagcacgcgagagggtgtgttggcctgttcccgggggttctttccacacgtggtgagaggacccttgtgccgtgaggcccccgcgttaatctgcaagctgtgctgtcctccgtcggacgcgggatcttcccctgtctaagatgtcttctgtggcgtctcgaggcagagctgcagccgggctcgcccatgtccgcaggccgggggcgggatcaagcgcggggctgggggtcaacgagcacttcctcctcccagccggggatccggggcttctccaggattctccgtggcgaggattccgggtgggggtggggaatcccgcggcggttccgccccgccaggcaggggcgttggcgactg

SEQ ID NO: 624496 - DNA, 467 bp, Homo sapiens
gcgaaggtatggatgtctggcgacattgcgcggggcaaactgcggcgccagctcgatatcacccgcccagccggcaggtccatgtacagcaggttggccgggtccggggtgcgccagtcgctggcggccgaagcgtccaggatctgctgcgggctgcggtaaggcgaggccgcgctggccatggtgggcaacaggcaggccagggcgagggcggtcagggcaaggcgacgacggtgcggcatgggaaccccggaacatgaacgaggcttcgattctgcgcgagcggcctggtctcgccaaaccggcactgatgactaaacgacactattcgctattcccgaatttcgcactaactgtgaactacaagcgtagttggagggccggtcatgtccgagggacgatgtccaccgtgaggaagtcccagaaggacctcagcgccggaacggtgtcgctggcccttgctgcgg

SEQ ID NO: 624497 - DNA, 300 bp, Homo sapiens
  misc_feature (241)..(241): n is a, c, g, or t
  misc_feature (265)..(265): n is a, c, g, or t
  misc_feature (290)..(290): n is a, c, g, or t
cggcacgaggaaatcttgttagaaactggcatagtgtacggacttaagagcacatatttgcgtgccagaggtactggatttgattcttaactctgctgcttcctagcttgatgaccttgaacaaggttttaaagcagtctatgtcccagcttcctcacctgtaagatgagctgatattaaatagtaccctacaaccattggagtcaaatgtaagggattaaagtcattggggaaggtaccntataacagtacctttggcatcctnagttaaggcccctaatggtaaggtngtttaatgta

SEQ ID NO: 624498 - DNA, 900 bp, Homo sapiens
  misc_feature (551)..(551): n is a, c, g, or t
gcagtcaggcgcatctgcttttgcgtcgtcagccgagccatatcgctcagacaccatggggaaggtgaaggtcgtgattcaacggattaggtcgtatggggcgcctggttcaccagggcttgcttttgaatcttcctggtacacaggtggagtatggtgggcacattcgaagtgacgcctcgtgtcgattgactcttctaagcgtacgagtgagttcttacattgatttcctaaatgatcgattcgctagccagtggcaaatatttccattggcaacgcgtcaagagggctcgagaacgggaggaaggcatatgtccatgcgaagtggagaaatctccaatcaaccgatcattcgccaggagcagacgatcacgcatccgaaagatcaaacgtgaggggcggatggcttggcagcgtgaagtaccgtctggtggacgtccgaagcgtgggcgttgcttcgaacacacctattggagtaaagagactggggggaactcacttatggcaaggaggcgggagcacaatataggggatcaatgcgactctctggncccacgcgtacgtagacgtgaatggcacacctcagtggttgctgtccactggaagctcggttagtaaaccccatcgtaagaacacgtcaattgtaccatatcaagcccttgcataggaattgccactaccatgagcacaattgtctcgtcacttgggcaacacgatgcgaaagctcggtcgtatgaggccaacctcgaccgtgggggccctacagggggttcgatccgctagttgggatccgatagcgtgttagggagtaagtccggtggcggacaggggaacgtccgatggaagcccgagcaaggtccccaatgggccccatcccagcgtgggccaacacccaggaaa

SEQ ID NO: 624499 - DNA, 742 bp, Homo sapiens
cgcctaataaccgtggggtgctactcgctctgggatgtccgtttggggcgcatgtgtggtgtgtgccggtatttttggggaattcccctgtggttgccgccgaaattcttgcgtgtttgtggaagctgggcttgttcaccgggattgcccgttggtcgcggtgttcccccccgcccgtccccgcgcgagtctagtgtgtgtgccgtgggcgtgtacccccccctcttttggggcacaactggtgataatacgacttccccactgatccataacgggcctcctcgggacattgaattaatacttgttaattgttcccccccaaatgtcaactgttcatgttcatgaattcctcttttatccaccagtttccgcagcgcaaacttgtcctttaactcgctcctccccaccgcggaataaggtgggtaataatttatttcctcacaccctgttaagtatgataagtaacacaaagttatgttttattccccctttcgcccacagttcacaccgcactcattgtaaaattggaaagaccccatgggagactgccactactggttgttaagcacccgcgtcttcttatgctattcccgcgggtggtttttctcgcactcaccaccactcgcaccactattttcgcaactgctcgctcctcctctctaatttttcttctcctccccacaccgaggtattatataattctctctctccttcttatcccccaaaaaaacatatatacaag

SEQ ID NO: 624500 - DNA, 218 bp, Homo sapiens
ttatggaggtcagcacggtagctcacgtgtcgacggaacttgtacagtgtaggcatgcacctgcagtggtgaatacacgtcgaccaggctccatgcttgcgatctttggtggtcgtcgtggagctcatgtgtccacggaacatgtaacaggaaggaatgcagcgcagtggtgaatacacgtcgagctggaggcatgcatgcgtgctcgggtactggaa

SEQ ID NO: 624501 - DNA, 278 bp, Homo sapiens
gcgcatactgaccatcggcaccttttctggagccatcaagctctacggagccagaagcgtctagttcatggggatgcaccacgagaacaaactctgtgacgcagatccacctcctgcccggccagtgccagctgatcaccctgctgcatgacaacagcctgcaccttaggagcctgaagggcaaggacgcaacatcggagctgcaagaggatgagagcttcacactgagaggacccccaggggctgcccccagtgccacacagatcaccagtgccctg

SEQ ID NO: 624502 - DNA, 208 bp, Homo sapiens
agggtgcaggagaaatcgagagcagcatgccattgtgcaagacctatgatcagcttgcgataagaaacaggaggtgcacgtaccaaccaattatctatggcagcatgcatgtataggccgaactattatcagctctgatgtcacagagagcagaccgtcagacaccgaaagcaaaccaccaccctcctatggtgtctgaggtctcacg

SEQ ID NO: 624503 - DNA, 136 bp, Homo sapiens
ctagcaggttaccattcatagagcccacggcatgggtgtagggaggtagtaaataagggacagatgaaagaggtggaaggaccctgcagtgtcaccctgctgaatgtagaccctggtggctgttgctagtttctag

SEQ ID NO: 624504 - DNA, 91 bp, Homo sapiens
cccctgtaacagtctatgctacagactggctctctattgcaaaattcatatgaataacataagagccaaaaaaaaaaaacaatttcaggtt

SEQ ID NO: 624505 - DNA, 256 bp, Homo sapiens
tcagaagacctctgggcatatttcaaccaccgctagaggtatagccacacacttagctcaaggacgattgggaatagggaaatcatgtttctttatccctgtggcgaggaaggcaaggggtaaggggtgggtaacacgtgctggatccaagctggcatacaggatctactaccctatcctcttaacccatctgactattacgatcaggatgcctcgacacctatactgaatatctgtctatatgaagactctagtg

SEQ ID NO: 624506 - DNA, 2034 bp, Homo sapiens
  misc_feature (617)..(617): n is a, c, g, or t
  misc_feature (1156)..(1156): n is a, c, g, or t
actactgctaagtgcttgtgtaatgtaagactatttatcacaacagacggcatgtagtatagcatcaacatgtggtagcaagcctctgcttcgacatcaagcacaatactatcactgtgagaatatagcttggtccttgtgtaatagtgatttggagagcgaacgcgtttatcatcaggatacatcatgagatgcacaggagcgaggcaagctgtaaagaagtccgaccgtcttgtagcgcgcatgcccagtgagatcccatcgctgttcctcaccgtggaatgcaaggaatagagtatgttctccgtgttccatgcagagcggtgccttgcatgatgaacacatgaggctgtgtacgccgtgactgccttctagatgcaacgccccgcatcacgtcttacactatagggggactccccaataggtacatgagtgcgggggggtcagaggcctagtgttccactaggtgcctggagcctatcttggtgagatgctcccgctcgctagctctctcgtgcgagaatatcgctagcgcgcgctcacttgatgggccctagcctctagatatcgtttaccgagcggtataatcggttaggcgcggtgctcgctatgcattnacaccagttcgcgcacacgcccggctagtcgggatggtcctccgcttttaaccgcattgtgtagagtgcttctgagaacattcttaccttgagcacaaacattcttactacaagagacgcactggtaccagcttacattactttcgctacaccatacttaaaatttctggggtccaacgaggccaccacgaggttgatgccttccaatgagacgcgatacgcttaaaaatactcacgagaagaccacatcttttggagtggaatgagagacccttgagagcgctggggcgctttgaggaatttcacaatctctcctggcatcatcatttccaatcgcgcacggatgtccaaaactcacaatcgaaaggatcccgcaggtgtaaatcacacaacgcgaggttggcgctcaatatagaaaccccaaccgttcgatatataaatcccgattatgccggcgtgcacaaaataagacagtgaaacgcccatttcggcgcaggcatcggcactagcgcacatggagccacacacgttggcacacncccacatcggctatacatcatccccgcctaagatccacaccgacctttcgctcgcgaaaagctggtcctcggactgtcgcccagtagtgcgagcaacggcgcgcctctgctaaaagcccgccaacccgcacgggggccagcaagccggtatctgcccgcagaacgacagtacccaaagtcacagtccagctcgagccgacctctgcgacgacacattcccaactcccacacaggagtggcacgccccccacaacatcctcgcactacgcacacaccgtcgattacgcgcgccaaccagccgccgtcgacaccacgccccaacaccatacgtggggacgcgcgtctcccgctcagcactcggcacaaacaaacacttcaacgcacacggcgagccaggtcggccgccatcagatcagactacagacgcgccattgacgcacagccgcttcatcacgacatcgcgcaccagcaaggtcggcgacccccccgcatagcatcgccgacacacacaccaccctccacgccccgccaagacacctcggccccggtccgtgattcaagacaaccgcgcgcggagcaagagcgcaccaaccctgctcacgcaacacgcccgcgacttcgagccgcgaccgcgtccaccatcacgcgggcagccgcgtcatcaccgcgctcgcagcgagctcctaggacacacctgcgcgcgctgcccgagccctcatcacacaccccgctcaccctggatcgaccacgccgccgcgcgccacgcgaggactcaccactcgcgagcgaactgaatagccgcctcaccgtcctcgacgccgcccgcatgactcccacagccggccgacgctcccgcgccccgtccgtacccccgctcc

SEQ ID NO: 624507 - DNA, 226 bp, Homo sapiens
cagagtggcgagagtaaaggggtgtacaggtagaaaaggttgcccaggccacactagaatcggtgaacacatcagtactagtagactgtgacgagtcacatatgtatatggttatacctagagcaaccactcagaaaactatccaaagctgtatgatcaaaaacactataagcctgggcatggtggctcatgcctgtaatcccagcacttagggaggctgaagcaa

SEQ ID NO: 624508 - DNA, 433 bp, Homo sapiens
tttaagatcccactcggtgaccaatcactttaaaagcaatatgccaaagaggaacttcataaggagtatgcagaagacaagaagcttttcggacagctatagtttataaattcagataacgtttaatcaaatatttttacagaatattttgctaattatttttcggggagaaaaatatcacgatacgcaacttctaaagccaattcctactccggatatatgagatagtgcgctaccccaagcatatcgggtatgaatatgtgttcagagctgtgaggatttaactctgtcttgagaatacatattcttggtgtaatatacattatacattcatagaatgcactgttagctatcataaaatcagtcgataatttctgtgtactagaatattgtctcctatctaatttttccctttctttaacttcttttaagg

SEQ ID NO: 624509 - DNA, 490 bp, Homo sapiens
  misc_feature (450)..(450): n is a, c, g, or t
cacggcgactcgaagcggcacgcgcctatggcctgcatggctggcgcctgacctgtttgtggtggtaccggccgcgttgcgccgggcgttgccggcctacagcaatgaaatgatcctgatgctgcacgccacatcgctggcgtttaccgccaccgtcgccgatatcctcaaggtggcccgcgatgcgaatgccgagacgttcctgacgttccaggcctttggtatcgctgccctgctctacatgctgctgtcctttgcactggtgggcctgtttcgactggccgaacgtcgctggatgcgttttcttgttcctacccgaggctaacccatgaatcagtccgcgcaggccctggccacttatcctgtcgatgtccccgctacacgaacggccacggctgccgtcaagctgcaggtcgaaggcatccataaacgctacggcgaacacgaagngctcaagggcgtgtccctcaacgcacgcaacggcgatgtg

SEQ ID NO: 624510 - DNA, 1777 bp, Homo sapiens
aagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatctcgttgtagacgtggacaaaaacattgacatcaatgatgtgacacccaattgccgggtggctctaaaggaatgacagctacactctgcacaagatcctgcccaacaagggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctcaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtca

SEQ ID NO: 624511 - DNA, 874 bp, Homo sapiens
ggacgcgtgggtgacagcgcaggggatgacgcccaattggagaggctgggatccgcaatgggagctgatcgtacgtgtgtgcgtctccaatgcagttggctgtggaccctggagtcagccagctggtggtctcttctcatgaccgtgcaggccagcagggccctcctcatcaggccgcacatcctgggtacctggtggtccttggtgtgctaacggtgcctggtgacggctgctgccctggccctcatcctgcttcgaaacgagacggaaagagacgcggttcgggcaagccatttgacagtgtcatggcccggggagagccagccgtatcacttccgggcaggcccggtccttcaagtcgagaaaggtccgagcgcatcgaggccacattggacagcttgggcatcagggatgaactaaaggacaacatactggaggatgtgctcatcccagagcagcagttcaccctggggccggcatgttgggcaagaggagagttgggtatcagtgcgggaggcccagactgcaagcaagaggatggctcctttgtgagcacgtggctgtgaagatgctgtacacagcgtgacatcgattgcctcgaagcgacattgaagagttcctcagggaagcagcttgcatgaaggagtagaccatccacacgttggccaaacttgttgggggtaagcctccggagcagggtctcaaggccgtcttcccatccccatgggtcatcttgcccttcatgaagcatggggacctgcatgcttcctgctcgctcccggatggggagaacccctttaactagccctcagacctgatcggtcatggtggacattgcctgcgggatggaggaactgaactctcggaattatca

SEQ ID NO: 624512 - DNA, 100 bp, Homo sapiens
cgtaatgtacaaaaagcatatgtgacatttttgctactagtctgatttcattaatatccatgagattcagaaaactccctacagtcagaacgggcctaat

SEQ ID NO: 624513 - DNA, 1658 bp, Homo sapiens
  misc_feature (8)..(8): n is a, c, g, or t
ggacggcncggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatctcgttgtagacgtggacaaaaacattgacatcaatgatgtgacacccaattgccgggtggctctaaaggaatgacagctacactctgcacaagatcctgcccaacaagggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctcaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtca

SEQ ID NO: 624514 - DNA, 443 bp, Homo sapiens
  misc_feature (1)..(1): n is a, c, g, or t
  misc_feature (387)..(387): n is a, c, g, or t
  misc_feature (432)..(432): n is a, c, g, or t
  misc_feature (437)..(437): n is a, c, g, or t
natttcgcattggagcactttgtatttatttgctgaagtaatttttgtcatttttttcagaaccagaatatttcacaaaaagtttccatgtatttcttttgtatcatacagttactttaaaaaaaaacctgtagtgatcttggcactgtagctcccctgtaatcccagcactttgggaggtggaggtgggaggatcccttgaggccagggaattcgagatcaacctagggcaacaaagcgagatcccatctctccaaaaatttaaaaattagccagggcgtgggtgggtacacatctgtagtcccggcttacccaggagggctgaggtggggagcatttgctttgagcccggggagtttcaagggctggcagttaagttcatggatncatggcaacttgcacacccagcctcggttgacccaagcgagatantgttntccaaa

SEQ ID NO: 624515 - DNA, 348 bp, Homo sapiens
ggggttttagcccccccccccccaggggggggggggggttggccttcccccccaggggggggggccccttcctttgggggcaaaaaggggcccctcaccagggaaaaaaaggttttcccggcccctttttagggggttttgggcctttttcaaatccccgggttaaggggggcggccccccccaagggccaaaaaaggggggcccccccgggccccccattggggggggggaacctttaaagggggtttaaaccccgggggtttttgttttttggggttttttttttttttagggggttggggaaaaaaaataaaacccccgccccccctttaaccgggtttttttta

SEQ ID NO: 624516 - DNA, 1270 bp, Homo sapiens
  misc_feature (8)..(8): n is a, c, g, or t
ggacggcncggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcatgtgacacccaattgccgggtggctctaaaggaatgacagctacactctgcacaagatcctgcccaacaagggtagacccattagtgtcactgatgatggtggagaaagtaccagattcaacttatgagatgattggtggactggggacaagatcatgatcatacgcgcaagatctaagagagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtca

SEQ ID NO: 624517 - DNA, 1318 bp, Homo sapiens
  misc_feature (8)..(8): n is a, c, g, or t
ggacggcncggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaaggcctggcaagaggcccgaaaccccaaaaagggaggggaacgaactaaatgctaaagttcgcctattgcgggaggaggctttacaaggcccattggcctttgggcccaaagggggaagtccaggggctcctatgtgggggaagtagtccgggccatggataagaagaaagtgttggtcatgtgacacccaattgccgggtggctctaaaggaatgacagctacactctgcacaagatcctgcccaacaagggtagacccattagtgtcactgatgatggtggagaaagtaccagattcaacttatgagatgattggtggactggggacaagatcatgatcatacgcgcaagatctaagagagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtca

SEQ ID NO: 624518 - DNA, 230 bp, Homo sapiens
ttttttttccccttccccggccccggaggaaaaaaccgggggggtccttttccccccccgcccggggggggggggggccttttttttgggccccccccccccgggggggggcccccccccccccgggggggggggggggggggggccttcccccccctttcccccccggggcccccccccggggccttggggggggttttttttttgttttttttgggggggggggggga

SEQ ID NO: 624519 - DNA, 187 bp, Homo sapiens
acttgagaacagtaatgaacaattattgtactgaacaacttgttacgagactcgctgatcatcaaacaacctgtgtgcactatgatctccttacacacgtagcacccttcagcaggaccctataaaactttcctccagcccttgcctctttgcaggtagccccttctctgctgagctgcccactgca

SEQ ID NO: 624520 - DNA, 707 bp, Homo sapiens
atgggagctggggagcgtcaccccatcatcttcgtttctggacaggagcaaatcagactaaccgaaggagctggagtgtgtgactcgaggcagttctaagatggtagtggcaaagacggcagagacacacagcccatgataagccaaagggcagtctcccgacagacgcgacgaggctcgtgtgcaagacttcgtgaatcgagggcaacaagttcgaggcattactaggcataggcgaatttccggggatacaatttgtcaaagccaggaatcagctagggccagagtgaccattggcagatcgttggttgcacggacttggaggcgtcacaggacacgagtcaccttaaccaacgatgatctgatgatagccacataaccaaccaaatggaatcgcctcgcacaggagcaaccaacaggagtatcatcacttgagaaagataccttggccgttacgacgatgaatattgctggcatcggatggaatatcgagaattggggccttctgtgagtaacgcagggccgctccaagacctcggtgtcgactggtggagggtttatcacgaagaacgaaacaccgtccgtggggaaaaatccactacgcacattaacagggggcgcgttggggccacgacagcaagtactgctcatagaccacttaattgaacatacaaggacccaagtgtcccgtgctagacccagttcaa

SEQ ID NO: 624521 - DNA, 872 bp, Homo sapiens
gatttctcgagattgactttcacagcacacacgcgggggcccacacacacgcgggagaagggtgttccatacgaaagggatgtttctctcccgcttgggagagctcgttcgtcgagatattccacacagcttgggagtttcgggagatctttggagttccacagagagatatttcccaaacagtgtctccacagcgtgataattccacctgggggcccaccacactactccgcggagggccacagatacaccccccctgcgtgagttttccgcgggcccctctggtctttacgcgccccaagagcgacgcgctgctgtggggacccgcgtttgaaaaaatatgtcagatatgttataccagcatcttgcgctcgtgatcaccgcgccgctccccgcagatagagagatagttgatatattgttcgtcccactctatgctcactcgtagccactagagatgtggcaacactctctctctcggagaggagaggtttgtgatcttaggtgaaagaactcatagtggcccgcgcccgcgatatagaatttttcacgggagagctgatatatataacctccctatctcgtgctagcggagaggtggggaatattgggctggtccactggaaaaccccttaccattgtcctggcaccagagactttcgagcaaagaccatttaccagagactgtccataccaagaaagcgacgcagcccgggagcactgaattttacacaatgacccttcccttccctcccccccccccctcacggggctggggctttttttgcaccccccgcacctttgtcccccaacctcaatcccctttttttttaccccggaattggttttttccataaataaataagatccga

SEQ ID NO: 624522 - DNA, 1251 bp, Homo sapiens
gaaagccatccaatgtttccagagcacaggcagcaacacatcaaacaacccaaagcgcaagccagcagttatgggcaatttcagatcgtatacggaatcaattctttcatccacaaacccagcatgcattccaactgcaggcacatgcacaggcagcatccccacaaagtggaagtggagcaacaacagtaacaacttcacaataggaccattactgtggccagtgccagcagtgcaatacgtgattacacgcccaagtccactatgacactgacatccctcaaaatcacagcaacggcagcaccatcatcagcacattcatttgcaaaacacccaatggggcatgtggcaccaggaatgttgcaacaatcaaaagtgggcaacacattcaacattcatttcatgtggatgtcatctcagcaagaggaagcagccccccaagaacactcagacggcaaaaccgaaggagtcaacagcaccgacagatccacaagcactctgcaggagtacctagagaggatacatctgccaggaaataccactcaaccacctcataggctccactgggttactgagaacctcaacacagactttaccacagactataacacagaacgagtaagctacaatagaactaacactacttgaacaaaccacgactgacccgaagacccgctactaatccacttattgaacaaaagcactggaaggcaagcaacatattcaaaggacagccagagacacagtggaaccacgggaggcaccaaaatccgatcggagcaacaagacaaatacaaaggaaaacgataggacccagggtcgagctgcaccggcccaagggaccacctgggcgggacaccgctaccagcccgggcacaagccagcgacacggcaccagacggctcaggaacacacgaaaacgcggcatcgcacgggacacgaacgaaaggaaaatcacaggagcacagagtacgagaaagagcggtccaagcaaatgtcaactaagaatagaacagaaagcacaagagatacacaaggacaacgagaacgaagacgcgcagcgcgaagacgcacgaccgtggcccgcgccggaaaagaatcaagacagagagacagacaacgaactcgggagagtgcaaagaacaaaaacgacgacgaaaacgaaaggaaaagcgatcgtgatgacacacacacgcctaaaaagaaaagaagcgaagaaaggagagagcgcagcagcgaaggaggaggagg

SEQ ID NO: 624523 - DNA, 410 bp, Homo sapiens
ggtcacttggctccgggggctccgctcgcctgcccgcacgccgcacgacaccacaggaccgcgccgccggacctccgtccgctaacaaacccttccgacggcagctacgctgcgcaacgccgggacgccctccatacccaactcaagaagccacgacgaaggaaaggttaacgttagaaagaaggggggaacagaagggggcagccgataggacgatgagtgaagggacggactccaacgcaaagggaagccatgagagtgagacccaggaaacaacagggagacgatgatatagaggaaagcgtatgaaataacgaaaagagacagcagaaagtccacacgtgaattgagaacaaactacgaaagagactataagcaaacgtgacaatacaagaagaagcaaaaagaga

SEQ ID NO: 624524 - DNA, 105 bp, Homo sapiens
atcaggcgaagactgtgactgaggtagaaaatgtagcccatttcttgccaactcatgggctacaccttgacctaggctgtctgtagcgtggtgtacttgcgctta

SEQ ID NO: 624525 - DNA, 230 bp, Homo sapiens
ggcgacgggacacgatctccaatgctgggccgctccttcacacgcgcccggaactactacgctatgggctcccataccaagttcgtagcagtgcccacgactaggggagctaccagacaacgcaaggcaggtggtagcccactgtagtcactgcacgatatcgacgtcctcaactctcgcacccaggtcttcctggtgctcttctcaaagtgacaccagggaaagatcaa

SEQ ID NO: 624526 - DNA, 273 bp, Homo sapiens
  misc_feature (44)..(44): n is a, c, g, or t
  misc_feature (238)..(238): n is a, c, g, or t
  misc_feature (257)..(257): n is a, c, g, or t
  misc_feature (264)..(264): n is a, c, g, or t
tgaaaccccgtcactactaaaaatacaaaaattagctgggcgtncgtggctcacacctgtgatcccacctactcgggaggctgaggcaggagagtcacttgaactctggaggtggaggttgcagtgaggcgagattgcgccactgcactccagcctgggcaacagagagagactccgtcttaaaaaagaaaaaaaattgaggtaaaatacatgtatcaatatatgtacagtaaaaggncaccaattttaaatgcttnagcttgntgggatttt

SEQ ID NO: 624527 - DNA, 826 bp, Homo sapiens
cattgatatgaggcactaagagtagcaaaattcataagagacagaaaatagaatggtggctgccaagggctaggggaagaggggatcagggagttagtgtttaataggtacagaatttctgttggggaagatgaaaacattatggagatgggtggtggtgatggttgtacaacaacatgaatgtacttaatgccacaaaactacactaaaatacggttaaaatgttaaattttagcttatgtgaatattttaccacaataaaacacacatacagaatgaaattctgatacatgctacaacttggatgaatcttgaagacattacgctaagtgaaataagccaggcacaaaagaacatatagtgcgtgatttcacttaaatgaagtacctagggcagtcattcagagaaagcagaatagtggttggcaggagctgggggaaggaggggatgtagagttactgtgtaatgggtagagattctgtttggaaagatggagaaagttctggaggtggatcatgtagtgatgtaatgtacttcatgtactgaaatgctacagccaaaatgtgaaaatggaaagttatggtatgatattctactggaattaaaaaatagcatatcaggtgtccctaattttaggtactttacagtggggagcctcacataatagtttagaacattcatcctggggaagatctaggcattatttaaccatgctcaggcaatagaattgtctaaagatagggcgggtgataaggaaggaaggggggttacaatgaaggggggaaagaggggtgagaaaaaaaggtcaagaaggactgtgtgtttt

SEQ ID NO: 624528 - DNA, 369 bp, Homo sapiens
  misc_feature (139)..(139): n is a, c, g, or t
  misc_feature (166)..(166): n is a, c, g, or t
  misc_feature (205)..(205): n is a, c, g, or t
  misc_feature (220)..(220): n is a, c, g, or t
  misc_feature (224)..(224): n is a, c, g, or t
  misc_feature (232)..(232): n is a, c, g, or t
  misc_feature (272)..(272): n is a, c, g, or t
  misc_feature (283)..(283): n is a, c, g, or t
  misc_feature (298)..(298): n is a, c, g, or t
  misc_feature (315)..(315): n is a, c, g, or t
  misc_feature (351)..(351): n is a, c, g, or t
gaaccttaaaactcctcggccaggctccaaacccctgcccttgcaaaaacagaaacagctcacttccccctcaaggaatggcctgggagccatgttttctttaagcctaagcttcccccccaccacaggccctttcctnaggcaaggtttggcctcaggtgggccncaggcgggaaaaacagcccttggccagaagtcaacccanccacgtggagcctanagtnagggcctnaggtttggctgcttgcccccatgctggcgccaacaacttntccatcctttntgcctctcaacatcncttgaatcctagggccngggttttcatgtttttgaaacagaaccataaagcanatgtgttggcttgttgta

SEQ ID NO: 624529 - DNA, 537 bp, Homo sapiens
gagtgcagtacaccctctaaatcaccacgatcacaagggacaagcatcaagcacgcagacaagtgcagcatacaaaacagcttagcctagcacacacccccacgggaaacagcagtgattaacctattagcaataaagcgaaagtatacactaagactatacataaccccagggattggtcaatttcagtgccagccaccgcggatcacaacgatataacccaagtcaatcagaagccgcgcgtaaagagtgttatagactcaccccactccccaagtaaagctacaactcacctgacgttgtaaaaatactccagattgacacaaacctagactacgacagagtaggctttaacattatctgacacacacacatagctaagacccaaactgggattagataccccactatgcttagccctaaacctcaacagttaaatcaacaaaactgctcgccagaacactacgagccacagcttacaactcaaaggacctggcggtgcttcatatccctctagaggacgctgttctgtcatcg

SEQ ID NO: 624530 - DNA, 443 bp, Homo sapiens
  misc_feature (139)..(139): n is a, c, g, or t
  misc_feature (166)..(166): n is a, c, g, or t
  misc_feature (279)..(279): n is a, c, g, or t
  misc_feature (294)..(294): n is a, c, g, or t
  misc_feature (298)..(298): n is a, c, g, or t
  misc_feature (306)..(306): n is a, c, g, or t
  misc_feature (346)..(346): n is a, c, g, or t
  misc_feature (357)..(357): n is a, c, g, or t
  misc_feature (372)..(372): n is a, c, g, or t
  misc_feature (389)..(389): n is a, c, g, or t
  misc_feature (425)..(425): n is a, c, g, or t
gaaccttaaaactcctcggccaggctccaaacccctgcccttgcaaaaacagaaacagctcacttccccctcaaggaatggcctgggagccatgttttctttaagcctaagcttcccccccaccacaggccctttcctnaggcaaggtttggcctcaggtgggccncaggcgggaaaaacagcccttggccagaagtcaagcccagccacgtggagcctaaagtgagggcctgaggtctggctgcttgcccccatgctggcgccagaagtcaagcccanccacgtggagcctanagtnagggcctnaggtttggctgcttgcccccatgctggcgccaacaacttntccatcctttntgcctctcaacatcncttgaatcctagggccngggttttcatgtttttgaaacagaaccataaagcanatgtgttggcttgttgta

SEQ ID NO: 624531 - DNA, 383 bp, Homo sapiens
ttccgtgggtttcctccaaacccttggccaggagggtttttgggtttgcaaggtcccccaattttccccggaaagtccggagggtaaatggattttttcccttataccttccccccccctttttatccgttgtgggaggaccgtttccggaatttttttttcaaatggcccctttaggtttgttgtaaaaggctgggttattgttaccatgccttgttaaaccctccggagggaagggggatttttttttggcccccttgggtttcttttttgggggtggccggtttaaggtttttggtttttaaaacccgtcctttttattggaaccactttgcccaaaaattttccccggatttttgggcccccttaaaaaggttaattga

SEQ ID NO: 624532 - DNA, 760 bp, Homo sapiens
  misc_feature (179)..(179): n is a, c, g, or t
  misc_feature (283)..(283): n is a, c, g, or t
  misc_feature (289)..(290): n is a, c, g, or t
  misc_feature (351)..(352): n is a, c, g, or t
  misc_feature (368)..(368): n is a, c, g, or t
  misc_feature (386)..(386): n is a, c, g, or t
  misc_feature (395)..(395): n is a, c, g, or t
  misc_feature (410)..(410): n is a, c, g, or t
  misc_feature (422)..(423): n is a, c, g, or t
  misc_feature (444)..(444): n is a, c, g, or t
  misc_feature (446)..(447): n is a, c, g, or t
  misc_feature (460)..(460): n is a, c, g, or t
  misc_feature (470)..(471): n is a, c, g, or t
  misc_feature (477)..(477): n is a, c, g, or t
  misc_feature (480)..(480): n is a, c, g, or t
  misc_feature (491)..(492): n is a, c, g, or t
  misc_feature (498)..(498): n is a, c, g, or t
  misc_feature (518)..(518): n is a, c, g, or t
  misc_feature (521)..(521): n is a, c, g, or t
  misc_feature (532)..(532): n is a, c, g, or t
  misc_feature (534)..(534): n is a, c, g, or t
  misc_feature (576)..(577): n is a, c, g, or t
  misc_feature (593)..(593): n is a, c, g, or t
  misc_feature (598)..(598): n is a, c, g, or t
  misc_feature (611)..(611): n is a, c, g, or t
  misc_feature (613)..(613): n is a, c, g, or t
  misc_feature (616)..(618): n is a, c, g, or t
  misc_feature (629)..(629): n is a, c, g, or t
  misc_feature (634)..(634): n is a, c, g, or t
  misc_feature (637)..(637): n is a, c, g, or t
  misc_feature (640)..(641): n is a, c, g, or t
  misc_feature (655)..(655): n is a, c, g, or t
taaagccagccatatcctcatttctggtgatggcctagtgaccctctctggcctttcccatctgcatagttggttaagcatggacagaggcatagggctgtgtatgatttcccacagttcagcacatcagtgcagccgtggctgagtccagaactactgagacaggatttacatgggtntaatgtgaagtcagatatttacagtgtgggattacagcatgtgaattagccaggggcaggtgcctttccaggacatgcatagaactcagatgctgttacagaanctgaannggtcctccttatagcccattggatatcagtattttccctcaatcagaatccagaatgaaannttcccagtcaggtgtngactctgggattggaganagtgtgctntgtctccagtggaanctcacacagtanntagtgaccgattacacaaacncnntcctcaaaaactnttctctccgnncttctntangcttggtacannctctgnttgcaacaagatcctgaganaanaggccatcacnanagcagttgattcgtcccatgttttcttcaaatcagatgaaannagagaggcaggattcnatacntttcactgttgcntnctnnnttataacaggncatcnatntcnnttgcctccagtgtnaactgggactggaggctagagatgtgatttggccgtgatgaagaagagactcaattgggggaatactaggggtggcaaaacaattaatgtcccaaataactggac

SEQ ID NO: 624533 - DNA, 356 bp, Homo sapiens
  misc_feature (214)..(214): n is a, c, g, or t
ctttgcaggcaagtccgattttttgcgttgattttttaatgcagaatatgcagttaccgagatgttccggtatttgcaaatcgaatggttgttgcttccaccatgcgaggatatcttccttctcaaagtctgacagttcagcaagatatctgattccaggctttggctttagcgctttcggttcatcagctctgatgccaatccacgtggtgtnaattccctcgcccgaaatgggtcatcacagtatttgggtgaaggggaacgagtttttaatctgtcagtgcaggaacgcgccgccgacgtatggagtgccatatttctttaccatatcgataaatggcttcagaacaggcatt

SEQ ID NO: 624534 - DNA, 371 bp, Homo sapiens
gcgtggtcgcggccgaggtacggaatagaatggaatggaacgaattgtaatggaatggaattgcatggaatggaaaggaatggaatggaatcaacgcgagtgcaggggaatgtaatggaacggaatgcaatggaatggaatcatccggaatggaatggaatggaatggaatggaatggaatggaatcaacccgagtgcaaaggaatggaatggaatggaatggaatggaatggaatggaatggaacaacccgaatggaatggaatggaatggagagtaagggagttgaatagaatcaatccgaatgtaatggaatggaatgcaaaggaatggaatggaatggaatggaatggaatggaatggaatggaatg

SEQ ID NO: 624535 - DNA, 613 bp, Homo sapiens
gactctagaggaccccggtcacttgctacacagataccagaaatgtgaccatccttgaaatcctgtgctggctccccatcatctgtactgcagatcataacccaggctcgattggcagagctctatccccgctttctgtctcacatattatgttctgtactcatagaattaatgttgaggcttgcgacatatacccctatatgtcatgaaaaatccttgcggttggaacctgagaatacacatttacatcaaagtaccccaagtgattgtgaagcgcaataacatttgaaagcgactctaccgtaccagtaattggagagtgatttacacagtttgatccataccgtctattcctcccttgcttcatgtatccgtccatcccacagatatctgttgagtacttaattgtgtgcctcgtggatagctatggtgcagtgtgtggagaggtcctggtagacaagtgtttggatttaatggtctcaccatggaactgttgggttagaaaagtaaaataactcaacaccaagatctgaaaaagtctgcctggcatcccctaactttatgccattatatttcaggttcatactatgaacaactaaagtgataaaacctt

SEQ ID NO: 624536 - DNA, 448 bp, Homo sapiens
  misc_feature (217)..(217): n is a, c, g, or t
tggaatatacctgtcgcaccacaaacaatgtcaaccagtaactactactaatcaacgcccataatcatacaaagcccccgcgaccaataggcatcctcccgacatcaacccatgacccctctcctagcataaagttattcagtcttcctaacactcattaacagtttacacacaaccacacacccctatcatactcatttcaccacacaagcaccanatcctgacctcacattcgctacaccccgagctaaaacacctcaccaagcacctcaatccccttgaccccgcatgccgtcgggatactcctcaagtagccatcgctagtagtatatccaacagacaagccatcattcccccttaaataaattaaaaaacactattaaacccatattacctcccccaaaattcagaataataacacacccgaccacaccgcttatatcacgtt

SEQ ID NO: 624537 - DNA, 285 bp, Homo sapiens
gtgatttataactctgtaccttcattacttgatctatgaaagctgtttatgtgagtctatatatatatattccataaaaaaagtgttctcttttgcacatgggaggtcttggggcaggttttttaacacacttgcctcttggtgggggaggattaccgcccatcatctttgaggcaattttgggggagggagggaattttgcaaaacacaacatgggtgtttccagaaaaggggaaaatctttatttagagattatttgagatttttatacaaaaagttacttca

SEQ ID NO: 624538 - DNA, 268 bp, Homo sapiens
  misc_feature (2)..(2): n is a, c, g, or t
  misc_feature (60)..(60): n is a, c, g, or t
  misc_feature (92)..(92): n is a, c, g, or t
  misc_feature (141)..(141): n is a, c, g, or t
  misc_feature (176)..(176): n is a, c, g, or t
tncctgccctaccctaactaatccatccaccactgtgacatgttcctgccctaccctaantaatccatccaccttgtgatatgttccttccntaccctaactaatccatccaccttgtgatatgttcctgccctccccaantaatccatccaccttgtgatatgttcctgcccttncccaacaatccatccaccttgtgacatgttcctgccctaccctaactaatccatccaccactgtgacatgttcctgccctaccctaactaat

SEQ ID NO: 624539 - DNA, 428 bp, Homo sapiens
  misc_feature (71)..(71): n is a, c, g, or t
tgagctgtggttgagaatttacaaaaattaataggaaaaaaaccacaaaattattcaaaggattcttccangttgttagaagtctttggtccggaaaatccttctttgcaggctgataaggatgagttcaagaataaaaagaggaaaagttagagtttttaaattgcattaggttgtcaatgagtatcaaaattaaaacatgaaaaccttttgacacagaaattccacttctaggaattcattgtaaggcaataaccagacaattctgcaagatatatgtacaaagacttatattaagaacacataaataggccaggcatggtggcacacacctgtcatcccagcactttgggaggctgaggtaggaggttcacttgaacccaagagctcgagaccagcttgggcaacagagtgagaccccatttcca

SEQ ID NO: 624540 - DNA, 225 bp, Homo sapiens
tttttttttttcgggggcgcccttcttttgaaacccccggggcccaaggtcaaatgcccccccttggacggcgggccctgccaaaatttttttccctttttccggggcattgaaaatgggggcccccagccgccccgcccccctttttccctttcagggggccccttctttggggccggtgggatttttacccttttggttttccattaaagggggggcccccca

SEQ ID NO: 624541 - DNA, 295 bp, Homo sapiens
  misc_feature (143)..(143): n is a, c, g, or t
  misc_feature (234)..(234): n is a, c, g, or t
aaaaatcccatagtctgggtggtttaaataatgaacattgatttctcacagctgtagaggctgagaatgctaagatcaaggcaccagcagatctggtgtctgtcgagggccctctcttagcttgtagacagccacctcctcgntatatcttcacataggagaggagagggaaaggggaagcaagctctctggtatcccttcctataaggacactagtgccattcaggagggtgncaccctcttgacctaattacctccccaaaggcctacctccaaatggtattccattggggat

SEQ ID NO: 624542 - DNA, 897 bp, Homo sapiens
  misc_feature (897)..(897): n is a, c, g, or t
gttgaatgtaggatagagagtctccctagtcttacggatctcaggacccacaattgatgaccagtgagatgacaaccagcagtgaaggaacatcttattatctagtggtatgatattcataacaagtgtgcttcataggattaaactagtatattcatctgaatgagtgattgcatgcaatggaaatagttgtgtaagactattaagtgcatgatatctcaggctttgagacaggtattaggtactgtgcgggaaagcggaaagaaacttggttagagtcttggacgatgttgatttagtgcaagaacgtagaatgggtgcaagtagaagttcattgcagtgtatgtgccctaagcacgatctgatagatagttatgtatgagacagatacatctcgaggaaggtacaattacttgtagtacacgttgtatataaatgttagtgctcgtgaacatattccgttggggagtttctaaaagaatgaggtcatgtttgaaaaagcaaaagaccatatttcaggagtatggacttatttttaatgggtttatctggtgatcagacgttttactcggggagagttccacattaatgagttggggaccgtgcagctatcgaagggcaccatccggagaactaagggtggggatgggaacccagcacggttagcccggacaacgtatcagacagcgtgaccattaggtgcgtggaaaccaacctcttgggggcccacgggcatgggccgaggcggaacaacacaatgcgggaccaccgagggggcacggaagcggacacaacgggcagcggtcaccaagttgggcaacaagaagcggacacggagcacacccacggcccgtgaccgcaagcgccggcacgcaaaaaggataaacacaacgagcn

SEQ ID NO: 624543 - DNA, 114 bp, Homo sapiens
cacctctataaggacactccccatgcatgtccgcactatactcctgctacctgccatagttctccctgcctcctgttcttgagaccagcgatcccttctaagacatctgcattc

SEQ ID NO: 624544 - DNA, 1094 bp, Homo sapiens
aattgtcactgcatactactatactccgccatagcccggtagtcccctagttcccctccattgcatcgccatcactcatctctccttcccagatgatatctcctacacactgctcttatgtataaactcacgactttgatcggctgttcccaacacgtcttgagtatcagttcaagatacgtgcgtatacgccgccgagttcagctatataataagcagttctgacctttagaatcgattggactgattgaatttgattacctacagcccaactagtaccacctgaagaacacagtagcgaattacaggcctgagtcgtctccactgtaatctatcattctgagtagtgactttggccagtcaatatccgagtcacgcttgcttatgatgcacgctagagacggtcctgtactggtgatgtccttgctgtgtgactattaactccttagagccagtttgttgattcgaattctatacatctttatgctgcgtgcatacgtgtatcgttactggtccctatgacaaaggtacttgagttaagcgctagaaagtagcgtaataaccgccttgggccaaacgcgatgtagcagggtgctaggcaatccctgctggaagtaagctccgctagtccgtagtggagaacgcaccaagggaaatggcaaaaagcatgcttctcgtgaacgcggtctctatccgaagcgtggtccggagtaagatacgcgtttccagtagctttcgcatttatgcaatgattatagtcgcatagtattactgtacaatgtagagatcctcggaacatggttacaccagtatctcaacaggcttcctttggtaccgtacatcccactgctaagggactcggtcggtaggggtcccggaggcaaaacagggcagatatgtttttgacacggcatttccataccccaaaagaagcttcccggcatcgggccggatcaaagtggcaaaagatgcagacgaaataattgcgggcaatcacacaataataagaggcgaaagccactcattggtccaatgatgggccctgccaaggcacatcacactatccacaaaggacaacgcacaccatcgactcc

SEQ ID NO: 624545 - DNA, 932 bp, Homo sapiens
  misc_feature (524)..(524): n is a, c, g, or t
  misc_feature (621)..(622): n is a, c, g, or t
  misc_feature (628)..(628): n is a, c, g, or t
tggatcagctttcgggtcgggtccggctctggatgagattttggaggtgcttcctaacggagatgtacaggaataccaaactagtagacgaacgtgatgctttccaagacaacctagggtctctgacgaggattttgccgtcagacagccaggacttgggtcaacatggatgaaaaagggttgttatgttatacaagaggattttcccaccttgaccccaggcaatgtagttagcatattttatgtcccatggtcatatgattaatcttgggccaaagaattttatagcactttttgaacatctgaaaaaaaaggatgataaaacttaagcttctttttcagacgtttaaaaatttctataaaagaagcttaagttttatcatcctttttttctcatgaattcttaaaggattatgctttaatgctgttatctatcttattgttcttgaaaatacctgcattttttggtatcatgttcaaccaacatcattatgaaattaattagattcccatggccataaaanggctttaaagaatatatatatatttttaaagtagcttgagaagcaaattggcaggtaatatttcatacctaaattaagactctgacttggattgtgnnttatantgatatgccccttttcctattcaagcaaagatccaataatgaaacgcagtgtgtttgtagagtgggggtatttgacatcttttacagggtggagtgtcctatatggtattacctttgaatgtgtttgcagaggtagtgtatgtgttggtcagccaggatgactcctgttccattaccccccaaattagctcccacattcaaactgagttgtgctgtctaggcctgatagtgcttggcctttttttcctgcatatctgtgtattttcaaatgtgcatatatattttagctttaatacacccaaaa

SEQ ID NO: 624546 - DNA, 318 bp, Homo sapiens
gcccaaaaacctcaaagggttaatgaaattttttcctaaaacccgccccccccctttttattaatgggtgaaaaacggttttaaaaattttttttttaattggcccttttaattttttaataaaaaaatggttttttataaccatgcctttttaaacctttaaaaaaaaaaaaaaatttttttttggccccttttgtttttttttttgggggtgggaattttaaaatttttattttttaaaacaggtcttttttaatgaaaaaacttttccaaaaattttttccaaaattttttgacccctttaaaaaatttttttta

SEQ ID NO: 624547 - DNA, 752 bp, Homo sapiens
agcggagtgctcatgctcgctgcagcgtgtcggaggtcagggcgagcgtctcgcagtgcctgtagtgagtgaagatgtgcggtgtgagtcgcgcgttacccagtgaggacattaagaatgtgagccagacgaaacctgatctgacctgcgagaatgacatgcccactgttgctacgtggtcttcaccaccaataacggcctgccaccacctgaatggactgagttctccctggggaaatgtagccgtcacagcgagttgcagatctagcacttggctggatgcaagctttgaacagaactgacaagcttacgtacaaagaagtctacccagaagctagaaagaacgggcactcaccttcaactttctgcaactcagttatttaacagactgttaacacagacctggctatcgagttaacgggaacattggcacgcaccagtgtctggcaggaaagtggggactgactgagttcccagtggacccctggccagcgtcggcactgacaggttcgcaggacttacgggagcataaaccttgcgaccataacggccaagttacccccttccaagactccgggtggcaccccaaaacccgtaccgtctcgaaggggaccggcccaacttgcaggacgccccagtaggtttcacaaagttagcctaagtcactaacgttaagtgactcgggttcgaaacgttctgcactgtaagtgtcgcccgattcacggtatacatggctagagagagaactaacc

SEQ ID NO: 624548 - DNA, 339 bp, Homo sapiens
aaaaaaagagaaacctttatttacaaccaggggaggcccacaggggtccacaaaacacacaatgggcacacacccaaaaggaaccttttagggaaataccatgcgggctccgggccgggcgccacccctaagggccctatccggaccaccattacagggacgtggtcggccgagccccgttggaccgccttgcgggccagccggttgcaggctgtctcttgaaggggcggccgctttgggacgtgccttgctgaggtctgggatattatatagttcaaggagtggtaggggaatgcttgatggggatgggatcttgacactggtacattgttagagtaa

SEQ ID NO: 624549 - DNA, 676 bp, Homo sapiens
  misc_feature (234)..(234): n is a, c, g, or t
gggacgacagcgagcgggagaagcggggtcaaagggagcactatgtctgcggaagtccccgaggcagcctccgcggaggagcagaaggcactggaagataaagtgactagtccagagaaagcagaagaagcaaaattaaaagcaagatatcctcatctgggacaaaagcctggaggttcagatttcttaaggaaacggttgcagaaagggcaaaaatattttgattctggggantaccgcatggctaagcaaatgaagaacagcaattctactgcagtcggatagacggaggtcactgtgaccaatccactccgaagacttcctcaaggaagccgtccctttgttgctagcaagctggctggtgattagaggctgaatgcatgaatctgctaatctcatatttctccttaatatgtattatctactttttatttcctttcattcactagtcattgagactgacagtttgaggtagcagtagtgtgtgcggtattgtggatatcggtgtgtagagtggattagttacagtgcactgtgaagaggactgttgagcacataagtaatacttgaaatagtgtatatttactaatctagtgtgtactgttctacagtaaagcacgttaaattaatgttggttcatactctctaatatagttgatgtgactattaaaaatca

SEQ ID NO: 624550 - DNA, 840 bp, Homo sapiens
taaaaagaaagaggctttttattacattgttacaggcaatgcatttacgtgtgagcgtggttcccgggttacaattccccaagccacggcaaaacatcaggagaacgcaccgattctcacattgtgtacacaggcgcagaacaggatcaccccttaaaaaaaaaaaaaaaaaaaaaaagaaaaaaaaaaaaaaaaaaaaaaaacaaaaaaaaaaaaaaaaaaaaaaaaaaaaaaaaaaaaaaaaaaaaaaaaaaaaaaaggggggggggccccaacacaaaacccccaaaggagagcacaaaaaaacacgacacacccagaaaaatactaaaaaaggagaaaaaaaagagaaggaaaaatataaaaaaaaaagaaaaggagacacaaaaaaaaaaacaaagcacagagaaaaacaaaacaccgggcaagaaaagagagaacaaacaaacaacacgagggagaaaaaaaagcggaaaacgactaacaaggaacaaccacaccacaaagcggaaaaaccacagcaaaaaaagagcaataacaaaggacaaaaacacacaccggaagaaagaaaaaggcaacaacacaaacgaagaaaaaacaaagaaaaaaacaacagcagaaaaaacaaaaccacgcgcacacaacagaagaaaacaaacaagaaacaacaaaccaccaaaaagaaaacaaaacaacgaaaaaaaaaaaaagacacagcgccacagaaccacggcaagagaaagacgagagagaagaaaaggaaacgaaaggaacaaaagacaacacaaaaaacaaacgaggagaaccaggaacgagaagaagcacgcgacagaaagagac

SEQ ID NO: 624551 - DNA, 489 bp, Homo sapiens
  misc_feature (226)..(226): n is a, c, g, or t
  misc_feature (256)..(256): n is a, c, g, or t
  misc_feature (298)..(298): n is a, c, g, or t
tcggctccagggaggtgtcatttctatagaaattagaagctttctgatttctagatgaggttttacaattgtttcttacagtcatgtgcactaagtactctttttgtaagcagaggtggctggctctgcagcttaaggcattttttaagtcaccacgtctagaagtcacatgaactctgctcagaataatctggtcctcagaccggccttttcaacctgtggcggnattctccattcagctggatgatcctcaggnctgaccagttagctggaaggttggtccaggcttttaattccnggtcataatagggtggacagtgttaaccgtgaaaaacttgagaaggcactctgccctccttccctataaaatcacaccagcgtgattttacaagggtccccgtggcaccttggctcaggacctctgcccctagttagcaagactgcagcagttgctgttgcttattctgaagggatgtagaacttgacagc

SEQ ID NO: 624552 - DNA, 243 bp, Homo sapiens
ctggagataaggcgcagatgaactcatgtagttgtgggctcttctctggtcatcaatcttgaacttcttcctcttctctacctcctccttgaggcacgcctcactagctttgcaactctcagcctccacacactttaggcagctgccagacagctccattgggctgagatctttcctccccacctcaaggcgctcgccagcgccatcaccactccccgctctatctctctgactgctccgctg

SEQ ID NO: 624553 - DNA, 539 bp, Homo sapiens
attctggtttcttattcttgacacacacattgtcctcagccttctttggattgtctgcacaccgttttgtaaattccgtttcactaactgcacagattcgctctccaaagtgcttgctgcaggctggctttttgtctttcttgatctcaggcacatggagtctgaatttcctgcttctcctttccctttctgattctgcatgaaaaccttcgcactcttctgccctccgctctcctctgccaccttaggctgggagctctcattctgtctagcagacctcaagcaccttttgttctcactgactttgcctctaggtatgggtttccgggctccatcatctggattctgaatgtccatctctggggaggtcttcatgggcttcttttcatttctgtttatttctattctttctgctaatacaaagacctcagttatttgctgtcctgcctcagtcttattttggcgtctggagcgcagggatattcccttattttcagggaccgagtcttgtaatttgtgttcctctttgttggttttct

SEQ ID NO: 624554 - DNA, 125 bp, Homo sapiens
gtcttcctgttctgccttcctgctactgctgcttcctgcttctgccgcttcctgcttgcttcctgcttctgcccctcaccagaccctgacccaggacagaagcaggaagcagcaggaagcggcag

SEQ ID NO: 624555 - DNA, 961 bp, Homo sapiens
gccactgccacttatccagtgaatcattatcacgaacaaaatctctaccttctcatatactaatcttcccgtacaaatctccattgatattatacatcattctaggagtacacagaactaatcatatctgttatatcttcttcgaaaccaacacttatccccaccttgcgacttatccatctacccgcatagaagtgcgaccatgacagacactgcctgatctgcaggcacatactacctattctacaccctagtacgctcccttcccctactcatcgcattatgttcacacatcacaatcacccctacgtctcactaaatcattctactactcacatctcactcgcaccaataattattcaatactcctgagcctaacaaatcttcaatatgactagtcttacagcaattcagcttttatagtaaagataccctctttacggactccacttatgacttccctaaagcccatgtcgaagcccccatcgctggggcaagtagtacttgccgcagtactcttgaaactaggcggctatggtataatacgcctcacactcattctcaacccctgagaaaagcacatagcctaccccttccttgtactatccctatgaggcattattataacaagctccatctgcctacgaaaaacagaacctataaatcgctccattgcatactcttcaatcaggccacatagcctcgtagttaacagcattcttatcccaaccccctgaagcttcaccggggcagtcattctcataatcggccacggacttacatcttcattatattctgccttagaaatcaacttacgacgcgctccagggatttaactcttcaggggtccaatctaccccctatagttttggggttagaagctgcgacacgttcccctataacgggaacctggggaccgccgcgaacaccagaagcaagggtcccctttcaagggccccac

SEQ ID NO: 624556 - DNA, 391 bp, Homo sapiens
cgtcgactgtgtatgtgacaaatacaatttgatttgatttggctaggggctgtatttgaaccattatgagtaacagtgactctctttctctcagggctgaagtacctgcattctgctggcatcctgcacagggacatcaaacctgggaacctgttagtcaacagcaactgcctgctcaaggtaacggtgtacacgtttgttttggcgtgtgagtctgtgtgtgaacttcctcaaaagacatacaaggaagcattatgctagtcaagaaaaaaataacttagtagaggtcaatatgggctgaagaattttgtctatacaccttttgacaaacatacatgtgtattatgctgtaattacactggtcaacctacactgattataccgtcgacgc

SEQ ID NO: 624557 - DNA, 560 bp, Homo sapiens
  misc_feature (452)..(453): n is a, c, g, or t
aactggacttttaaggaattctgtcacttgtagcattgtagaggtctcaccaaaaataattatttaatttcttttctatacaatggcagcatttctttggtgaacacttaggtgtttttcctctgaagtggtgggtattactgtttggaaagaccttgtgtacctcttttggggcctcttctattagagcctctcaaaaggaatagactgctacaatttgctaacctgctagtctttcttacttgctgttgtgatgcctactggcgctcccctttgctgcaagtgaatacaggctgttgaattgaagaggagttttggcaaattttcgtattattgtacgaaatgctatatctatcacaatttggtcttttaggaagtcttgcgtgaaagtggaagcgtttccgaataccaggttaccgtggagtgtattctgaagcgtcttaattgcattnntcccatttgttatcatttgcctgggaattttaaactttttaattggaaaattttaaggaaagaatttagttacagacattatttagaactttatgtcacagtattgc

SEQ ID NO: 624558 - DNA, 449 bp, Homo sapiens
  misc_feature (8)..(8): n is a, c, g, or t
  misc_feature (18)..(18): n is a, c, g, or t
  misc_feature (45)..(45): n is a, c, g, or t
  misc_feature (119)..(119): n is a, c, g, or t
  misc_feature (378)..(378): n is a, c, g, or t
cgttttanacttggggtngttaaccttcctacagtggagccttcncctattaccccaataatgtttttaggttgcctaacaatactttaaatgtgcctgctgtcccccagttagcctcnggaaaaattttgcctagatggagaatattccttaattcctaatttttttcttattgaaaattataggctgggcgcagtggcttatgcctgtaatcccagcattttcggaggccgaggcagatggatcacctgaggtcaggagttcaagactagcctggccaacgtgatgaagcccccgtctctactaaaaatacacacacacacacacaaaaattagccaggtgtggtggcgggaggctgagggaggagaatcacttgnccctgggaggcagaggttgcagtgagtggagatcatgccactgtactccagcctgggtaacaagagcaaaa

SEQ ID NO: 624559 - DNA, 688 bp, Homo sapiens
gttggccgcataaatacctccttttttttggcagcataaatgtcttcttttgagaagtgtctgttcatattctttgcccagtttttgatacggatatttgttttcttgtaaattagtttcacttccatgtggattctggatattagacctttgtcagatcagtagatggcaaaagtttttctcccattctgtaggttgcctgttcactctgatagtttcttttgctgtgcagaagctctttagtttaattagatcccatttgtcaattttagcttttgttgcaattgcttttggtgttttcatcatgaagtctttgcccatgcctatgtcctgacatggtcattgcctaggttttcttcttagggttccccatggtttcgggttttacattgacagtctttaatccatcttgagttacactttgtgtatacagtgggcttttcttgatatcttaaccgttcttctgaaaccttacagagctgccagaaacatggccaagctaatgacacaaacaattcacatgacaagcagtcagtcattacatatagggctcgtcttcttgcactgactgatgccagtgtttcaacttactgattagttactgatcaatgcatacttgccttcatactggttttacaacagttgcaccaactccctgctagttcatccagaagtcactgaagtttgg

SEQ ID NO: 624560 - DNA, 159 bp, Homo sapiens
tgaccccatctctacaaaataaaaaaaaaggaataaaaaaggaaggccgggcccaaacttctctgaattgggtgtaacgtcgtgaagccaggcactttcataattctcagcttccattccatatttaaatcacagttttattgttgggacgaatactgg

SEQ ID NO: 624561 - DNA, 174 bp, Homo sapiens
  misc_feature (73)..(73): n is a, c, g, or t
caggctggacgtgggctcgtcgaggatgagcacgcgcgccgagatgcgcagcgcgcgggcgatggccaccatntgctggatggacagcgagtagcgcgacagcggcgcggtgacgtcgatgtcgaggtccatctgcgcgaggacgcgccgggcttcggcgtggacggcgggcca

SEQ ID NO: 624562 - DNA, 573 bp, Homo sapiens
  misc_feature (26)..(26): n is a, c, g, or t
tgtagccgaatgtcgatgcccggggntcatacattgtttcaaacatgtcatcgaccaactgacgaaccttgtcgtccactacggccaccggcttggcgatcgtgcgcaggcgcgagtcgggaaattcgaggatgttcaaaatagccataagcgtaattgctgcacatgtgaggaagagacaaatcggcggtgggatggacccatacggccggtgtgaaacgctcggaagccgcgaaggccatggcatttcacgcgaacgcacataataaaggagattcaccccatgaggaaatcgctactcgtcttgctgctgtgggccccgttcgccacggcgttgattgcgcaacccactgagcgcctggatcaggcagcgcaacaggccatccagcattttttactgcacaaccgtatttttgactcgcccgaggacctggataacgcgccttatattattgcggcgcaaggggggcgcgtgctgggtgccaacgacgagcgtgtgcatgcgcgcgggcgtctggacccggcccagccgagctacgggatcattcggcgaggcaaggcctacaccgaccc

SEQ ID NO: 624563 - DNA, 633 bp, Homo sapiens
gagatagagggaagtgtgtgtaagggtgctcaagactgaatgttatatcctgcaatatataaaactccacatgtccctaatctgaaatcacctcttactcatgcaattattttagcaggagaggaaaatatgatctgacttcaatttgttcagcatttattttctaaaaaaggatatttgccacaagtaattactgcaaagggggagctattcctggttagaaagtttttaatcatgaagtggtatttgacgttctaattatttccacagcttgaaaaacaaacttgtcactgggctgtagtaataactaagtgtgaccacaaaaagaaagctatgcactgttgatatacacggccactaattttataggaataacactaaaatatttaccagtaaatatttgtcattcaatgagaggtactgttaaataatgtaggaaacagttttattctctctctttttttttttcttaagagctgtgggccctgcacaagtggtctgtagagggcaagagaaagagtctagaatctccaggcacttctgtctccaatttccattttccataggcctccttctgcccagcaaggctggtaacatcaaatgctctggaggcaatggttagctcagttttct

SEQ ID NO: 624564 - DNA, 1447 bp, Homo sapiens
agcggggctggacgtgaggtggctggtggccagggctaggggcggccagcccggcgggagactggcgcgatcaggccgcgggcgttacggtttgtcctccgtgtcgtggcttgtgggggctctcaccgtgagagaacgctgcgccacgcctcgatgagagcgccggccgtccagggacgggatcgtgtcctggcgagtaatgtagcatgcagattctggggctgctggattcgtccccccgtgatttgttgtgttacgatgttgagatgcaaagccatgaaggtgccggattgtaagcttgtgtgaccccgcaacgatggatcgttgttgggcggtatgaccacaaccgacctgctcgtgggtgggcgttgccctggacagcgaagagtgctccatagaagtgtggcgcgaccgtccgtgcacagttgcacgtacacgactgcgacggaggcgagatttactccgtcacaaaccacgtgaccacatttcggacctagcggctttgtgacacccttcttcgaagcgttgtacgccttgcatggtaaacacgcaatggccttcggccaccgtgggtgaaatattgtgggcacaccgaggggcactacacccctctgtcggtggcggaacggcggcttggtgacgagagagggcgccatgtattcaccttgaaccccaaattacaaaaagaggccgtactgcggttggtgcttagtgccacccattccaaagggtagttttactccagttgttattcgcgccacgtggaaggaggcgcgaccggcaggaacatagactcacctaccgcggggagtaacttgtaacaccacccgacggatggaggcgcactccaccggtgttagcacattccaaaaggtccaacagcattgagacttgcaataggacggcgtctctcgcattaaactatctactaggccaccggaaaggtaaaccctttggtggttgggctttcccattattttgtgaaagaccgtaggttccaatttcttcggaggcccctatataggggaacttccacatgcgactcggtgcatgctcaaactcctaggtgaggcttgggtgcgaagggggacaaaaggggccttgtgggagtaggcatttgggtgctatttagaaaacaagacattggttggcgacaacgttggagccaaggttgcagggttaaggactttaccggaatcttggaccagggaagaatttcacgttgggccgttgggaaggaaatattcttggatatgggcgggagattattgcgcaattaaagtaacatcagcccaatttccggggattatttggggtataaggtatggtggccacacagagaaagtaggggaattcacagaaaaggaccttggggccacaggagcgttgttggataaagtctttacacaggaaagcttgcgggagttgcaacaaggattttcacacg

SEQ ID NO: 624565 - DNA, 275 bp, Homo sapiens
ctgcagtgcttcttgtaggtgatctcagcaggcatcccgtttgggctcccattccaggtcagcaccatcttcccagctgttttccgggccaacagcatcaactcttgctggtccaggcaggcgatgcgtgcccttgtcttggctcttggccttgcacattctccaatggtgtccatcgggctcccacttcgcagggtgcatggtcttcaccagtccagggtctaccacgcaagcatctgcatccccacctcgtgagcacggcagcccccaggtgc

SEQ ID NO: 624566 - DNA, 416 bp, Homo sapiens
  misc_feature (416)..(416): n is a, c, g, or t
tcaagtcagacaagccttgagaagcttcaacttgactgaagcgcgggtattgattgttcagtgagtgaagataactgtgccgtatgggcagtgctgtgttcagtgagtgaagataactgtgccgtatgagcagtgctgtgttcagtgagtgaagataactgtgtcgtatgagcagtgctgtgttcagtgagtgaagataactgtgccgtatgagcagtgctgtgcgcccaggatctggacagcaaactcgttattgcagagtgggcagattcacgacagtccggtccagaacttctcatcggttcctggggaatctttgtctccccgtctcctggagttgaagagggaatgcgcttgttcatccgtgtgaggaaagaaggatgcttccactgagggcccacgtttctgcatagccn

SEQ ID NO: 624567 - DNA, 580 bp, Homo sapiens
  misc_feature (114)..(114): n is a, c, g, or t
  misc_feature (356)..(356): n is a, c, g, or t
agcatgtggggccatctggtgaggtcacccccatcccacactctgcaaaggaagaaactgaggccttgagagagcttaacccatgccgggtcacacagccgtggacaggcctgnactggaatccttgtcccctgacactagcatggggcttcctctggcccctccttgctgtggagagatgaggggcacccacatgctcacggggctaaatctcttctatcccatcaaaaccctggaaacagggacccaagtggtctgcagccaccaacctgggtgtggcctgaaggctgggtgtgtaggcctatggggaggggctggcttgcctaggagctatataccttaatgtaaaatgacangaactcactacaaaccttggtaacttgtgggcaccttcttcaccctgtcttcacacttatccaaccacttccttacacacaccctattgatcttgtatccccctccaagcaggcctacacaagccccaggaggcctctatcctttcactcccacctagctaccccacgtgtgagaagaggggcccccttattccaaggaatccactttaaactttactttcaag

SEQ ID NO: 624568 - DNA, 1131 bp, Homo sapiens
gagccggtgctgcgctcctctgctgggactgccgagccggggctatttctggcgctggcgcggctccagagaaggcgatccgcatttgctatctagctggtggctcgggaggagcctaggccgggttgtctagctgctccagcaatgacgtctcgcggcaacgccaggagcgcgcaccgcatggcgcgggggcacgaggttctgagcatcgcagaccatctactcttatcaccatgctccgttagagaagggaagatgagtgagtcgaggctcgaagtccacgcctggccctttgtcgctccaaggcacggaaaacggacggcgtcttgacgaagactggggccaggtggcatcggtcggcgtcaagcgaggcactccgggttgaaggacccagtggatcgatgctgctggataggtggaacgttcacgaacggaggcacctgcagaaggtggcagagcaggctaaggatgagcttctaggggagctcgaggtcgaaaaggggtacatggcagaagacttcgaacggtggtgacttgcagcaaagtagaccggcataagagctatccaacaactttccatggacacggtaatactcaaggagtggcgagtacctctacacagacaactgtgcacgaacgggatcgcagagaaggaagaggggcatctccgcacggagatgtcccctcgaggaagagcacgtgactgcactgtggaaggctcgattgccggttgagcagctcttggcttcccctttcagcttgtgaacgggagtcacagcgttcacctgttctcggacgacatttgggcaccacgcgaattgggtctacacgggagtctcatccaaaccgtggagccaccatatgggcacactatcgagatggacattcctacacgtcaggagcaacttagaagtcagacgctaacctttgggggagcccaagccacactttgctccgtttggaacaaaaccacatcaccaaacccgccgccacatcacacctgtttaggtaacaaaggtgaaggtcccccgtgggcccccttgcgtacttgggcacacagatcgccccaacttattctcagtacccctgcgtcattactatgctaatgagggcagagcagcttggacacag

SEQ ID NO: 624569 - DNA, 769 bp, Homo sapiens
tggcacgagggagagagaactagtctcgagtgtttttttaatttttttgggacagcaatgtagaacatttatgggtgagtatacaaaaggggggcagcacttgggaagccctcatgagtgcagggcccgccattgtgtccaaagggccacaatgggggatgtactgtgaccccacagccatcgtgggatgagccgcattatatcagccaccagtgtcttcaaattcatcagcattgaactgtggtgaagccccacttcttggacaatggttggatcttctggcggccaggacaactttagaacttgtggcccttgcgcaaggggccttcaaactcacgatgtgcctccttgtggtccggaagcttgtgggtcgccgagagtggacatgtgaataaacttgtgggccaatgtgtgtagaaccctgtgggcccacaggtgcccgtgggggcatttccaaaagggtcacctctcgacatgtgcctagtgttggaacgccatacatgtggggagatagggtgcaagggtctcaaaaacatgtgaacaaatcacacactgtgaagagggccgtgtttttacagagagctcccatatagaaagccaaacaccattaacacaacccaacacagggctcgtgacggataacactataaccaagagggcaagccgtacgtgagagatgcagacccaattccggcaccagcggggggttccccccaatgacgggaacacgggacacctccagacgcgagggtaaaaatgaggacgggcg

SEQ ID NO: 624570 - DNA, 506 bp, Homo sapiens
acttgttactagaatatgacttattaaaaatgcatttccacactgcaaacattttttagggctatcttctgccctttggaagcagtcttggcagcaacctctttagtaatcaatataaggcacacttcatgtgtttgtgtagcctggaatctattctaccttcacaggttagaacatcttgatttcctcttaacgaaacattccctaacggtgtatgtagtcatgagggaaccaccattcaagatgccctgctcaggacttggcatgagcactatggtcagctgaggctcagaactgtacattgttaatgggtttttcaagttcagaaaagcaacatgagcttttgttctatggtagcatgttgatgtaataagtagctatttcaatagaggttcccagaacagcttttgttactgtcatttgcttaactttgttcacttgtcttttattttgagctattgggtgtgcttttaatacattccttgtttgattgcattaaaaaaaaa

SEQ ID NO: 624571 - DNA, 744 bp, Homo sapiens
  misc_feature (449)..(449): n is a, c, g, or t
  misc_feature (461)..(461): n is a, c, g, or t
cccccaaagtttagcatgcatggaaatcacctgacagaaggttacacagcacagactgctggcctcccttcccacattttttgatgcagtagatccagggaggggactgacaatttccatttctaataagctcccaggtgatgttgctgctgctggttgtgaaatgctaattgctttttttctttcttctttttttttttttggaggtggtggtcctctagctttcccgtgctaaaaaatactgatttccttatcaggaacttatcctcgtgctatctactatttggtaataaaattatcaggggaacaaagggctggttggataagaacaacaggtttctcaaatggttttacttacgtttatttcaaaagaaagctatttttctcgaatctattatattattacagtgaagatgaagactttggagcatagctagcaaaggcttctntaaagctggatntagattttcgggttcctaactttggtttttcgggtcttctttggagagggagtctggctctggtggcccaggtctggctgtcgcaggggcgtgaatctcggctcactggaagctccggcctccgcgggttcaccgccattctccggcctaagcctcccaagtagctgggcacctaaggcgccggcaaccacgcccagctaatttgggcatctttagttcgaccggggtttcacgggtgttagccgggatggtctcgaatccccctgatctcgtgatctgccgc

SEQ ID NO: 624572 - DNA, 243 bp, Homo sapiens
  misc_feature (1)..(1): n is a, c, g, or t
nagacgcagctctctgtgtatgtctggatcagcaggctgctcccaagtacagacttggtagacacggaaagggaggtattctgggaggttgtggaggatggcgtggcaaagctaaggagtgaaagcatttcggccgtctctgtagctggggcagcggccactaatgttttctgaaagggattgtgacagtggacttgagcatccgggcaggttaggggtagtggcgctgcgtctgctgaggag

SEQ ID NO: 624573 - DNA, 123 bp, Homo sapiens
cagttctcaatgagagagatcaacctccctagataaaccaaggcaaatgtgacagaaagggccacggacctcatggcaggggtggcgtcttaatgagggaggggcccaaagcccttgtggggg

SEQ ID NO: 624574 - DNA, 268 bp, Homo sapiens
gttatctcaaaatctctgcgattagaagatatttattaaaggtggtccttcctacctctgtggtgtgtgtcgcgcacacagcttttaccaaaaaggttgccttattaaaaacagggaatacgagctccaaattgaatcaccctttataatttacccatttctatacaacaggcagtggaagcagtttcagagaactttttggcatgcttatggttgatcagttaaaacaagaatgttacagtaacaaataaagtgcagtttaaaaccc

SEQ ID NO: 624575 - DNA, 170 bp, Homo sapiens
gtgtgtgtgtaaaatatgtgtgtgtgtgtgtgtgtgtgtgtgtgtgtagagatggtgtctccctgtgttgtgtggagtgtctataaaacttgacattcaacagtctcgtgtttatattcatagagaaagcggcttcatccttttagtgaaatgggagaagtgttatttat

SEQ ID NO: 624576 - DNA, 150 bp, Homo sapiens
agacgcaccttccagaggacccggtgggaatttttcatagtgccaaagtcctactactgcgttttcagtgggtccttgtacatagtttggtcctctgccctagccctcacctcttgctatactggaccgctttgtacactgtgggatttt

SEQ ID NO: 624577 - DNA, 346 bp, Homo sapiens
cagtggttacttcggcgttgtgtacctgggaaaacaataccttttttttttagttgagatgagacgtctagatcagcacaatctgatttccttttagtacagtctgacttcctttaggaagtgtcactcactgagaggtttgtgacttttttattttgcggtaggccttagctggtaacggcgtaagtaacacggccagccttgcacggtggagaaagaatggcatttacttacctctgtcactttctgtatctctgagcaagtgaattacctgtctttgtaaaatgcctcctctgtaagtggaaaacactgttcacctaattgtggggttttattttcctcacga

SEQ ID NO: 624578 - DNA, 859 bp, Homo sapiens
tgccaggcctcacaggcaggcattcatgtgagctggagaaaccaggatcctgaccgcagggcccatcacttgctacatagagatacacatggaaagagggtttataccatgaccctctctaggacacaatcgtgtttgcatggcgttcgagcaataatttctaaaccatgaggccaagcagtgtcaccactgctcccgttgggtctggctaggggatgggtatccatgtgaggccagagcgatcgccgaattatcgatggcccctactcgaactggtgctagcaagctggccgtgtcactgtagggagaaacagagtggagcttacttggggctccagctcaagacatgggctctggggacgttctggccatcgtggccggcacatccgagagctgtgccattggctagcttttagcccacgaggctggtgcgtagcgtgaggagttagtgatggcagcttgatcgcacagagttgctggtagtacttgctatcgaggggggagttcctgaggctggtggacaaggggactgacttgtctgcggactagcggaggagggctgggacagaatgtgattctgatatgagacatcagaggggatatgaactgttacttcgctcggtaattctgtgggtaaaaacctaagaatggggcaaatctaggatcgtcacaaagacacataaaagataatcaccataagggaacataaacaatgataatccaagacaaaaattaaccacagtacgtaggtaatcctcatttgggaatgcatggtagggacccaggtcatagactatttcgaccaaaaataaaaaatttggctcttctgggggcccatcgggacgaaagaagagtggca

SEQ ID NO: 624579 - DNA, 121 bp, Homo sapiens
cccggccggttcgcatgtttccgatggacatcttcagtgctgaagcacagatagagctgaagagttatgtgtatgtgggtggaaggtctaactaaatttagcagtgtcagtggagtctgaa

SEQ ID NO: 624580 - DNA, 177 bp, Homo sapiens
gcaacgaatgtgtccagcgcgaacgtttgctgaggggatcgaaaaagttgggcgggtgaggtcatattcgacgtgcctcaggccaatgcacgcatccggcacagtatcttcagcgataggcctgccccagattctgtgataaacaactcaggttggtcaccctgtagttgaaccgcc

SEQ ID NO: 624581 - DNA, 528 bp, Homo sapiens
ggctgaagtgagtggatcccctgagcccagagaggtcaaggttgtggtgagctgtgatcacaccactgcacttcagcatgggagacagagtgagaccctgtttcagaaaaaataaataaataaaaccaccagcaccacaaacaaaaaaaaaaaaaaaaaaaaaaaaaaaaaaaaaaaaaaaaaaaaaaaagtgtgggggcggcgccgacgggccccgagagagaacacttcaaaaacaaaggggggggcgcggcgcgcggccccacggggaaaaggacgacaggggcacaaaaggggtgacccaacagaagagaaaccggggaaacaaacagagggcgaggggagttctccaccaacaataaaaaagacggcggggggaggaaaacagagagagaggcttcgagaaaaaaagcccaccagaggaggagcatacgagagaccaaaccaggggggagactacaaacgagggggagcccaacacgaacgacgcaaaataacaaaatagacccccgcacagcgggggggggc

SEQ ID NO: 624582 - DNA, 105 bp, Homo sapiens
gaccatgagtctgctgaaaactagagcccttacagttcaacctgattctcttgtccagtaccacgtactaactgaaagatgccctaggaaaaagtggcagaaatg

SEQ ID NO: 624583 - DNA, 215 bp, Homo sapiens
  misc_feature (78)..(78): n is a, c, g, or t
  misc_feature (121)..(121): n is a, c, g, or t
  misc_feature (211)..(211): n is a, c, g, or t
cctaagccactgcctgctggtgaccctggccgccaacctccccgccgagttcaccctgcggtgcacgcctccctgganaagttcctggacttctgtgagcaccgtgctgacctccaaatancgttaagctggagcctcggtggccatgcttacttgccccttgggcctccccccgcccctcctccccttcctgcaccgtacccccgtggtncttt

SEQ ID NO: 624584 - DNA, 912 bp, Homo sapiens
  misc_feature (551)..(551): n is a, c, g, or t
ggacctgcgctgacagggaacagttgcgtgacatccgtccgtactccgatctatgtgcagttattgctactcgccaacatagaactatcgaggggatacgcctgatgaatcgtggagacattttgaggctgctagggtcacgtggtgcctctgctgtgattcgagagctccctattcgacctaactatctgcttcgtaactgctagttcagtccaagcatgcgtcgccaaaatagcaagttggaacagacccttcatgcatgacaggtgaattgagtcggtcatcaaagtaatgctgacgctccttgtgttactggctagagcatgttgggctcgcacactgcccacgaagcttcgttgggttggctgtgcgcccatcctcgcgagtactgcgtcgctggggctacctattatggctgacaatgctagatcgttgacccggaccgccgattgttgttcggcccctgagacctaagaagcctgtgacgtcacgtgtctgagcttcgatagacaagatgaaagcacacagccccaagagagagcgaatcacgngccgagtcatgatatctgaccgcttgaacctcggccctccagacttcgtcaccgcaacgtctagcttgggcttctatttggtacctcctaaccgggtttcccattccgcgtcacttttggaaggcgcaagaaggactctccccgttttacatcctttccacatgtccttggggctcaagatcagcgtccaggccataaaacacctttgtggaaacagagggctgccccttgggaaacaaggaaacccatcgggaaaagccatgggcttgattagccgttcccgtttgaaattccaagggcattgccttccgagcatagtgccccctcgtattccttggcaaagcgatcgttaacatagggc

SEQ ID NO: 624585 - DNA, 351 bp, Homo sapiens
aggatccgggtcgtggtgcaactgtagtcccagcatctgaggcaggaggatgcttgtgccagaagtcgaggctgctcaccgcaacctccgccttccaggttcaagcgattctcctgactcagcctctcaagtagctgggattacaagcatgcgccaccatgcccagcttattttgtgtttttagtagagacagggtttctccatgctggacaggctggtcttgaactcccgacgtcaggtgatctacctgcctcggcctcccaaagtgctgggattacaggcgtgagccaccacgcctggccaattatgtaattattgagaaagggcagttcatcgacttgggtaccgagc

SEQ ID NO: 624586 - DNA, 1456 bp, Homo sapiens
gtgtgttcgtcctcgtctctctgccgcctcggtggcctcctggcccgcctcgcttcgttctgctcggccgtgtccgctgagcgcgcacttgtctgcgggtcgtcgtcgctgggtcgttgcgtgtttgcggccgcatctcgtctctcgtttgtgctgattgttccttcctctgcttcgcttgctcgcgcgagcgtgcctggtcgttttctcgtcagatgcgggttgtgtgcgtgatggttctgtcctgcgctctcgtcgatcctcgtgtcgtcggcttgtcatggcggcgctgccgtgcgtcgtccgtctgttggcctgcccctccgatgcggctctagcgcgctctctgctccgccgtggcgtgcgcttgcgggcttcttgccgcgcctctgctgctcgtgggcgtgtgcgtcgtctgtgcgggatcccgtgtcctggtgctgctgtttctctggactacggtcctgtcctgtttggtacgctttctgtgtgccgttgtcggtcccagcggtggcctgcgggcggtctgcgcttccttcccgctccgtcgcggcggcctactgccgactgtccccgatttcgctgtcactcgcgttcgatgccttctcttcctgcgctacgcaggcagctcctgctaccgtcccatcctgtttgttccgtctccgtttttcttgttggctgtctgggttgcacggggtgtagctcctgttcggctgtctctttgtgattgctccgacgtctcggtacacgccctctcgcgggggaacagcggggtgccatctccgtcggctcggcggcgttttcgtagggtgcgtgttgagacccttgctgcgtgctcgcgcccggcggcggtcgactttccgtctgtgggactcgctgaatgcttgctctgtgccattgtcgaccctcttgccagtccccagtgtacctggggctactgtacccgcctatggatctatgaattcacttgcctgctagagagagacagagtgcacacgtatggtctttgtgcggcaactacttcactatgatcgctcagacttggtatccaaccctaagtgtccaaccactatgatacgactggactgatagtaaactggggcaccttatacaccttggaatactatgtcagccattgcaggtatgtatgagttctatgtcctttgtagggacatggatgaatattgcccaccatcattctcagtaaactatcacaagaactaaaatcctcacaccgcatattctcactcatatggtgggaattgaacaatgagatcacatggacacaggaaggagaatatcacactctggggactgtggtgggtcggggccccccggacgggatagcattgggagatatacctaatgctagatgacacgttagtggtgcagcgcaccagcatggcacatgtatacatatgtgactaccatgaaccaaggacatgtccctactgtg

SEQ ID NO: 624587 - DNA, 183 bp, Homo sapiens
aagtagtagattagccgatgcttatatatatgcgtgtgttaggagtgggatgtataggggataagcggggtgatgcctgtaaggggcagtagcctcctaataggggggtaggggctaggctggagtggtaaaaggctcagaaaaatcctgcgaacaaaaaaacttctgaggtaataaatagga

SEQ ID NO: 624588 - DNA, 260 bp, Homo sapiens
  misc_feature (250)..(250): n is a, c, g, or t
gccggtacccattatgaagcagtctaaatataccacagacacaatgcaggaagggcctctttgagtgctatctacttgaaatagctaccctaaatgttggctacaaattacttcgattaactatcatgcacatgtcaatcataatgtattgaaatcgtcttcattgtgtagatttattctcccatggttatcgcgggatccatctagagatcgtacctgacaggcgatgctacagcttggctggtaatcnatgggtccat

SEQ ID NO: 624589 - DNA, 231 bp, Homo sapiens
tgcaacatgaaatatagctttgagattaaaaacccaactaatcagaaacatgaaaaccagtatgttttaataaaagcctgttgctggttctaggaataactagtaggcatagcatgtatcctagtcatagttggactatctaccttacagctttgagttggagtaagtgtgtgttccacaagtagccaattactaatagtccacctactagcagtgtatctatagcttaca

SEQ ID NO: 624590 - DNA, 349 bp, Homo sapiens
  misc_feature (105)..(105): n is a, c, g, or t
  misc_feature (201)..(201): n is a, c, g, or t
  misc_feature (245)..(245): n is a, c, g, or t
ggatcccccccccttggatacctcctccgctctcctccttccagggtctcctctgcatcactccctggcctcccaggcactacctccccttcttgtcccctagancattcggcactagatctctgtgggccatcacacagacttcctcccatcaccctctcagatcctcctctgcggccccatgctaggtgggagccccantgtcccactaattttttttttttggctaaccacgtgctctcacnccacagggtccattggactgcctgctctggttgccacactgccacggggtgcggtcgctgatcttcaagagtccccctattcctccagcaggggactaacccac

SEQ ID NO: 624591 - DNA, 275 bp, Homo sapiens
tcatcttgggcctgtgttatccatcacattcgcgtggcagcgcgcagccgggaccgaagttcgataagcaaaggctcgatggtagcgttagtagctggttccgaagcatccagacgcgcatcgtcggtgcggtcgtccgccacccatatgacacgtcaacaacggaatcccgcgacgagaaaagaggtcagagtgccttccaccgacacggcacatcacaccactgacgagcgagagataacacaggcccaagagataacacaggcccaagatga

SEQ ID NO: 624592 - DNA, 415 bp, Homo sapiens
acccactggcccctggtcgctactggacagcaaacagaaacacagcttccaggccagataagcccgccataggcctgctgccacaggacacttggcaaagacgtgatggtagggtcaggatgacagaaacagtaggctttgcaaaacctgcagtcctcttcgttgggagtataaaagacagacaccaagtgcagcacccaacattggactggatcctcaagccaccttaggagaggggacatggggacacagaggccctgaaggaggaagtcacctgcccctggttatgtggctggtaggcatggagccgcaggtgcaccaggcactgcagtacagacacccagaggccagggagcaccagccgggctttgcagctggctttctcgcccaccctggtatctgcactatcacctgc

SEQ ID NO: 624593 - DNA, 417 bp, Homo sapiens
tttcatccacctcggccactcctcttttctagtggaagactgtgactgcacctgggactctgtttacaaacaagagagaaggacttgggggtgagaagcgggtcactgtcactgaagcctcctgtgcaaaccacggaaactgaagttactccgggcggtctcaggatttcctgctctgctttcaggctctggttcttgagctacagtcagactggtggttaattcctcttgaggccaagtttcattagctctcattatctaggatcagctagccaaactggaaacttctttgttccagccttgatttacagagcaaggatgggttcaaacaaacaaacaaacaaacaaacacacaccatgaggaaaataaaatgttcacaaactaaacagcttcttgcaagtgtaaatacttagggg

SEQ ID NO: 624594 - DNA, 1505 bp, Homo sapiens
  misc_feature (410)..(410): n is a, c, g, or t
  misc_feature (789)..(789): n is a, c, g, or t
  misc_feature (1505)..(1505): n is a, c, g, or t
tgggggggtagtaaaccggtttatatggggaacccgtgggttaaaaattaagggcactccaaggcttatatgggttctcctggagggttacaggtttgggtgggcgtggcgtcttagtggtattctcaagaaaaaaggcaagatgggacagaagaacgcgactcttatacgagaagcgtgtgggtgttctcataacagcgtggagcgcgacagagggcgggtgaacatagcgcgcgtggtatttctcaacacaacgcggagccccataggcgcccgagctctcagacacacacatagcgcctctcgaggaagagcgcgggattttgtggcagcgccaccactatagcgtgtgcattctctaatacgagagagtctctcaagtgtgagaaacgtctctattatatacccangagtgtgtgtcttttttctatgtgcacatatacacacccaaccatcaaccaagaggtctcacaaatattgtgtgggaagtgggcgtgggcatatataaacagagtcacttgtgagagaaaactctctctgtggcaaagataacttgtatcactctcacacaattctcacgaaagatgtggcgccaaagagaggtctcgagggggaaaaactcgaagcctgtgagaaagaaaagcgtggcgtcctcacggaggggtctctataaatctcttgtgggggtgggacaaaaatctttctacgaagacccatgaagagacaagagtgtgtaaaattctcccggcgggggttcacaccacggatgctgtttcccccaccgaggtntccacccgagaagaggggccgctattacctcacgagagacgcgtgtgtctgagggacacgagaaagatctcctcgatgaaacaagggtgggtccccgtggggagacctaccagaggtggaacatccgtgggcgcggtgggtgtgcaacaccttcttatgaagagttctgccaccccagtctatagaacaaagaaccaggggtcctttcccttcaccacagagtcttctgcaactgcagcacctcggggcgcaacacacggcggtgcgacaccacatgttgtgcggacacccgccgatatcccctctggaagcccacacagagagggaggcgagccgcggtggagacccccacaactattgctccgccacaagagggcagcaccacactggtgtgcggctcaaacaactccccaagaggggcacacttccggggggaacgggggggagaagcaacttctccccacaaacgttcctccccttagtgggaggaggcagcactattaccaagcgagaggctgttcctccccggagaagaggcggaggatgacaccgcgggcagacaaacaaagcccagcgggggggcggggctaggacaataaaagcaggcgggttctctcagcgaggtcacaccaaccaagtcggggcggggagccagaagtcatcacccgagtagagcagagcctcccgaaaagacaaccccaccagaggagagggtn

SEQ ID NO: 624595 - DNA, 377 bp, Homo sapiens
gatcatcaaggactttatccaaggaggaagagaccacgaaataaaacctcccacgtttgtctgtacatactgggctctgtgattcacatagatcagccattaaaataaaacaagccttaaaaaaaaaaaaaaaaaaaaaaaaaaacctttaaaaaaaaaaaacaaaaaaaaaaaaacaaaaaacagtggtgtggcgcgccgccgccgccgcggccccaagaaaaaaaggttgctagataaaacaacatgctgtggtggggggcgcgcgcgggccaccacaatgagtacatagaagacacggcggctcaataggggtgtgtcacagaggagaacaaccgcgtggacaacacaggggcggcggggtcccccccaaggag

SEQ ID NO: 624596 - DNA, 110 bp, Homo sapiens
ttaatggaacaatgtaaatgcatatagggtgatattactaagtgccagctaacattgttcctttaattacagtctctatgcctaacaatatggaatttatcgctagaata

SEQ ID NO: 624597 - DNA, 203 bp, Homo sapiens
tgttatatgagctgtattatttgccagacatagcctctagattatttcctctaattcctacagtccattaagataggtagtatcatctccattcaattgatcgagaaacttaaaggatcataaagtagttataataatattactaccttattatgatgtagtagtagtattacaaggtcatagctgtagcctgctgtcaatca

SEQ ID NO: 624598 - DNA, 118 bp, Homo sapiens
aaatgtccaggttcagcccggtgctctcatgagtctaagaaccgcaccacgagccaaccttgcagcagaatcctgcagctctggcgcgatgtaacctagccagcgcaggacacctgcc

SEQ ID NO: 624599 - DNA, 403 bp, Homo sapiens
  misc_feature (213)..(213): n is a, c, g, or t
  misc_feature (220)..(220): n is a, c, g, or t
  misc_feature (230)..(230): n is a, c, g, or t
  misc_feature (265)..(266): n is a, c, g, or t
  misc_feature (269)..(269): n is a, c, g, or t
  misc_feature (386)..(386): n is a, c, g, or t
tgctgcaaacatattcatactcaaaacactaggaatcgcccgagcagaacactgaggcactatctggtacactcataagtgtccatctattctgcccaacacccacattgccccaacatctctgagcatattttttacttttcctctcacaaatgtctcctgactttacattcccacagcagtggtctccaaatgctggtcatgccctaaatnatgtttncagagatccntcgtgaaataagaaacaaaagccaatgtggagagnnttncttagatctaaattcctttcatataagtagctgttactttatcctgggaatatgtccttcctaattgttttggtactaaaaccttttttttttttttgagacggagtctcgctgtcnccaggcttggtctccca

SEQ ID NO: 624600 - DNA, 131 bp, Homo sapiens
gaaaaacagatgtggatagatatgaagaagaaagataacatagggaagaggacggatataaagctccaggggggcagatatacagggtcaaatacgggtaatcttggaaagcctcccggactagggtaaca

SEQ ID NO: 624601 - DNA, 456 bp, Homo sapiens
tgcaagtgagacacaatcagagcagtccaacttcgcagtggacagcccagaagcactggagttctggataagctgaagatcatttatgtcacagctcctgacaagagaaggcgatagctggtggctgcagagggagaatatgaaatgacctgcattttgggggatggggaaactgaggcttggagaggttacataaatgtcctgaggctagacagcccagtggtctctggactttgtggtgggggaggaaggggacctcctgctttgccttcaaataccatgggccattgctcccaatcaccactcaccacgtcctgctgctcctcaaatcccagctcaagggcggcttcctttggcactcccctgcatccccctccaaactctctgaacattttctttatacacactcgtatcatgcaccatgccctgcgaactgtgaatatgtctgttcactcg

SEQ ID NO: 624602 - DNA, 177 bp, Homo sapiens
gcaaatgtgacacactcgttgtaagatgagatggagatcatacgaaagtagtacctccgaccacagctgaaatgaagttagaaatgaacacaagaaagatgtcattcagcgaattctcaaagtatataggacatgaacatactgctaaagtaacctaatgtatcaagagagagaaat

SEQ ID NO: 624603 - DNA, 169 bp, Homo sapiens
  misc_feature (50)..(50): n is a, c, g, or t
acctctcggagcccagcccaggccgcaccactagatgcgtcagcatcatntttttctttgccacctgcgtgatgcgctcctgcgactgattcacgggtcacaaaccggtagctcattacctttttattttgccaaaatatttgtcaattgaaccggatagcttgccgat

SEQ ID NO: 624604 - DNA, 283 bp, Homo sapiens
tgacgctagaggctccgggattatataaggaaatatgggcatagtataggtaataagatgaaaagacacacacttcacaaaacatagagtaaagataaacatgaaactataacactacttaaaaattattttctcccaaattattttagcttgtttgactagtataataatatgacacactgccataaagtgggttcaacgtcgccgggagaaacagttttcttcttcatggagtccatctcagcagcagagaattttctcccacattcatctcccaagattg

SEQ ID NO: 624605 - DNA, 134 bp, Homo sapiens
tagaggatcccctcattctacccacagactcactgccgtttgtattattaaaacacacgcgaataggatataaaaagaagcaagagtactgggctttaacgtgagtcatatctcatttctgccaattcctatgt

SEQ ID NO: 624606 - DNA, 296 bp, Homo sapiens
tggcccacgcgggaggcaacggtcacggtctggccatcctgtaactggcgcgaggcggcgtcgcgcgggtggatccacagggtgcagcgcggcttgccggacaccaggcgggcgctgtagtgcatccacgagttgttgctgcgcacgtcacggcggccgatcagcttgagggtggggcgggcggctggttcgctggcgtcggtcgcatcttcggttttggctggcgtggtgggcacatcggccgggaagacgctcatcaggttgggcagctcctggcggatggccagcggcagcag

SEQ ID NO: 624607 - DNA, 336 bp, Homo sapiens
ttagagttccatgtcccaactcccttgggcatgtggtgcctctcattttttttggatccctgtatattctcctaatttgataactaattggttcatgtgaggttttcattttccaaatactaaaagttttactttgtgctggatggtgctagaggttatggatatgaattcaaaatcccattttcccttttttttttttttttctctaacccccactttagggaacagaagtcaaagccattacatattcagcaatgcaggtttataatgaagagaacccggaagtttttgtggtcattggccttttagacccccaaaaattaaagactccttcga

SEQ ID NO: 624608 - DNA, 107 bp, Homo sapiens
  misc_feature (61)..(61): n is a, c, g, or t
actcttccttcgggtgatccgctaggcgagaagtgggacgcaccaaactggaggtcacggntggtcatcaagtccaactttaaaccctcactgctggctgatgaatt

SEQ ID NO: 624609 - DNA, 454 bp, Homo sapiens
  misc_feature (118)..(118): n is a, c, g, or t
  misc_feature (268)..(268): n is a, c, g, or t
tttttcccccggggaacaggttggtccatgatcgcagaattaatcgcctccccataaaggaagtggcccccccccagacgttcccgaatcccggtcacattcctctcatcatgtcgcntccatggggaacgctttttttttttttttttttttgagctcaaaaagaggtttcattttcccctatcaaactaaaaaaccaatcgggttttacctttggattaaagtcacttaaagtggggcaacagaatctcactcatgttagatcttngtattcagcttcataagatcaaagaggagtctttcccttttctcttttaccctcaggattctcatcccttacagctgactcttccaggcaatttccatagatctgcagtcctgcctctgccacagtctctctgttgtccccacatctacccaacttcctgtactgttgcccttctgtcgtcttctc

SEQ ID NO: 624610 - DNA, 1581 bp, Homo sapiens
tggcttcttactatgattagccagaagtcacgcaaaaaaatcccttccccaagcggaacgctttcccccgaagccagaggaagcctcgtgtttgtgtctcaggtgcgtgactctccgagcattcttcagtggacccgtgggaattaacagcgaggccaccaagaaccaccaccagtgtttgagagtggagaagtgtcttcttagatattcctcacttttagaacccatattctctcatgtgcgatttgtgcgcactttctcatagatatctcaccagaaagggcatgtgtgtcccccatttctctctatatatgtgacacagggtggtctccctttctattctcccacaaggctgtgagacctctccacaaaactcctatatacacaataataagtagtcactgtaggagagggggcatctcacactctcagagccctctatctgtggtggcccttatgagtctcacacacactgtgtgtctctctctctctcacacgctattctccccacataaagagacctctcccctgtgagagagcccccgagtgcttctcaactgtggtgagcaagacactgtgtgagagggcgcacacagaagggcctctctgtgggacaagtagtgtctcccagccgaggagggaaacaacccgtgtggtctccctccccgtgagtgtgctcttacacacacccccacacattgagagtgtgcttatcagacaacacacgcctatatctattctccgaggaaacattgagcggcactcttacagcagcccagagtgtggcccccctctctcctctgacacacacatactctcacccgcagagaaactttccccgtgtgcgccacacaacatgagtgtgaagcgcccacacgagagacacttccttcgaaatactccgagttgggccccccaacggaaaatctccgccgctggtgggctccccacttctcgcacggcgcaaggccgcaccacctcttccgcagggctctccgccaccttatcaagcaggagccgctgcgcgcccccccacgctgttgttttcttcccccgggggggttcctcccctccccccaacagcggggtgtgcccccccccctagatgtggggccccctaaaatgtaggggcgccgtttgcggcccccctatcacccgttgggggaaaagttgtgggcccgcacaaaccccaacaccctggtgggggacaccccccacgtgtttctcgccgcgttcctcactttccgcaccgcagcgaatacatgtagtccgtcccccctcaatccggtcggggggtacccccccgggagaagtatcccctcccgagaggtcagacggacgtactacgattggtgcgcgcccaccacgggtaccgattcctctcgggtggtttgtcccccacccgttttgtgtcgcggcggcccgcctagttgtttccttcccccggcgctcactctctattaacgagcgaggcggtaaactaatttacctaccgagcaggccggcacgcggcccacacacgcagagggagttcaccccccgctttgatcaaacgcgagcagcacactatttttacacccg

SEQ ID NO: 624611 - DNA, 844 bp, Homo sapiens
  misc_feature (427)..(427): n is a, c, g, or t
  misc_feature (722)..(722): n is a, c, g, or t
  misc_feature (724)..(724): n is a, c, g, or t
aatggtcctgcaccattatcgctccggcgtttcgactctgcggaggaatcgatgatcccttgcctatggtgcttacaagagagttgaaagccgagagattctgttcgagctgggtgggttccttgaagaagctaaccgtctcgacaatgtccccactgaaagacagatacagtgttttggcggtcctcattttcaggggagaggtcaccatcaacaccgggtgagagacgaccttgagaccatactgacgtggtgtcagcccgctatctctcatgaagtcgaattcggctcgcaactcttccgctgcgtcggcaatgtgctcgaaccaatcaaccagatccgtcgtggtgtagagacgacacaagtccaagtaacccggtcgatagccgaaccaccgtcccatctgcatcagcgtgtcgtacatttnggaagcccgaagaaaatagctaacacacaggccttcaagcgtaagtcctcgagccagcttgtctcctccaattgcgatgaccttcagccccgtggcgctgtctacatagtccaacgcatcctttgcagtgccattgatcatgcgcacatcgatctgctccaacagatcaggtaacgctcgttctatctcgaaccaatcgtcagctttacaccgagacccctctcccatctgcttttcaatttcgtggcttgtcgtccggatgtctctctcccacagattgcagagttcggccaanangccctcatggtcaatgcgccttctgagccgctgcttcaactgcatgatgtaactgcgaacctgcccgtgtacatgctgctgaccaggttgaatcgcgtgacatgtactagcatcgagctt

SEQ ID NO: 624612 - DNA, 874 bp, Homo sapiens
cagtggtattcacccaccactgccaagttatagcttgttttggaataagtggtgggtgagataccactgcctaaatgggaatccggctatgatcggcagtggtattcacctcaccacttatgggttcgctagttgcgtacctggattatctgtactgagggttaggtatgctacttctcttcaagcctatgccagaataatccatggactccctccatatttgattctgtgtaacaactcgcacgtgctttcaggagacacgaccgttgcttgctcatatacaaatgtatgcataaacatatcagagcttgtggggcatgaacatcacagtttcagtcccactattatgcgctctgtttgttacacacacctgtcaccttcctgacctgcattgctttgcgaagcctaaccgcctaccttatggatgatcaatcaataacctctctgtgcccacgccatcatgtgatttgaccaactgcttacctttccacctgctataaatagttggtactctacgcatggcccattcggacacttcagtgttgcgacactaccaaatctcagctacttctaggtaactaaccaagttttcacattatgtgtccctccgctacaactcgaccctatacaaggcggcttcttctccacgcgggacatagctctggggcattctctacgatcgactcccgggcatccacaattccccgaatccttcaaactatcaactattatctggtggctctctactgactcaaggctgctctttccccttatctgactcatgacatcttgccacaccaagccaccctagacttcgttcagcattcagctcgggccacgctgcactactcacttttcctcatctgcacttgcc

SEQ ID NO: 624613 - DNA, 339 bp, Homo sapiens
  misc_feature (51)..(51): n is a, c, g, or t
  misc_feature (127)..(127): n is a, c, g, or t
  misc_feature (147)..(147): n is a, c, g, or t
  misc_feature (243)..(243): n is a, c, g, or t
  misc_feature (319)..(319): n is a, c, g, or t
  misc_feature (335)..(335): n is a, c, g, or t
gagtgaccaagtcctcatggaggattacagtccgacagttgtagagcatgnctcgtctctctgaagctaccgctcggatgcactgctgccatgaggtccaacctaaacctgtgaaggaagctttccncttactgaataaatcaatcntccgtgtggaaacacctgctgtcaatctagatcaagacggaagagatccagatggagcgtagatgagggtgctggtggcatcaatggtcatgctgncagccctgctcctgtgaacgggatcaatggctacaatcgaagacataaatcaagagtctggcttcccaaagcctcnttcaaggctggggttnctct

SEQ ID NO: 624614 - DNA, 1020 bp, Homo sapiens
agacgcgttgggatccgacccgatgcataccgagtgaagggtaaattactacatatgttctgggccaccgagatgcatctaagttcgagattcccaaatgaccagaggggctgagcatctctggagctaggtcgttggctgtgggtgcttatagtaatcattttcgtcagtccgctcgccacctacacaattaggaactggacccatgcccgaattaaggctgatggtgctgaacactgttggggttacatggtgacaggctttcgcaccgtggtagagtagttaaatatgatgggtttaatcgtagcataaattgcacattctgaagggtaataagcattttgattattgtgttggtgcaagagcatggattaacacgagcgaaacggttggagcaagatgtgattcttagatggggtgaaagtagtgccacacgatatcttgtaatggcttatttgcattgtgtgaaactgtggaacaatatgactgtgatgcacgaaatgcatttacggtgtaaaggagtctatagcattgacatcaggctatgcgttgattttagtgatccgggtgatgagacagttatacttgtgattgtccattgatttattattgaaagtgctatcatttttcgtttacgagtgtattataaagcttgttttgaatttttattccagatgggtctcattgtcctgatgctgtgattgtttcttgagcttgtagactttcgttgtggttatccgccatgtgtaacgtgtgattccgaatgatgttaaggctgtggcacggtatgccatttttggtaacggcgggcaccggtggacccggttatgaatgcccatggcaggcatttcggggaaccgatcccttttgcgaaactttatgtgaaccccccaagagggttttttcccagaaaacttggcgggctcattttaacccaaaaaagagggtttcctaaaaaaaacggggggccaatacccaggcgcgcgagacccgcttaaagcccatttttacgcaggcgcc

SEQ ID NO: 624615 - DNA, 397 bp, Homo sapiens
  misc_feature (88)..(88): n is a, c, g, or t
agttttcagtattagttaatacagcggtccagaaagataatagactatacttcctactgtatggagaaaggatcagaggttatattantatttccttgacctgacatgcccaaattgaatgtgatgttcagtaccatacatttcaatgaagcaaattataataagaaagaaatttttttcatgggccatgcatatccataatagaaataacaggattgtagggtaaatggatatatcattgcataagaaatattgtctacttagttgcatgagttttaaatcaaatagagatggatgtgagtcctacttctctcctatctgtttgaacatggtctctctgagcctcaatttcctactagctaaaataaagatactattatcaacctcaaaaaaaaaa

SEQ ID NO: 624616 - DNA, 1634 bp, Homo sapiens
  misc_feature (354)..(354): n is a, c, g, or t
  misc_feature (422)..(422): n is a, c, g, or t
  misc_feature (682)..(682): n is a, c, g, or t
  misc_feature (1062)..(1062): n is a, c, g, or t
taaaagagtttccatcttaaatgaaatgacttgggaaataacgtacttccccatgaaccccaatactacagttttccggaagtcttcaccagataaaatatacccaaaatttacatcccgctaatttaatttgtgtaatctgcccacacacttgttcaagccagataatttgtgtttccatgtgcacaaacacaacaatctcacagaaaagccaacccattcaacacaaagagaaacaccccatatagtcttctcgagaaaagagggcaacatctcccgagagagatatagccatttgtgtagaacacgaggcgtggcgtgtcttctcagcgcgaagagggtttctcgtggccntatatcaaccagatgtgatatatagagggctgtgcgcaaaaagacactgtgtgtctcccaatatcacncgagcgcacccaagaacaccccgacgcccactctctctatactgtgtgtgtcgccagccaccctgtgcgcccacccaatatatacatgtggtgcggcgcaaacgcaagtaatatctctaaaatgtgtcgtctctctgtgcgtgtgtatgatgtgcgcagtgtggtgtcgtctgtagacaaactctctcctctctgtgtgggcattttatagcgtctcgtgggaggacacaaacacacactatcttctctgtgtgggcccnccccaatttataaaaatatcacccggggatataaagagcgcccttctttctcgcgaagtctccctataactgtaaggcgccctcctctgttggggtgctgccggagaatatattatccccccgccgttgtaatgttgtgcacgaaaaaatgtgttgggcgccccggtgtattatgtgcccacacttcttctgttgggagaatcccaccgagcgctcctccggggaaatcttccaacgaaaagacgaaggggggcgtgtgttgcaccacgggggccgaaaaacactctgatgtgggcggccatatgggtgccggaatcacctttcttcttttatcacgacccctcttctcttcctccggcaggggacacttttggttctgncgcgcggctgtggcgaggccacaatttctgttgtggcggggtgttgcacaccgacgggggggcaggacaaccgcgtgttgggggcgaccctctcccctattctcttcccccgcggaggatttcctcgctctagttctttctccccccccgaggtgagagggccgccgcgtgatggagggcgaggaagaaaagagccaagcgccctactctccccaagttggggctgctggcaagacacagagagtttctagcaatgatggtggtcactcttacagcgcaattttaaaacggtcttcccccagaggggggagaggcaagccctcttttgtgccgcgccgcagggatgttgcaatcacagcggggtggggtccttcccaaaacccgagtgttgggcacccaccacgcgggtcagtggatggggagtgggtgtatggtccgcgtagttgtgtctcttcgtgctggggggtttaacgcaccggcggcgcggtgctaactcaggtgggttgtggcagcaaggcccttttggtgtgtttctcggcgccccccttctgcggcgaagagggtgtttgtcc

SEQ ID NO: 624617 - DNA, 717 bp, Homo sapiens
gggcgttggttgctgtcacctgggagctcctgagctgtttggtttagatacctgttcagtcttggggtcagccctccctctagtcactgcccttttagctctggatgtgtactgggcccctgcactttcccgtgctttgagtcactgtggctgcatggccgggcgctggccggatggaacacctcccccagcaagggaccagggaccagagccctggcctgccctggctgtagcccgtgctgtgcagagggcctggcactagtatgtatttgagattcttgccgcaaggtgttagcacttcactaccctagttgagtctttgagattttatagtgaatgtgaagctagacaaaagtacagtatccgagagtttgacaagaaactgcagagttagctacagctaggactcgtgtctggttggggttttttagtgtatgtctttcgtaaagtcatgtggagcctcaatttaagtaccaaagtctaccctggtggtcataaaataggcaggcctatgaaggaaggccttttactcgttccatctgggtcccagcccgcgagttgacccacgttgctgctcctcacaccatggtgatgcaggtctcgtagtgtgggcacaggcgctggctacctcatctttttagtgcctgtctcctcttccacaggatggggtcccacagctgcagcagctggcccacgtagttgagatgttacgtaatc

SEQ ID NO: 624618 - DNA, 128 bp, Homo sapiens
gctcaccaggccaggtatggaggggatgctcatttgatgaagatgaaaggtggaccaacaatttcagagagtacaacttacatcgtgtgcagctcatgaactcggccattctctggactctcccattc

SEQ ID NO: 624619 - DNA, 923 bp, Homo sapiens
  misc_feature (1)..(1): n is a, c, g, or t
ntaatcgaacgctcacagagacgtgaagacgcccaagagtcagacagaagttgttgaaaagtctgtttcgcagcactttacggaccttaatgggtcgcgccccccaggtgttttcataagcgcgttctcggctaagagggggtcaaattcgtaagagggctcttaagcggctctgtcttgaaaaaaggtggcacaaaattccagaatgttttccggtttctcccccccattgtgtgcagaaacttccttcccttaacgggaccagaaattccctggtcgcagcccccgcgtaatgatcttgtgtggttccgagcggtaaaagaaacgacggggttcgaacgaacatttcttaatagggaagtctttaaatttctgtagggccgcttgtgaagacccactaattgggccttcgcttctccttagtaattgagtaagccgctgggggccctccaatgtgagaattaattatgccgcttgttaccccccccttacggggcaccctgtggggtaaaaaaaacaacgcaaggttgtcaccacactcttgtgtccttgtcagacaagatttatctccccccatctaatatgagacgtgtgaagacaggtcttatgctcccgtttacgagcccgtccagtgagtagtaaaaatcccccccgcgcgaaccacgctgcagaggggtcaccaaaaggtttgtagcaactgtttctcaccccaggcccgtgggaggggaaaatccccctcaacacatgcgggcgagagaatttctgtcccccccggcaaacctctgcgagcaaaaaaatccgaagaccgggaacatggagcaccacaactgtcaaaaggaagtgggggcaaacaagaaaaaatacaccccagtagtgtccagggagaccaatttccaaaaaacccgaaccaaccccacaaaaca

SEQ ID NO: 624620 - DNA, 436 bp, Homo sapiens
cccctcacggattactcaagattaacacacctgcgcgcatacaaggacacaatcaacaaagtaaagagacaacccgtagaatggtagaaaatgtttgtaaactacccatctggcaatttagtaaccagtatatataaggagctcaagcaactttataagaaaaaaaatcaaataatctgatttaaaagtgggtaataaacagacatttctgaaaagaagttatataaatggtaaataggtatataaaatatgctcaacattattgatcatcagagaaatgcaaatcaaaactacaatgaaatatcatctcaccctagttaacatggcttttatccaaaagacaggcaatagcaaataccagtgaagatgtaaaaagggaacccttgtacacttgtggtgggaatataaattagtacaatcattctgaagaacagtt

SEQ ID NO: 624621 - DNA, 256 bp, Homo sapiens
cagctggaacgatggactgcaccgctgttgactacaacactccacgaacgagtccaccctgcagctggtgctccgtcttagaggtgggctgcagctcttcgtgaacgagcctgacctggtaagaccatcactctcgactgtggagccgagtgacaccattgagaatgtccacggcacacgctccaagacaaggacatggcatccctccttgaccatgcagaggtttgatcttttgcttgggaaacagctggtggtc

SEQ ID NO: 624622 - DNA, 136 bp, Homo sapiens
  misc_feature (9)..(9): n is a, c, g, or t
ctcaggtanctcgtaaccttctgacacgttgggacgtgagttcgatccccgcaaacgggatctttctcactaaaaactaaaaaaccaaaataaaaatgccaagcgggtggagaacgattaattcgttagtacacaa

SEQ ID NO: 624623 - DNA, 122 bp, Homo sapiens
ttggtggtgcctcagccatggcctggaccgttcttcttctcggcctcctctgctaactggcacaggcctctggaaacctccaattgttctttactcacccaccccggggttcactggccccg

SEQ ID NO: 624624 - DNA, 535 bp, Homo sapiens
  misc_feature (1)..(1): n is a, c, g, or t
  misc_feature (124)..(124): n is a, c, g, or t
  misc_feature (161)..(161): n is a, c, g, or t
  misc_feature (198)..(198): n is a, c, g, or t
  misc_feature (202)..(202): n is a, c, g, or t
  misc_feature (216)..(216): n is a, c, g, or t
  misc_feature (249)..(249): n is a, c, g, or t
  misc_feature (268)..(268): n is a, c, g, or t
  misc_feature (302)..(302): n is a, c, g, or t
  misc_feature (312)..(312): n is a, c, g, or t
  misc_feature (357)..(357): n is a, c, g, or t
  misc_feature (381)..(381): n is a, c, g, or t
  misc_feature (395)..(395): n is a, c, g, or t
  misc_feature (398)..(398): n is a, c, g, or t
  misc_feature (400)..(400): n is a, c, g, or t
  misc_feature (516)..(516): n is a, c, g, or t
ngcggggcactccaaacaaaagagaaaagcaccatttagatgttttttcccatttttctttctttccgccacggaacatgcacaccaacagagctcagggcactttttgcccttttcccttggnaaaaggagggacagaagatttaagaattttgaaaggntttttttcttgttttatttttttttaaagttaatgcnattnatctaaaacgaggnctgtttttttaaaaaagttctaaaacaacaggngggaaacacatgggaaganaccccttgcggagacctgcttccttacagatggnggttcttttngtggagagttttaggggcagagggctccctgcgccggcaggtccngcccggccaccctccactcccctnccatcacccctccnctntncttttaaaaagcaaaatcccacttttgggacttgggttgtcctccgatccctgccggaaagttcggcggctacttggcgtggagcttggccatctcctgcccgtgattccgatgcncttgctgtcgaagagcagg

SEQ ID NO: 624625 - DNA, 101 bp, Homo sapiens
ctagagttcacgtgcatgattccagcagcagtcccgatatgtttctccttgatgcttcttttaaatacggtttttgtttaaaggatcgggtaccgcgctcg

SEQ ID NO: 624626 - DNA, 1260 bp, Homo sapiens
  misc_feature (996)..(996): n is a, c, g, or t
  misc_feature (998)..(998): n is a, c, g, or t
  misc_feature (1048)..(1048): n is a, c, g, or t
  misc_feature (1103)..(1103): n is a, c, g, or t
  misc_feature (1105)..(1105): n is a, c, g, or t
  misc_feature (1113)..(1113): n is a, c, g, or t
  misc_feature (1116)..(1117): n is a, c, g, or t
  misc_feature (1125)..(1127): n is a, c, g, or t
  misc_feature (1134)..(1134): n is a, c, g, or t
  misc_feature (1136)..(1136): n is a, c, g, or t
  misc_feature (1153)..(1153): n is a, c, g, or t
  misc_feature (1159)..(1159): n is a, c, g, or t
  misc_feature (1161)..(1161): n is a, c, g, or t
  misc_feature (1164)..(1164): n is a, c, g, or t
  misc_feature (1166)..(1166): n is a, c, g, or t
  misc_feature (1174)..(1174): n is a, c, g, or t
  misc_feature (1176)..(1176): n is a, c, g, or t
tgggctcctgtctatctggggaggccccgtgcaggggtagggggtggaggcttcttttctctttccttttcctctgcctttcccctctccctggaggaaacggtagcaggatttcttttaaggggaggccgctatattttaccagcaggtggaaggtggcgttattcgtgcccacgagctgcacatggacccctgcatgaagcgtagtggggcacagagcaggcgagccatttccatctcacagcgggagggccggcgacaccacacgaagtgacatgcaggccctcctcggaagccggcgcttagatccctaattagttccacgtcgactgaatttttcagtacacgctcagtggcaataaagtggaagttgccgtcaaacagatcatcgctcgaaaagccatggagcaacgaggtgctttctcgaaccccgaggccctgcatctgtactgggacatccctgagctgaatggcttctgagtcggactggctggcacagggaggatggaaaccttgaatggcctggcgcaggagtccctggcttgcaggcaagctgtgcttaagggctgccggtgggaactggcacctgaaagaaggcatttgaagagggaggtggtgggtgctcctgcctcacccaggctggggtggagggaactgcagttttggtaacgactcctgggtcctctctgtgcctgttgctaaggcttttgtccgctgggctgtctggtggctaaaggatatggcttctactgtgtggtctgccgagctgtccttttgcaacagggcctgagaccactgacttcaggggctggagtcacagttgtgtgggctttgggctgggttctgctgagcccttggggcctagccatttcctgccaataatagctaacactgctgtagtacataccatatgctgggtgctgttccagggccacgatcctgagtataaccctagaaggtaggtgtcatcattatccctatttggaagatggggantnaggcccaagttcagggagcttgcccaaggtcacatgggctaaggcagccntttggaaagagttccaaggaggatagtgagatccctcttggtacggggtactccngnatatctanatnntcaaaaannnatacccnantgaagagatcaatccgngtcatntnccngntcacttgncnttgtcacagctcacagatgagcctcaactgaatatggtgagaacatgcagggtctgcaatccccagcaggccaggaggtctcca

SEQ ID NO: 624627 - DNA, 996 bp, Homo sapiens
  misc_feature (96)..(96): n is a, c, g, or t
  misc_feature (103)..(103): n is a, c, g, or t
  misc_feature (108)..(108): n is a, c, g, or t
  misc_feature (112)..(112): n is a, c, g, or t
  misc_feature (115)..(115): n is a, c, g, or t
  misc_feature (128)..(128): n is a, c, g, or t
  misc_feature (135)..(135): n is a, c, g, or t
  misc_feature (143)..(143): n is a, c, g, or t
  misc_feature (155)..(155): n is a, c, g, or t
  misc_feature (167)..(167): n is a, c, g, or t
  misc_feature (207)..(207): n is a, c, g, or t
  misc_feature (228)..(228): n is a, c, g, or t
  misc_feature (237)..(237): n is a, c, g, or t
  misc_feature (247)..(247): n is a, c, g, or t
  misc_feature (254)..(254): n is a, c, g, or t
  misc_feature (261)..(261): n is a, c, g, or t
  misc_feature (280)..(280): n is a, c, g, or t
  misc_feature (291)..(291): n is a, c, g, or t
  misc_feature (303)..(303): n is a, c, g, or t
  misc_feature (314)..(315): n is a, c, g, or t
  misc_feature (333)..(333): n is a, c, g, or t
  misc_feature (365)..(365): n is a, c, g, or t
  misc_feature (376)..(376): n is a, c, g, or t
  misc_feature (383)..(383): n is a, c, g, or t
  misc_feature (389)..(389): n is a, c, g, or t
  misc_feature (412)..(412): n is a, c, g, or t
  misc_feature (454)..(454): n is a, c, g, or t
  misc_feature (467)..(467): n is a, c, g, or t
  misc_feature (483)..(483): n is a, c, g, or t
  misc_feature (532)..(532): n is a, c, g, or t
  misc_feature (573)..(573): n is a, c, g, or t
  misc_feature (845)..(845): n is a, c, g, or t
  misc_feature (896)..(897): n is a, c, g, or t
  misc_feature (907)..(907): n is a, c, g, or t
  misc_feature (934)..(934): n is a, c, g, or t
  misc_feature (959)..(959): n is a, c, g, or t
tctacagttaaacaaagatataatcccaaagattctgaaaggaataatttacattgggaaaagtacacaaccctacagtcagattgggttagactncctttanaagantaanatnaattgtttgggtngaaatanattaacanaactgtatttcnaacgcatttccnttctttagagccaatcaaatgttctcatttgagccacgtnttgctgattgtcacatacagngaacctttngaaaatgaantaagtcnttgcctnctttagtctgttgaaaaanacttgagaatnctgagaaatctncagaaaaacannatgttttctcttgggaanaattgcagagcctcttgccaattaccattgtntttcagacatnacaaaanacgtancatttgatctaaggtgagatttntgttaccatatttccgcattgtaaatatttatctaatggaangcattcagttgcnaggttcagccgttttnccttggctagggatgtgcctggctgcatactcttatcaacaaaagattntttttttttttttttttcatgcctgaaagtagtcataacantgggagaatctgcagttaaatagataatactgtcctttggaaataaatctacatgagacttttctgttgatgttaaaagcaatttgtcccatttttcttgataccgtttaactaactctctgtgcaaagcaccatctatttttagattgcagaaataaatatggaaaggatcaacatttcttctgttccatccttcactttctaaaagctgggaaacagtattctgcaattcttttcgtttcatataattttcgtaagccatgtcaaaaacnaaggttgtccaactgcatggcctgggcaccttccagcccattgctatgtcnnatcctatccnaagtcgtaaaatagaagttttctgttntcttctcagtggttctagcgcttgnatttttgctcttccttgctgcgcttcattcctttttt

SEQ ID NO: 624628 - DNA, 850 bp, Homo sapiens
gcctgccgtccccctcgacctccactcgcctgcccggctcttcctcggatcactgcatgcacccgagtcctcattgcagtgatgcattgagggggatcccacatgtagccatgccccttccaggcagacagaagcagcacaggcccctggctgagctgtgccactggcgggtgcagcaggaggtgcaaacgcagaggttcaactcggcatccatgctggaacccatgttaacttgcggtttgaccagcgtaagagagacaaggaaggatgagtagaactgtagcgagtcaaagatgcttcagatgctaggtaatacggaagtccatgctcaaaccggtttgaagcggaggctcaggggctgcatggtgtggcatctcccatggcacctgttctggtccctcagtccccctgagtggtgcgacaccttccctccacaaggtgtgttggccgggtggccacggcgtgtcctgggctcgcatttgctcatgacagtgtctggagagctccggctttgagggctcttcctggggcctctaacgagagaggactggggggaccacgacacaaagatatcggggttcttgagacagcagaaaaggtggtggaagcttgggtgagtagaccagacagtatactagtagaattgtggaatcgtccaattggaagttatctcccgtggtgagttcgttaaccccgagcgtattgaactcggccaatggctagcagcacgggacactggggaacaaaacaagtggggcgatatcacctccttcacggcaacacacggcttagtaacacgggtccacggcctttccagagcaggcctgtgttctaccagtgaggcacgtgg

SEQ ID NO: 624629 - DNA, 169 bp, Homo sapiens
gccgggaaaaaccccctggcaggggtcccccttttggggtttgaacccacccgccagctcctctttgaagggacttccctgtttgggacggcaaaaaaaaaatttttttttttctttttgggggggggtaaaaggggcccccaaacctttaaataaacctttcccaata

SEQ ID NO: 624630 - DNA, 281 bp, Homo sapiens
ggaggcagaggaggcggagtgtggtgtgccacggggcagaggcataaggccgggtgggttgtgttgagaaacggatggtgaactggactaactgggaagaaaaagagaggcggagagggggaaaatggagcaaaggtaaaaggctggaagggagaactaggggggatacaaacacagccaaggaattaacgcggatttctctctgagagcagagacgaactggataaataatactaagtaggaattggattaattttagatagctgtgtatacagggagcg

SEQ ID NO: 624631 - DNA, 442 bp, Homo sapiens
gtcagggctgcgatacagacccggtcacgggtgaccctgcaggagtggaatgaccctcttgaccgtgaccttgaggcccagctcatactaccggcacctgctgggcgtggaggccatgctgtgggagaggcaccgggagctgagcgggggcgcagaggcaggcagcggtgcccacgagccctggcaaagtccccgagtgtactcatatgggcccggctgctaccgggtgctagcaggaccctcccgcgagggcccatagcatcccagcccggacgcggctccccaaccactcagagcccaacatgactacctggagactagcagacgtagaggcacacgccactacagactacaccctttgcttgaagtaacccctgaccacaacgcgctacgagagaacccaccccccaggaaactactgaaaccccccaatacacaccac

SEQ ID NO: 624632 - DNA, 2901 bp, Homo sapiens
ctccaagatcacccaggctgaagctcctgagggactcacatcagttatcttgctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtccccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctacgaaaaatgtgtcctgctacatccagaatctccttcttggacaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggagtctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttccttcctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttacaccttccatttccatcgtattctccagtttccaggatagatgttgctcatcgtctttacctaataaataagtttgtctgattgctg

SEQ ID NO: 624633 - DNA, 184 bp, Homo sapiens
ctcaactgggaccaacaccgtccacagcagctctgtccctgctggtgcccccccacacaccccccacacgctatccccgcgtggttggcgttttttttgttccggtcgggcctctgcacctgggtccatggttggttcggtctcctggcctgtgggttccgtgttcgggtaaagccctactgta

SEQ ID NO: 624634 - DNA, 247 bp, Homo sapiens
gatctcggcgctgggctggggtggcctaactttgagtttcattctccacatctttattttaagattcctctctctcattgtctggttctgagacttttctccaaaacttcaatcatgttcatcagtttgtctagaaacaaatgtaggggaagagttttagcaaacacgaaattctggccatggaatcaattccatttcatgaagttgtgttggccaagcaaacaacctcttcctgtgagccgcccgg

SEQ ID NO: 624635 - DNA, 419 bp, Homo sapiens
  misc_feature (2)..(2): n is a, c, g, or t
  misc_feature (40)..(40): n is a, c, g, or t
  misc_feature (67)..(67): n is a, c, g, or t
  misc_feature (71)..(71): n is a, c, g, or t
  misc_feature (130)..(130): n is a, c, g, or t
  misc_feature (253)..(253): n is a, c, g, or t
  misc_feature (255)..(255): n is a, c, g, or t
  misc_feature (304)..(304): n is a, c, g, or t
cnggggaagcttgaggttgcagtaagctgagatcacaccngtgcactccagcctgggcaacagagcnaacnctttgtcaaaaaaaaaaaaaaaagtctacagcataaacatctttaggcatgcataaaanctaattttggcctggtgcagtgacttgcgctataatcccagcactctgggaggccgaggcaggtggattacttgaggtcaggagttcaagaccagagtgaccaacactgtgaaaccccgtttntnctaaaaacataaaattagctgggtgtggtggcacacgcctgtaatcccncctcactcggaggctgaggcaggataatcgcttgaacccgggaagcagagattacagtgagctgagattgtgccattgcactttagcctggataacaagagcaaaactctgtctc

SEQ ID NO: 624636 - DNA, 88 bp, Homo sapiens
gcggcccctactactactactactgctcgaattcaagcttctaacgatgtacggggacatgacttacctgctaataaaaactcattgg

SEQ ID NO: 624637 - DNA, 173 bp, Homo sapiens
tagatgtgttagtgtagtatcagaattctccctctcttccccttcactggcccctcctctctttatttgtctctctctcttcctctctctctctctgtctctcctgtggctgtccacattgctgtgacaccattttgctgaaatgactatctttttcctattagaactggcgt

SEQ ID NO: 624638 - DNA, 107 bp, Homo sapiens
tagcaggagcgtaatcgcaccacagcagaagagcatcaagcgacaggactgaactctcagagcttgaagactgtctttctgaaataagacaggcagataacgaacta

SEQ ID NO: 624639 - DNA, 83 bp, Homo sapiens
  misc_feature (80)..(80): n is a, c, g, or t
ccccacctcgtgtataccaaaatttgggcacactcaagtccttaaggggaaaccgcgtataagaaaagtcagccctcccntat

SEQ ID NO: 624640 - DNA, 112 bp, Homo sapiens
tggagtatagggctgtgactagctatgttgagtcctgtacgtatgtaagttatatttgatcacgagaaacgtggtttctaccacagagagttctccccccggtacatgcata

SEQ ID NO: 624641 - DNA, 655 bp, Homo sapiens
  misc_feature (285)..(285): n is a, c, g, or t
caacgccaaccgctccgctgcgcgcagtgctggtgctgcaggctctcgtgctgcagcgttgggtggatctagtgatccggcttccaacatgtggcagctctgggcctccctctgtctgcctgactggtgtatggccaagtgccctggagacaggccctctattccatcaccctgtacggcatgagcttggtcaactaatgtacaacgaaactggaagtacccacgtaggcatgtgccggtgcagcaactatcgtacacactgttgtggagcattgacgctcactntcgaatgacgggcgtaatgattgtgctaccgttcgcttggtgttgtgtgcccaaagcgcatccaccgaagatgatcgttactagttttacacgacggtagcctgtcagtctagccatgacaaggctatctgaatagcagcgtgtgaagcaactgtgccaacagttgtcgccagcacatccacaagagatacagagagccagtggcgtaccttgtaggcttcctgcctggtgcgcttctgcggcgctgttggaatgcccatctactgagcctggagtctgcagtccagcaccagatgtcgcagctgtacagctgttggagtgtgtccgtgcgtgatgaccttgctcacgttgctgtggcagcatgtgtgcg

SEQ ID NO: 624642 - DNA, 153 bp, Homo sapiens
gctaaagcatgttcttctatttgcaaatgactggaattcataggtaagacactgcctgtcacttacaattatgggacacacatgtcatgctttatatttgtgtgcagtagaaaagctccaggttggaacatttgggagtatttaatactaatg

SEQ ID NO: 624643 - DNA, 797 bp, Homo sapiens
  misc_feature (522)..(523): n is a, c, g, or t
  misc_feature (531)..(532): n is a, c, g, or t
  misc_feature (535)..(536): n is a, c, g, or t
  misc_feature (551)..(551): n is a, c, g, or t
  misc_feature (568)..(568): n is a, c, g, or t
  misc_feature (589)..(589): n is a, c, g, or t
  misc_feature (593)..(593): n is a, c, g, or t
gaaacttataacctcgggaggcaggtccttcccctcagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctatgatcctctaagaaccaagtccttgaaacttttggctcaaagtggatacagagacaactttttctagaaagttcagaaaagtgtattttgaggacggagtctggggaaatcaatgggatggggctgactttgaaacaaactgggataggatcctgtttatggaggaaacaccacacaccttggaaatgacatcgggaactggccagatgttctttcacctcctccgttttgattccgattgcttcaggacttgaactgttactccgctcgctggttgnnggttgggnnttnngggtggtggtggatngataactggttttcagnttatttttgacattgcttttnctgnctgtttgcttccctattcacttctgtttacaattcaacgtatttttttctcctcacaggattgcggaagcaggggggactgggttcggtttcaagaaaaactcggttggccgggcacccgggggtcatggcctgtaatcctaagcccttggggaaggctgagaggcgggcggaatcacctgaaggtcaagagttcccgaaaacg

SEQ ID NO: 624644 - DNA, 851 bp, Homo sapiens
  misc_feature (576)..(577): n is a, c, g, or t
  misc_feature (585)..(586): n is a, c, g, or t
  misc_feature (589)..(590): n is a, c, g, or t
  misc_feature (605)..(605): n is a, c, g, or t
  misc_feature (622)..(622): n is a, c, g, or t
  misc_feature (643)..(643): n is a, c, g, or t
  misc_feature (647)..(647): n is a, c, g, or t
gaaacttataacctcgggaggcaggtccttcccctcagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctatgatcctctaagaaccaagtccttgaaacttttggctcaaagtggatacagagacaactttttctagaaagttcagaaaagtgtattttgaggacggagtctggggaaatcaatgggatggggctaaaatcgtgcctggcagtgaccgggttcttgttctaggatgtggagggagcagggactttgaaacaaactgggataggatcctgtttatggaggaaacaccacacaccttggaaatgacatcgggaactggccagatgttctttcacctcctccgttttgattccgattgcttcaggacttgaactgttactccgctcgctggttgnnggttgggnnttnngggtggtggtggatngataactggttttcagnttatttttgacattgcttttnctgnctgtttgcttccctattcacttctgtttacaattcaacgtatttttttctcctcacaggattgcggaagcaggggggactgggttcggtttcaagaaaaactcggttggccgggcacccgggggtcatggcctgtaatcctaagcccttggggaaggctgagaggcgggcggaatcacctgaaggtcaagagttcccgaaaacg

SEQ ID NO: 624645 - DNA, 797 bp, Homo sapiens
  misc_feature (504)..(504): n is a, c, g, or t
  misc_feature (536)..(536): n is a, c, g, or t
  misc_feature (542)..(542): n is a, c, g, or t
  misc_feature (566)..(566): n is a, c, g, or t
  misc_feature (651)..(651): n is a, c, g, or t
  misc_feature (674)..(674): n is a, c, g, or t
  misc_feature (680)..(681): n is a, c, g, or t
  misc_feature (704)..(704): n is a, c, g, or t
  misc_feature (752)..(752): n is a, c, g, or t
gaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgactatttgttagcaccattgccaatgtctggttggtttccaatacggtagatgcatcagtaggtctttggaaaaactgtaccaacattagctgcagtgaacagcactgtacatatgcacagtgaagatgcacctacaagacagtgcaggccttacatgcattactactactcatacatacttactgtgtacattgccctacctggtacttacgtgttaccagactacttacaccatggagaagggaaaccggttacttaccttctacagggcgccaccacactgngtgttgctgggctgttgcattacttgttgggnggtgtncatactaacactagtacattaatncgaatacgtgaatggaaacgcagtattcaccacgggctattacctaacatcctggggctggaatctgacttctgctttcagcttncatcatacggacgttactctaanctggtnnctggagaaaagaaaataaagggncgggacgagtttcatgggggatctggggggggtgggggaggagggaanccgtttgaaatctggggagggggaagtgggaggtttgctgttaca

SEQ ID NO: 624646 - DNA, 323 bp, Homo sapiens
  misc_feature (23)..(23): n is a, c, g, or t
ggggggggggggggggcaaacanttttttcccccgggggggggggggggttttttttttttgggggcgccccccccccccccccggccttgggggcggggggcccccgggggggcgttttttttttttttttggggggcccccccccccttcctttttttttggcccccccctttttttttttttttggttttccccttggggccgtttttttttttcttggtttttcccccctttttttcccttttttggggcccttttttttttttttttttttttccttcccttttccttttttttttgtgtataaaaaattatttagta

SEQ ID NO: 624647 - DNA, 649 bp, Homo sapiens
cgtttttattattattaatttatttttttacatttccccatgctgcaatttcaaaaccaaagaaaaaattgtctcaaaaagggtcacgatgggcgcccggggttatacagagattttttgaagttacaagagctgtcccccgcccttatggggcgtaatgcggggtcccacaccaaggggccactccacgggaaaaaaaaaaaacgctcccaaagatttgggaccggggggcaaacagggcgatggggttttccgggagaaaatggggccccgccccaaactgttggggtttttgtccttttttggcccccggttttcatcgaaaaaccccgctgggagttccccgaggaaaccggcgcgttaaaattttgcccggggggctgcggtaaaaaaaacccccccgttttccttgcttattggcacccccctttccgttaaagtgggaactttttttggtattctaatgggggcctcacaatatggggcgcaccttgggatggagggttcccggggtaaaggttttttccccgcactccaacaaatgggcggccctggggaaaaagggaaaacggggggggcctttggggggggccattccactttattggggtcctcaccgtcacatttcagtcgggaaacccttgggagc

SEQ ID NO: 624648 - DNA, 542 bp, Homo sapiens
gataacttctttaccacttcagctcacatgaaagaagcagacaatgtgagcttgcatctgtcgttgctgatcttttaacagtatgctgcccgagtacattcagaccctatcagtgttctcacatctgccttcctccttcctgggaattaggagaaagaagagtctcagcctctatttcttacctcaaaagatagcacaaactaatcttcagcctttctcagacagtattggttgttctgttgggttgttgcttgtgtcaagtcagctaggaaagagtgtggagtaaaaactggcctgctgagtaaaacgcatgatccatgtcctccccaagccgcgctaatacacatcaacctgcagaaaagtgacttcttactcttgagacactctttcctcttgcttaatggttcgtgacagttcttcattttcctcctaccactctcaatattttgtttttgggatggataattctcctgtatctggccattaaatgttgatgtccaccaagcagccttaggcccttctgtcattcttatttcccttta

SEQ ID NO: 624649 - DNA, 844 bp, Homo sapiens
  misc_feature (48)..(48): n is a, c, g, or t
  misc_feature (56)..(56): n is a, c, g, or t
  misc_feature (78)..(78): n is a, c, g, or t
  misc_feature (194)..(195): n is a, c, g, or t
  misc_feature (273)..(273): n is a, c, g, or t
  misc_feature (352)..(353): n is a, c, g, or t
  misc_feature (364)..(364): n is a, c, g, or t
  misc_feature (373)..(374): n is a, c, g, or t
  misc_feature (394)..(394): n is a, c, g, or t
  misc_feature (486)..(486): n is a, c, g, or t
  misc_feature (525)..(525): n is a, c, g, or t
  misc_feature (541)..(541): n is a, c, g, or t
  misc_feature (641)..(641): n is a, c, g, or t
  misc_feature (724)..(724): n is a, c, g, or t
  misc_feature (726)..(726): n is a, c, g, or t
  misc_feature (730)..(730): n is a, c, g, or t
  misc_feature (732)..(732): n is a, c, g, or t
  misc_feature (743)..(743): n is a, c, g, or t
  misc_feature (745)..(745): n is a, c, g, or t
  misc_feature (750)..(751): n is a, c, g, or t
  misc_feature (755)..(755): n is a, c, g, or t
  misc_feature (761)..(762): n is a, c, g, or t
  misc_feature (774)..(774): n is a, c, g, or t
  misc_feature (803)..(803): n is a, c, g, or t
  misc_feature (807)..(807): n is a, c, g, or t
  misc_feature (827)..(827): n is a, c, g, or t
cgaggaagaaggccccactgtagtgctgaacccccacccgagccttgngctacaangagatccggaaaggcgagagtnggtcggagtgctctggctgtgtgatggagctgggaagcctggggctgaggaggctcaggaccccgaagggaagggagaacagtgagcactcccagcagaaatgaggagtgagtganngagattggcatgtgtccctgcaatggcctcttcctgtgggtgggtgaatgagctggagagctggatgcagtgaggagngagctggctctccaaggagtgggagtgactccaaactgctggagcaatgatgtgaccagctggccaatgtgagctgacnngctgagaagcnggctggagnngtgcaggaggaggagtgagngacaaccgggacatgttccatgaagctctccttcctgtgtgcccggtgcctacgtgcttcatgtggccctgtggcctgcagctgcgacgagngctggaggccatcctcccgtggaggacagccttgaggcngggcctgcccctccanggtcctgaggctaccccgaggagaagaaagaggaggagggcagcgcaaaccgcagaccagaggaccagtgagctggagagcctgtcggccattgagtgcngagctggagaaagtggccaccagctgcaggcactacggcggggctgagacaccggctgcagggcttggcccagggcacctgtngncctngntctgtgtcccntngcagnnctgnccgatnnccggagctgctncggtgggaggaggctcactgcacaggcgncctnttgcctagcttgtctatctngtccactgcctgggctt

SEQ ID NO: 624650 - DNA, 214 bp, Homo sapiens
agagtatacgacgcagtatatagagtctgtcgtgagtatgttggtctggggtgtagcctgagcataggggaaatcagtcaaaaagcctcctagtctgggaatacagctcctattgatagagacatagtgaaagtaagctacaacgtattatgtatcgtgtagtacgatatctagcgatgagtttgctaatacaatgccagtgaggccacctaca

SEQ ID NO: 624651 - DNA, 806 bp, Homo sapiens
  misc_feature (48)..(48): n is a, c, g, or t
  misc_feature (56)..(56): n is a, c, g, or t
  misc_feature (78)..(78): n is a, c, g, or t
  misc_feature (194)..(195): n is a, c, g, or t
  misc_feature (235)..(235): n is a, c, g, or t
  misc_feature (314)..(315): n is a, c, g, or t
  misc_feature (326)..(326): n is a, c, g, or t
  misc_feature (335)..(336): n is a, c, g, or t
  misc_feature (356)..(356): n is a, c, g, or t
  misc_feature (448)..(448): n is a, c, g, or t
  misc_feature (487)..(487): n is a, c, g, or t
  misc_feature (503)..(503): n is a, c, g, or t
  misc_feature (603)..(603): n is a, c, g, or t
  misc_feature (686)..(686): n is a, c, g, or t
  misc_feature (688)..(688): n is a, c, g, or t
  misc_feature (692)..(692): n is a, c, g, or t
  misc_feature (694)..(694): n is a, c, g, or t
  misc_feature (705)..(705): n is a, c, g, or t
  misc_feature (707)..(707): n is a, c, g, or t
  misc_feature (712)..(713): n is a, c, g, or t
  misc_feature (717)..(717): n is a, c, g, or t
  misc_feature (723)..(724): n is a, c, g, or t
  misc_feature (736)..(736): n is a, c, g, or t
  misc_feature (765)..(765): n is a, c, g, or t
  misc_feature (769)..(769): n is a, c, g, or t
  misc_feature (789)..(789): n is a, c, g, or t
cgaggaagaaggccccactgtagtgctgaacccccacccgagccttgngctacaangagatccggaaaggcgagagtnggtcggagtgctctggctgtgtgatggagctgggaagcctggggctgaggaggctcaggaccccgaagggaagggagaacagtgagcactcccagcagaaatgaggagtgagtganngagattggcatgtgtccctgcaatggcctcttcctggagngagctggctctccaaggagtgggagtgactccaaactgctggagcaatgatgtgaccagctggccaatgtgagctgacnngctgagaagcnggctggagnngtgcaggaggaggagtgagngacaaccgggacatgttccatgaagctctccttcctgtgtgcccggtgcctacgtgcttcatgtggccctgtggcctgcagctgcgacgagngctggaggccatcctcccgtggaggacagccttgaggcngggcctgcccctccanggtcctgaggctaccccgaggagaagaaagaggaggagggcagcgcaaaccgcagaccagaggaccagtgagctggagagcctgtcggccattgagtgcngagctggagaaagtggccaccagctgcaggcactacggcggggctgagacaccggctgcagggcttggcccagggcacctgtngncctngntctgtgtcccntngcagnnctgnccgatnnccggagctgctncggtgggaggaggctcactgcacaggcgncctnttgcctagcttgtctatctngtccactgcctgggctt

SEQ ID NO: 624652 - DNA, 301 bp, Homo sapiens
tttatgggccaggttcgttttggacttaatttgccattattgtgatgtggataaaatctttaattttggtttttaggactttgaattggtctcccgggatattcctgggatgaaaggattgcccacccccaatatagactagattatcccatgggtttgggtttttgttcccttttcaaccttttttttttccactataagtaatcccccggtgtggggtagccagtgggcttccgtcaaaatccccttttttcctgctcccgtataaccgcttgccggccataaaaatttttttgcccca

SEQ ID NO: 624653 - DNA, 234 bp, Homo sapiens
  misc_feature (22)..(22): n is a, c, g, or t
  misc_feature (33)..(33): n is a, c, g, or t
  misc_feature (37)..(37): n is a, c, g, or t
  misc_feature (163)..(163): n is a, c, g, or t
  misc_feature (220)..(220): n is a, c, g, or t
gatgttttcaccagagattatntttccctcccnctanttgtgaatataccaattaaagtaagacaatccagtaagtaagagggtagccccaaacacagtatgtctccattctagcactctactgcctgcttagaatacaccaaccctggaagacctttccaancgtaaaatcccagtctgcccctatcaaaattgccacagccacttttactacttgtgnccatagtagactca
